(12) United States Patent
Holzapfel et al.

(10) Patent No.: US 11,618,880 B2
(45) Date of Patent: Apr. 4, 2023

(54) COMPOSITIONS COMPRISING BACTERIAL STRAINS AND USE THEREOF IN CONTROLLING PATHOGENIC MICROORGANISMS

(71) Applicant: Better Air International Limited, Central (HK)

(72) Inventors: Wilhelm H. Holzapfel, Gyung-buk (KR); Yosep Ji, Gyung-buk (KR); Yuli Horesh, Tel-Aviv (IL); Michael Hoffman, Moshav Udim (IL); Shimrit Laor, Netanya (IL)

(73) Assignee: Better Air International Limited, Central (HK)

( * ) Notice: Subject to any disclaimer, the term of this patent is extended or adjusted under 35 U.S.C. 154(b) by 171 days.

(21) Appl. No.: 17/019,281

(22) Filed: Sep. 13, 2020

(65) Prior Publication Data
US 2020/0407807 A1    Dec. 31, 2020

Related U.S. Application Data

(63) Continuation of application No. PCT/IB2019/052010, filed on Mar. 12, 2019.

(60) Provisional application No. 62/641,443, filed on Mar. 12, 2018.

(51) Int. Cl.
| | |
|---|---|
| *C12N 1/20* | (2006.01) |
| *A61P 31/04* | (2006.01) |
| *A61K 35/742* | (2015.01) |
| *C12R 1/07* | (2006.01) |
| *A61P 11/00* | (2006.01) |
| *A61K 9/00* | (2006.01) |

(52) U.S. Cl.
CPC ............ *C12N 1/205* (2021.05); *A61K 9/0073* (2013.01); *A61K 35/742* (2013.01); *A61P 11/00* (2018.01); *A61P 31/04* (2018.01); *C12N 1/20* (2013.01); *C12R 2001/07* (2021.05)

(58) Field of Classification Search
None
See application file for complete search history.

(56) References Cited

U.S. PATENT DOCUMENTS

| | | |
|---|---|---|
| 2,293,722 A | 8/1942 | Erickson |
| D221,836 S | 9/1971 | Giles et al. |
| D239,922 S | 5/1976 | Utley |
| D250,394 S | 11/1978 | Menius |
| D279,452 S | 7/1985 | Beechuk |
| D284,362 S | 6/1986 | Biesecker |
| D309,711 S | 8/1990 | Biesecker |
| D376,760 S | 12/1996 | Sykes |
| D433,336 S | 11/2000 | Weber |
| 6,405,944 B1 | 6/2002 | Benahkhoudja |
| D472,471 S | 4/2003 | McClure et al. |
| D473,143 S | 4/2003 | McClure et al. |
| D489,992 S | 5/2004 | Brauner et al. |
| D571,662 S | 6/2008 | Clark et al. |
| 7,858,336 B1 | 12/2010 | Garner et al. |
| D630,946 S | 1/2011 | Crawford |
| D656,599 S | 3/2012 | Browder |
| D663,215 S | 7/2012 | Clay et al. |
| D667,101 S | 9/2012 | Browder |
| D673,253 S | 12/2012 | Mack |
| D678,496 S | 3/2013 | Browder |
| 8,986,610 B2 | 3/2015 | Ben Haim |
| 9,486,552 B1 | 11/2016 | Ansley et al. |
| D805,909 S | 12/2017 | Matsuishi |
| D875,532 S | 2/2020 | Lehanneur |
| D879,613 S | 3/2020 | Lehanneur |
| 2003/0189066 A1 | 10/2003 | Schiller |
| 2005/0160553 A1 | 7/2005 | Gregory |
| 2005/0252930 A1 | 11/2005 | Contadini et al. |
| 2007/0217945 A1 | 9/2007 | Selander |
| 2009/0238716 A1 | 9/2009 | Weening |
| 2009/0324815 A1 | 12/2009 | Nielsen et al. |
| 2010/0021576 A1 | 1/2010 | Chang et al. |
| 2011/0214245 A1 | 9/2011 | Bassett |
| 2012/0152882 A1 | 6/2012 | Tune |
| 2012/0168971 A1 | 7/2012 | Hansen et al. |
| 2013/0015956 A1 | 1/2013 | Wegelin et al. |
| 2013/0068783 A1 | 3/2013 | Gasper et al. |
| 2014/0263426 A1 | 9/2014 | Gasper |
| 2016/0101925 A1 | 4/2016 | Franz et al. |
| 2017/0035262 A1 | 2/2017 | Li et al. |
| 2017/0035925 A1 | 2/2017 | Sevy |
| 2017/0348364 A1 | 12/2017 | Garner et al. |
| 2020/0405781 A1* | 12/2020 | Holzapfel .............. C12N 1/205 |
| 2020/0407808 A1* | 12/2020 | Holzapfel ................ C12N 1/20 |
| 2020/0407809 A1* | 12/2020 | Holzapfel ............ A61K 35/742 |
| 2021/0046256 A1 | 2/2021 | Hoffman et al. |
| 2021/0046497 A1 | 2/2021 | Hoffman et al. |
| 2021/0204774 A1 | 7/2021 | Dery et al. |

FOREIGN PATENT DOCUMENTS

| | | |
|---|---|---|
| CN | 1177636 | 4/1998 |
| CN | 1642827 | 7/2005 |
| CN | 1934241 | 3/2007 |
| CN | 103589655 | 2/2014 |
| CN | 103703121 | 4/2014 |

(Continued)

OTHER PUBLICATIONS

Restriction Official Action dated Jul. 13, 2021 from the US Patent and Trademark Office Re. U.S. Appl. No. 17/019,568. (5 pages).

(Continued)

*Primary Examiner* — Gary B Nickol
*Assistant Examiner* — Jegatheesan Seharaseyon

(57) ABSTRACT

An isolated bacterial strain *Bacillus amyloliquefaciens* 298 is provided. A sample of the strain having been deposited as KCTC 13469BP at the Korean Collection for Type Cultures or a functional homolog of same wherein said isolated microbial strain is purified to a level of at least 99%. Also provided are compositions and articles comprising the bacterial strain and methods of using same.

2 Claims, 6 Drawing Sheets
(2 of 6 Drawing Sheet(s) Filed in Color)
Specification includes a Sequence Listing.

(56) References Cited

FOREIGN PATENT DOCUMENTS

| | | |
|---|---|---|
| CN | 104487566 | 4/2015 |
| CN | 104688895 | 6/2015 |
| CN | 104736162 | 6/2015 |
| CN | 204501790 | 7/2015 |
| CN | 303340433 S | 8/2015 |
| CN | 105087423 | 11/2015 |
| CN | 105219669 | 1/2016 |
| CN | 205032305 | 2/2016 |
| CN | 107567493 | 1/2018 |
| CN | 107723267 | 2/2018 |
| KR | 20-2009-0007893 | 8/2009 |
| KR | 10-2014-0128870 | 11/2014 |
| KR | 10-2017-0130341 | 11/2017 |
| WO | WO 01/34182 | 5/2001 |
| WO | WO 2016/060934 | 4/2016 |
| WO | WO 2016/118864 | 7/2016 |
| WO | WO 2019/175774 | 9/2019 |
| WO | WO 2019/175775 | 9/2019 |
| WO | WO 2019/175777 | 9/2019 |
| WO | WO 2019/175777 A8 | 9/2019 |
| WO | WO 2019/175780 | 9/2019 |
| WO | WO 2019/175782 | 9/2019 |
| WO | WO 2019/175782 A8 | 9/2019 |
| WO | WO 2019/175783 | 9/2019 |
| WO | WO 2019/224691 | 11/2019 |
| WO | WO 2019/175783 A8 | 10/2020 |

OTHER PUBLICATIONS

International Preliminary Report on Patentability dated Dec. 3, 2020 From the International Bureau of WIPO Re. Application No. PCT/IB2019/054141. (9 Pages).
Restriction Official Action dated Jul. 7, 2021 from the US Patent and Trademark Office Re. U.S. Appl. No. 17/019,280. (5 pages).
International Preliminary Report on Patentability dated Sep. 24, 2020 From the International Bureau of WIPO Re. Application No. PCT/IB2019/052007. (6 Pages).
Examination Report dated Sep. 7, 2018 From the Government of India, Patent Office, Intellectual Property Building Re.: Application No. 309690.
Examination Report dated Sep. 11, 2018 From the Government of India, Patent Office, Intellectual Property Building Re.: Application No. 309744.
International Preliminary Report on Patentability dated Sep. 24, 2020 From the International Bureau of WIPO Re. Application No. PCT/IB2019/052016. (7 Pages).
International Preliminary Report on Patentability dated Sep. 24, 2020 From the International Bureau of WIPO Re. Application No. PCT/IB2019/052008. (6 Pages).
International Preliminary Report on Patentability dated Sep. 24, 2020 From the International Bureau of WIPO Re. Application No. PCT/IB2019/052010. (7 Pages).
International Preliminary Report on Patentability dated Sep. 24, 2020 From the International Bureau of WIPO Re. Application No. PCT/IB2019/052014. (7 Pages).
International Preliminary Report on Patentability dated Sep. 24, 2020 From the International Bureau of WIPO Re. Application No. PCT/IB2019/052017. (7 Pages).

International Search Report and the Written Opinion dated Jul. 3, 2019 From the International Searching Authority Re. Application No. PCT/IB2019/052014. (16 Pages).
International Search Report and the Written Opinion dated Jul. 3, 2019 From the International Searching Authority Re. Application No. PCT/IB2019/052017. (14 Pages).
International Search Report and the Written Opinion dated Sep. 17, 2019 From the International Searching Authority Re. Application No. PCT/IB2019/054141. (11 Pages).
International Search Report and the Written Opinion dated Jun. 26, 2019 From the International Searching Authority Re. Application No. PCT/IB2019/052016. (15 Pages).
International Search Report and the Written Opinion dated Jun. 27, 2019 From the International Searching Authority Re. Application No. PCT/IB2019/052007. (12 Pages).
International Search Report and the Written Opinion dated Jun. 27, 2019 From the International Searching Authority Re. Application No. PCT/IB2019/052008. (10 Pages).
International Search Report and the Written Opinion dated Jun. 27, 2019 From the International Searching Authority Re. Application No. PCT/IB2019/052010. (17 Pages).
Notice of Amendment dated Dec. 11, 2018 From the State Intellectual Property Office of the People's Republic of China Re. Application No. 201830508569.8. (2 pages).
Notification of Reason for Rejection dated Jan. 30, 2019 From the Japanese Patent Office Re. Application No. 2018-019747. (2 Pages).
Official Action dated Jun. 12, 2020 from the US Patent and Trademark Office Re. U.S. Appl. No. 29/640,027. (19 pages).
Official Action dated Jun. 12, 2020 from the US Patent and Trademark Office Re. U.S. Appl. No. 29/640,032. (13 pages).
Official Action dated Jun. 25, 2020 from the US Patent and Trademark Office Re. U.S. Appl. No. 29/653,164. (9 pages).
Cho "Characterization of Potential Probiotics Bacillus Subtilis CS90 From Soybean Paste (Doenjang) and Its Antimicrobial Activity Against Food-Borne Pathogens", Journal of Applied Biological Chemistry, 51(5): 285-291, 2008.
Gu et al. "The Preventive Effect and Therapeutic Effect of Spraying Agent of Bacillus Pab02 on Respiratory Infection in Broilers", Proceedings of the 10th in the 4th National Academic Seminar and Animal Micro-Ecology Enterprise Development Forum, p. 450-458, Aug. 1, 2010.
Jeon et al. "Screening and Characterization of Potential Bacillus Starter Cultures for Fermenting Low-Salt Soybean Past (Doenjang)", Journal of Microbiology and Biotechnology, 26(4): 666-674, Apr. 2016.
Ji et al. "Probiotic Bacillus Amyloliquefaciens SC06 Prevents Bacterial Translocation in Weaned Mice", Indian Journal of Microbiology, 53(3): 323-328, Published Online Mar. 16, 2013.
Wong et al. "An Antifungal Protein From Bacillus Amyloliquefaciens", Journal of Applied Microbiology, 105(6): 1888-1898, Dec. 2008.
Xie et al. "Isolation and Characterization of a Bacteriocin Produced by an Isolated Bacillus Subtihs LFB112 That Exhibits Antimicrobial Activity Against Domestic Animal Pathogens", African Journal of Biotechnology, 8(20): 5611-5619, Oct. 19, 2009.
Official Action dated Sep. 22, 2021 from the US Patent and Trademark Office Re. U.S. Appl. No. 17/019,280. (26 pages).

\* cited by examiner

COMPOSITIONS COMPRISING BACTERIAL STRAINS AND USE THEREOF IN CONTROLLING PATHOGENIC MICROORGANISMS

RELATED APPLICATION/S

This application is a US Continuation of PCT Patent Application No. PCT/IB2019/052010 having International filing date of Mar. 12, 2019, which claims the benefit of priority under 35 USC § 119(e) of U.S. Provisional Patent Application No. 62/641,443 filed on Mar. 12, 2018. The contents of the above applications are all incorporated by reference as if fully set forth herein in their entirety.

PCT Patent Application No. PCT/M2019/052010 filed on Mar. 12, 2019 is also related to co-filed PCT Patent Applications Nos. PCT/M2019/052008, PCT/IB2019/052007, PCT/IB2019/052017, PCT/IB2019/052014 and PCT/IB2019/052016 entitled "CARTRIDGE FOR AN AUTOMATED AEROSOL DISPENSING DEVICE"; "ELECTRONIC SAFETY FEATURE FOR AN AUTOMATED AEROSOL DISPENSING DEVICE"; "COMPOSITIONS COMPRISING BACTERIAL STRAINS AND USE THEREOF IN CONTROLLING PATHOGENIC MICROORGANISMS"; "COMPOSITIONS COMPRISING BACTERIAL STRAINS AND USE THEREOF IN CONTROLLING PATHOGENIC MICROORGANISMS" and "COMPOSITIONS COMPRISING BACTERIAL STRAINS AND USE THEREOF IN CONTROLLING PATHOGENIC MICROORGANISMS". The contents of the above applications are all incorporated by reference as if fully set forth herein in their entirety.

SEQUENCE LISTING STATEMENT

The ASCII file, entitled 84592SequenceListing.txt, created on Sep. 13, 2020, comprising 5,109,776 bytes, submitted concurrently with the filing of this application is incorporated herein by reference.

BUDAPEST TREATY DEPOSIT

The biological materials that are the subject of the instant application were deposited and have been accepted by the International Depository Authority under the Budapest Treaty. KCTC 13469BP has been deposited in the Korean Collection for Type Cultures Korea Research Institute of Bioscience and Biotechnology (KRIBB) 181, Ipsin-gil, Jeongeup-si, Jeolllahuk-do 56212, Republic of Korea on Jan. 25, 2018. These materials will be irrevocably and without restriction or condition released to the public upon the issuance of a patent, and the materials will be replaced if useable samples cannot be dispensed by the Depository.

FIELD AND BACKGROUND OF THE INVENTION

The present invention, in some embodiments thereof, relates to compositions comprising bacterial strains and use thereof in controlling pathogenic microorganisms.

A respiratory tract infection (RTI) refers to any of a number of infectious diseases involving the respiratory tract. An infection of this type is normally further classified as an upper respiratory tract infection (URI or URTI) or a lower respiratory tract infection (LRI or LRTI). Lower respiratory infections, such as pneumonia, tend to be far more serious conditions than upper respiratory infections, such as the common cold.

Various *Bacillus subtilis* group strains were reported to antagonize pathogenic bacteria such as *Xanthomonas*, *Pseudomonas* and *Bacillus cereus* group microorganisms and molds such as *Fusarium, Botrytis cinerea, Phoma tracheiphila*. Several bioactive components such as enzymes that degrade fungal structural polymers (protease and chitinase), lipopeptides (iturin, surfactin and fengycin), antibiotics (fengycin, surfactin, iturin and bacillomycin D) and antifungal volatiles have been identified as the main component of antagonistic mode of action (Xu, Park et al. 2016). This pathogen antagonistic characteristic has allowed them to be used as promising biological control agents and implemented in various foods and supplement preparations.

Identifying probiotic microbial strains which can be used in the effective and safe treatment and prophylaxis of respiratory tract infections is therefore highly desired.

Additional background art includes:

Jeon, Jung et al. 2016 J. Microbiol. Biotechnol 26(4): 666-674;

Cho 2008 Journal of Applied Biological Chemistry 51(6): 285-291;

U.S. Publication No. 20170348364;

U.S. Pat. No. 8,986,610.

SUMMARY OF THE INVENTION

According to an aspect of some embodiments of the present invention there is provided an isolated bacterial strain *Bacillus amyloliquefaciens* 298, a sample of which having been deposited as KCTC 13469BP at the Korean Collection for Type Cultures or a functional homolog of same wherein the isolated microbial strain is purified to a level of at least 99%.

According to an aspect of some embodiments of the present invention there is provided an isolated bacterial strain *Bacillus amyloliquefaciens* 298 or a functional homolog thereof comprising a genomic nucleic acid sequence at least 97% identical to the nucleic acid sequence set forth in SEQ ID NO: 4), wherein the isolated microbial strain is purified to a level of at least 99%.

According to an aspect of some embodiments of the present invention there is provided an isolated bacterial strain *Bacillus amyloliquefaciens* 298 or a functional homolog exhibiting:

(i) growth inhibitory effects against bacteria and fungi, as shown in Tables 3 and 4, respectively;

(ii) no lecithinase activity as determined by the absence of a white precipitate when the isolated bacterial strain or functional homolog of same is streaked out onto egg yolk agar and incubated for 24 h at 37° C.; and (iii) gamma hemolytic activity when streaked onto 5% sheep blood agar and incubated for 24 h at 37° C., wherein the isolated microbial strain is purified to a level of at least 99%.

According to some embodiments of the invention, the isolated bacterial strain or functional homolog has no lecithinase activity as determined by the absence of a white precipitate when the isolated bacterial strain or functional homolog of same is streaked out onto egg yolk agar and incubated for 24 h at 37° C.

According to some embodiments of the invention, the isolated bacterial strain or functional homolog exhibits gamma hemolytic activity when streaked onto 5% sheep blood agar and incubated for 24 h at 37° C.

According to some embodiments of the invention, the isolated bacterial strain or functional homolog is sensitive to an antibiotic selected from the group consisting of erythromycin, gentamicin, tetracycline, streptomycin, vancomycin, chloramphenicol, kanamycin and clindamycin according to the European Food Safety Authority MIC breakpoints for *Bacillus* species.

According to some embodiments of the invention, the isolated bacterial strain or functional homolog is incapable of colonizing a mammalian lung.

According to some embodiments of the invention, the isolated bacterial strain or functional homolog exhibits growth inhibitory effects against bacteria and fungi, as shown in Tables 3 and 4, respectively.

According to some embodiments of the invention, the functional homolog is characterized by at least one of:

at least 70% DNA-DNA relatedness to the deposited strain with 5 uC or less DTm;

at least 97% genomic DNA sequence identity to the genomic DNA sequence of the deposited strain;

having an average nucleotide identity (ANI) of at least about 97% with the deposited strain;

having a tetranucleotide signature frequency correlation coefficient of at least about 0.99 with the deposited strain;

having a Dice similarity coefficient;

being of the same ribotype as that of the deposited strain;

having a Pearson correlation coefficient of at least about 0.99 with the deposited strain;

having a multilocus sequence typing (MLST) of at least about 0.99 with the deposited strain;

having a functionality conserved gene that is at least about 97% identical to that of the deposited strain as determined at a level of a single gene or multilocus sequence analysis (MLSA);

having a 16S nucleic acid sequence that is at least about 97% identical to that of the deposited strain;

having substantially the same biochemical profiling as determined by the GEN III redox chemistry;

maintaining the coding and/or non-coding sequence order as that of the deposited strain;

having the same codon usage as that of the deposited strain.

According to an aspect of some embodiments of the present invention there is provided a composition comprising the isolated bacterial strain or functional homolog of same, wherein the composition does not comprise more than 5 different species of microbes.

According to some embodiments of the invention, the composition comprises at least 2 different species of microbes.

According to some embodiments of the invention, the composition comprises at least 3 different species of microbes.

According to some embodiments of the invention, the isolated bacterial strain or functional homolog of same is present in the composition at an amount of at least $10^6$ CFU/gr powder or $10^6$ CFUs/ml.

According to some embodiments of the invention, the composition is formulated as a liquid formulation.

According to some embodiments of the invention, the composition is formulated as a dry formulation.

According to some embodiments of the invention, the composition is formulated as a gel formulation.

According to some embodiments of the invention, the composition is formulated as a sporulated formulation.

According to some embodiments of the invention, the bacterial strain or functional homolog of same is a fermentation product.

According to some embodiments of the invention, the bacterial strain or functional homolog of same is a lysate.

According to some embodiments of the invention, the bacterial strain or functional homolog is viable.

According to an aspect of some embodiments of the present invention there is provided an article of manufacture comprising the isolated bacterial strain or functional homolog of same or the composition.

According to some embodiments of the invention, the bacterial strain or functional homolog of same is attached to a solid support.

According to some embodiments of the invention, the bacterial strain or functional homolog of same is soluble.

According to some embodiments of the invention, the article of manufacture comprises a commodity selected from the group consisting of a food, a feed, a beverage, a pharmaceutical, a nutraceutical, a cosmetic, a filter, a matrix and an aerosol system.

According to an aspect of some embodiments of the present invention there is provided an aerosol dispensing device comprising an effective amount of the bacterial strain or functional homolog of same or composition.

According to an aspect of some embodiments of the present invention there is provided an aerosol dispensing device comprising an effective amount of bacteria of the species *Bacillus amyloliquefaciens*.

According to some embodiments of the invention, the aerosol dispensing device is automated.

According to an aspect of some embodiments of the present invention there is provided a method of controlling a population of pathogenic bacteria and/or fungi in a respiratory system, the method comprising administering to a subject in need thereof an effective amount of bacteria of the species *Bacillus amyloliquefaciens*, thereby controlling the population of pathogenic bacteria and/or fungi in the respiratory system.

According to an aspect of some embodiments of the present invention there is provided a method of controlling a population of pathogenic bacteria and/or fungi, the method comprising providing an effective amount of the isolated bacterial strain or functional homolog of 8 or the composition as described herein, thereby controlling the population of pathogenic bacteria and/or fungi.

According to some embodiments of the invention, the controlling is prophylactic.

According to some embodiments of the invention, the controlling is therapeutic.

According to some embodiments of the invention, the effective amount comprises at least $10^6$ CFU/gr powder $10^6$ CFUs/ml.

According to some embodiments of the invention, the contacting comprises in vivo contacting.

According to some embodiments of the invention, the contacting is by inhalation.

According to some embodiments of the invention, the contacting is by oral administration.

According to some embodiments of the invention, the contacting is by enteral administration.

According to some embodiments of the invention, the contacting is by paraenteral administration.

According to some embodiments of the invention, the contacting comprises in vitro contacting.

According to some embodiments of the invention, the contacting is by using the aerosol dispensing device of any one of claims 24-26.

According to an aspect of some embodiments of the present invention there is provided a method of producing bacteria, the method comprising:

(a) culturing the bacterial strain or functional homolog of same under conditions that allow propagation;

(b) harvesting the bacterial strain or functional homolog of same.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE SEVERAL VIEWS OF THE DRAWING(S)

The patent or application file contains at least one drawing executed in color. Copies of this patent or patent application publication with color drawing(s) will be provided by the Office upon request and payment of the necessary fee.

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

DESCRIPTION OF SPECIFIC EMBODIMENTS OF THE INVENTION

Figure 1:
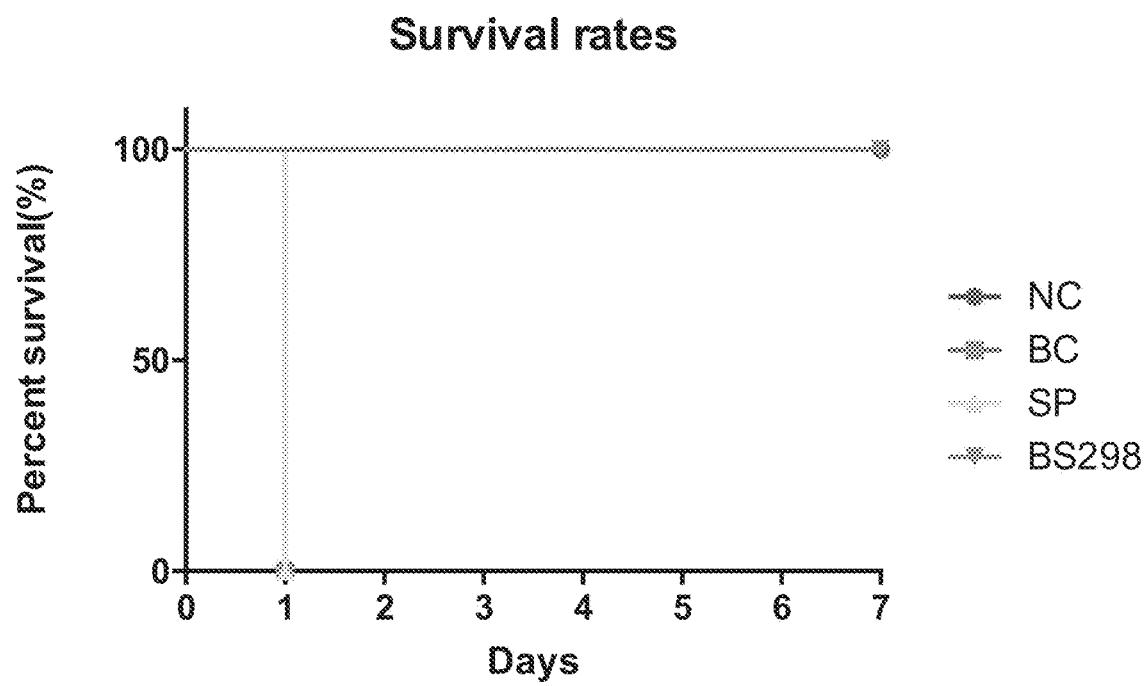
FIG. 1 is a graph showing the survival rates of mice after respiratory tract infection (NC: negative control, BC: *B. cereus*, SP: *S. pneumoniae*, BS298: *B. amyloliquefaciens* 298).
Figure 2:
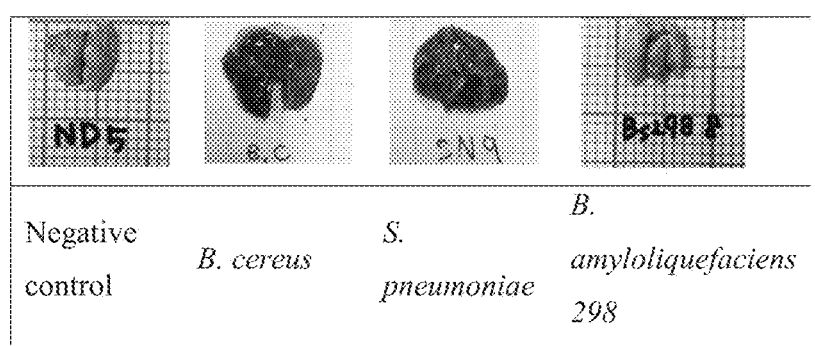
FIG. 2 is a photograph showing the appearance of lungs in each group described in FIG. 1.
Figure 3:
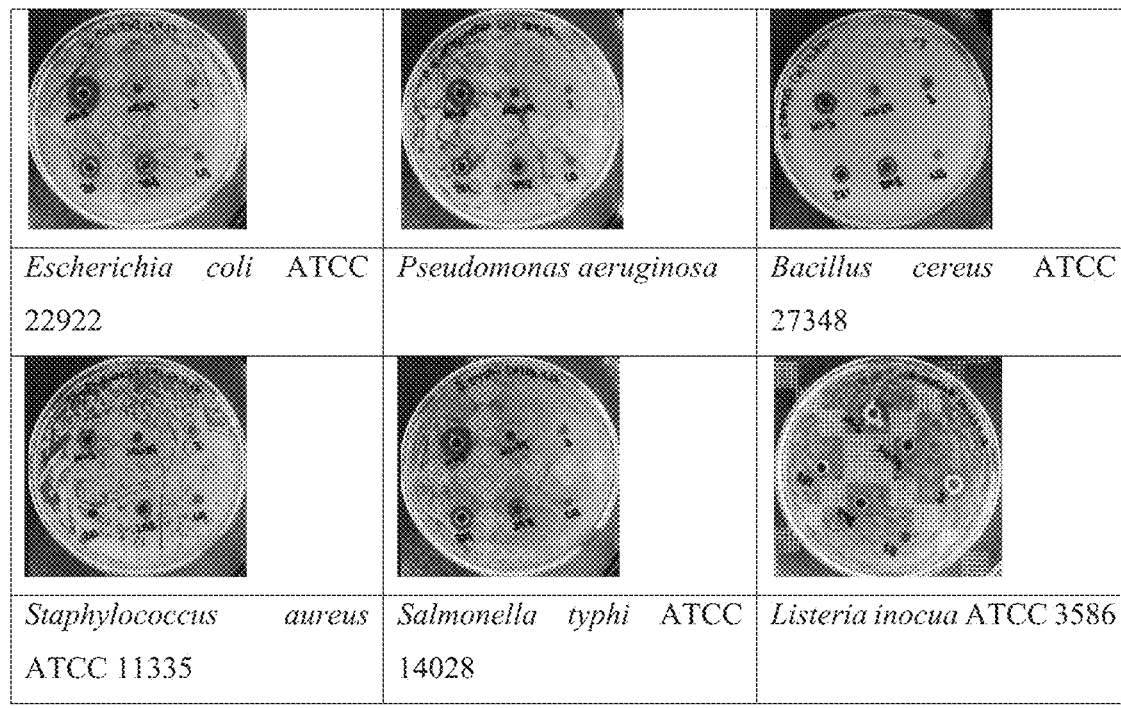
FIG. 3 is a photograph showing antagonism of pathogenic bacteria by *B. amyloliquefaciens* 298.
Figure 4:
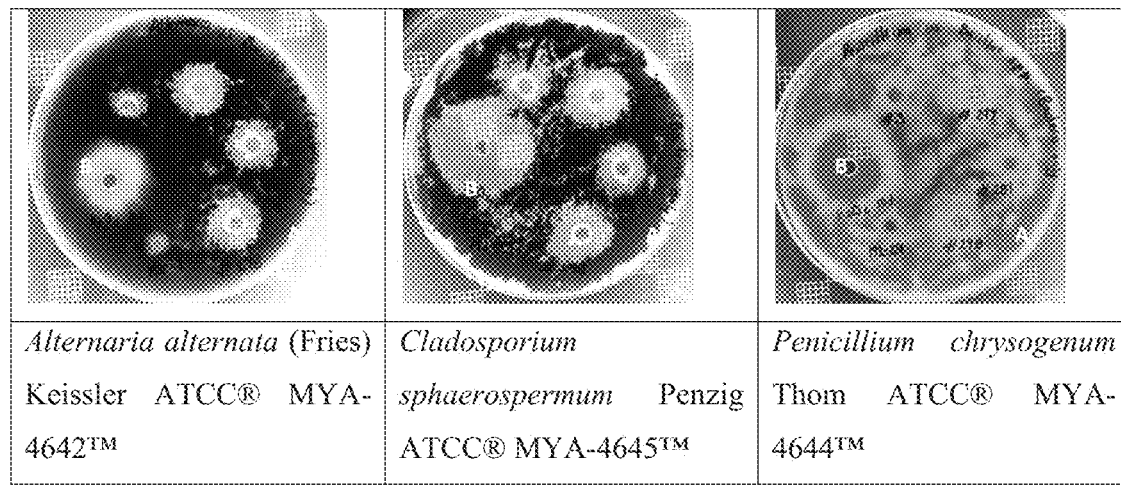
FIG. 4 is a photographic representation of results for the antagonism of test molds using *B. amyloliquefaciens* 298 (A) and 10% hydrogen peroxide (B) as a positive control.

The present invention, in some embodiments thereof, relates to compositions comprising bacterial strains and use thereof in controlling pathogenic microorganisms. Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

In a search for probiotic bacterial strains that can be effectively and safely used in controlling pathogenic microorganisms, the present inventors have identified a novel strain of *Bacillus amyloliquefaciens* (*B. amyloliquefaciens*), termed *B. amyloliquefaciens* strain number 298. The pathogenicity of the strain was assessed using in-vitro methods such as lecithinase activity, hemolysis tests and resistance to therapeutic antibiotics. *B. amyloliquefaciens* 298 safety was also evaluated in-vivo through a lung infection model in mice. Lastly, the efficacy of *Bacillus amyloliquefaciens* 298 in inhibiting the growth of *Escherichia coli*, *Pseudomonas aeruginosa*, *Bacillus cereus*, *Staphylococcus aureus*, *Salmonella Typhimurium*, *Alternaria alternata*, *Cladosporium sphaerospermum* and *Penicillium chrysogenum* was evaluated in-vitro.

Collectively these assays place *B. amyloliquefaciens* 298 as both safe for respiratory tract infection and functional with high potential to be used in various domestic, clinical and industrial applications.

Thus, according to an aspect of the invention there is provided an isolated bacterial strain *Bacillus amyloliquefaciens* 298 or a functional homolog thereof comprising a genomic nucleic acid sequence at least 97% identical to the nucleic acid sequence set forth in SEQ ID NO: 4), wherein said isolated microbial strain is purified to a level of at least 99%.

According to an alternative or an additional aspect of the invention there is provided an isolated bacterial strain *Bacillus amyloliquefaciens* 298 or a functional homolog exhibiting:

(i) growth inhibitory effects against bacteria and fungi, as shown in Tables 3 and 4, respectively;

(ii) no lecithinase activity as determined by the absence of a white precipitate when the isolated bacterial strain or functional homolog of same is streaked out onto egg yolk agar and incubated for 24 h at 37° C.; and (iii) gamma hemolytic activity when streaked onto 5% sheep blood agar and incubated for 24 h at 37° C., wherein said isolated microbial strain is purified to a level of at least 99%.

According to an alternative or an additional aspect of the invention there is provided an isolated bacterial strain *Bacillus amyloliquefaciens* 298, a sample of which having been deposited as KCTC 13469BP a functional homolog of same.

KCTC 13469BP has been deposited in the Korean Collection for Type Cultures, Korea Research Institute of Bioscience and Biotechnology (KRIBB) 181, Ipsin-gil, Jeongeup-si, Jeolllabuk-do 56212, Republic of Korea on Jan. 25, 2018.

The bacterial strain can be as deposited or a variant thereof, also referred to herein as a "functional homolog".

The term "the microbial strain" or "the bacterial strain" can refer to the deposited strain and/or the functional homolog.

As used herein "functional homolog" or "functionally homologous" or "variant" or a grammatical equivalent as used herein, refers to a modification (i.e., at least one mutation) of the deposited microbial strain resulting in a microbial strain that is endowed with substantially the same ensemble of biological activities (+/−10%, 20%, 40%, 50%, 60% when tested under the same conditions) as that of the deposited strain (see hereinbelow and in the Examples section which follows) and can be classified to the same species or strain based on known methods of species/strain classifications.

Following are non-limiting criteria for identifying a functional homolog. These criteria, which are mostly genetic, combined with the functional characteristic as defined hereinbelow and in the Examples section, which follows, will be facilitate the skilled artisan in defining the scope of the functional homolog.

Thus, according to a specific embodiment, the deposited strain and the functional homolog belong to the same operational taxonomic units (OTU).

An "OTU" (or plural, "OTUs") refers to a terminal leaf in a phylogenetic tree and is defined by a nucleic acid sequence, e.g., the entire genome, or a specific genetic sequence, and all sequences that share sequence identity to this nucleic acid sequence at the level of species. In some embodiments the specific genetic sequence may be the 16S-rRNA sequence or a portion of the 16S-rRNA (also referred to herein as "16S") sequence or other functionally conserved genes as listed below. In other embodiments, the entire genomes of two entities are sequenced and compared. In another embodiment, selected regions such as multilocus sequence tags (MLST, MLSA), specific genes, or sets of genes may be genetically compared. In 16S-rRNA embodiments, OTUs that share at least 97% average nucleotide identity across the entire 16S or some variable region of the 16S are considered the same OTU (see e.g. Claesson M J, Wang Q, O'Sullivan O, Greene-Diniz R, Cole J R, Ros R P, and O'Toole P W. 2010. Comparison of two next-generation sequencing technologies for resolving highly complex microbiota composition using tandem variable 16S rRNA gene regions. Nucleic Acids Res 38: e200. Konstantinidis K T, Ramette A, and Tiedje J M. 2006. The bacterial species definition in the genomic era. Philos Trans R Soc Lond B Biol Sci 361: 1929-1940). In embodiments involving the complete genome, MLSTs, specific genes, or sets of genes OTUs that share at least 95% average nucleotide identity are considered the same OTU (see e.g. Achtman M, and Wagner M. 2008. Microbial diversity and the genetic nature of microbial species. Nat. Rev. Microbiol. 6: 431-440. Konstantinidis K T, Ramette A, and Tiedje J M. 2006. The bacterial species definition in the genomic era. Philos Trans R Soc Lond B Biol Sci 361: 1929-1940). OTUs are frequently defined by comparing sequences between organisms. Such characterization employs, e.g., WGS data or a whole genome sequence.

According to a specific embodiment, the classification is based on DNA-DNA pairing data and/or sequence identity to functionally conserved genes or fragments thereof.

According to a specific embodiment a species/strain can be defined by DNA-DNA hybridization involving a pairwise comparison of two entire genomes and reflects the overall sequence similarity between them. According to a specific embodiment, a species is defined as a set of strains with at least about 70%, e.g., at least about 75%, at least about 80%, at least about 85%, at least about 90%, at least about 91%, at least about 92%, at least about 93%, at least about 94%, at least about 95% or more DNA-DNA relatedness and with 5 uC or less DTm and having the activities as defined hereinbelow and in the Examples section which follows.

According to a specific embodiment, the genomic nucleic acid sequence is at least about 97%, at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95% 99.95%, at least about 99.99%, at least about 99.999%, at least about 99.9999%, at least about 99.99999%, at least about 99.999999% or more DNA-DNA relatedness and with 5 uC or less DTm and having the activities hereinbelow and in the Examples section which follows.

Thus, for example, if there is DNA-DNA hybridization on the basis of the article of Goris et al. [Goris, J., Konstantinidis, K. T., Klappenbach, J. A., Coenye, T., Vandamme, P., and Tiedje, J M. (2007). DNA-DNA hybridization values and their relationship to whole-genome sequence similarities. Int J Syst Evol Microbiol 57:81-91], some microorganisms expressing a DNA-DNA relatedness value of 70% or more (as described above) can be regarded as functional homologs according to some embodiments of the invention.

According to a specific embodiment, the reference genomic sequence is as set forth in SEQ ID NO: 4).

As used herein, "sequence identity" or "identity" or grammatical equivalents as used herein in the context of two nucleic acid or polypeptide sequences includes reference to the residues in the two sequences which are the same when aligned. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are considered to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Henikoff S and Henikoff JG. [Amino acid substitution matrices from protein blocks. Proc. Natl. Acad. Sci. U.S.A. 1992, 89(22): 10915-9].

Identity can be determined using any homology comparison software, including for example, the BlastN software of the National Center of Biotechnology Information (NCBI) such as by using default parameters.

According to some embodiments of the invention, the identity is a global identity, i.e., an identity over the entire nucleic acid sequences of the invention and not over portions thereof.

According to a specific embodiment, the genomic nucleic acid sequence is at least about 70%, e.g., at least 75%, at least about 80%, at least about 85%, at least about 90%, at least about 91%, at least about 92%, at least about 93%, at least about 94%, at least about 95%, at least about 96% least about 97%, at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95% 99.95%, at least about 99.99%, at least about 99.999%, at least about 99.9999%, at least about 99.99999%, at least about 99.999999% or more to the genomic sequence of the deposited strain (SEQ ID NO: 4).

According to a specific embodiment, the genomic nucleic acid sequence is at least about 97%, at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, 99.95%, at least about 99.99%, at least about 99.999%, at least about 99.9999%, at least about 99.99999%, at least about 99.999999% or more identical to that of the deposited strain (SEQ ID NO: 4).

According to an additional or alternative embodiment, a functional homolog is determined as the average nucleotide identity (ANI), which detects the DNA conservation of the core genome (Konstantinidis K and Tiedje J M, 2005, Proc. Natl. Acad. Sci. USA 102: 2567-2592). In some embodiments, the ANI between the functional homolog and the deposited strain is of at least about 95%, at least about, 96%, at least about 97%, at least about 98%, at least about 99%, at least about 99.1%, at least about 99.5%, at least about 99.6%, at least about 99.7%, at least about 99.8%, at least about 99.9%, at least about 99.99%, at least about 99.999%, at least about 99.9999%, at least about 99.99999%, at least about 99.999999% or more.

According to an additional or alternative embodiment, a functional homolog is determined by the degree of relatedness between the functional homolog and deposited strain determined as the Tetranucleotide Signature Frequency Correlation Coefficient, which is based on oligonucleotide frequencies (Bohlin J. et al. 2008, BMC Genomics, 9:104). In some embodiments, the Tetranucleotide Signature Frequency Correlation coefficient between the variant and the deposited strain is of about 0.99, 0.999, 0.9999, 0.99999, 0.999999, 0.999999 or more.

According to an additional or alternative embodiment, the degree of relatedness between the functional homolog and the deposited strain is determined as the degree of similarity obtained when analyzing the genomes of the parent and of the variant strain by Pulsed-field gel electrophoresis (PFGE) using one or more restriction endonucleases. The degree of similarity obtained by PFGE can be measured by the Dice similarity coefficient. In some embodiments, the Dice similarity coefficient between the variant and the deposited strain is of at least about 96%, at least about 97%, at least about 98%, at least about 99%, at least about 99.1%, at least about 99.5%, at least about 99.6%, at least about 99.7%, at least about 99.8%, at least about 99.9%, at least about 99.99%, at least about 99.999%, at least about 99.9999%, at least about 99.99999%, at least about 99.999999% or more.

According to an additional or alternative embodiment, the functional homolog is defined as having the same ribotype, as obtained using any of the methods known in the art and described, for instance, by Bouchet et al. (Clin. Microbiol. Rev., 2008, 21:262-273).

According to an additional or alternative embodiment, the degree of relatedness between the functional homolog and the deposited strain is determined by the Pearson correlation coefficient obtained by comparing the genetic profiles of both strains obtained by repetitive extragenic palindromic element-based PCR (REP-PCR) (see e.g. Chou and Wang, Int J Food Microbiol. 2006, 110:135-48). In some embodiments, the Pearson correlation coefficient obtained by comparing the REP-PCR profiles of the variant and the deposited strain is of at least about 0.99, at least about 0.999, at least about 0.9999, at least about 0.99999, at least about 0.999999, at least about 0.999999 or more.

According to an additional or alternative embodiment, the degree of relatedness between the functional homolog and the deposited strains is defined by the linkage distance obtained by comparing the genetic profiles of both strains obtained by Multilocus sequence typing (MLST) (see e.g. Maiden, M. C., 1998, Proc. Natl. Acad. Sci. USA 95:3140-3145). In some embodiments, the linkage distance obtained by MLST of the functional homolog and the deposited strain is of at least about 0.99, at least about 0.999, at least about 0.9999, at least about 0.99999, at least about 0.999999, at least about 0.999999 or more.

According to an additional or alternative embodiment, the functional homolog comprises a functionally conserved gene or a fragment thereof e.g., a house-keeping gene e.g., 16S-rRNA or Internal Transcribed Spacer" (ITS), recA, glnII, atpD, gap, glnA, gltA, gyrB, pnp, rpoB, thrC or dnaK that is at least about 97%, at least about 98%, at least about 99%, at least about 99.1%, at least about 99.5%, at least about 99.6%, at least about 99.7%, at least about 99.8%, at least about 99.9%, at least about 99.99%, at least about 99.999%, at least about 99.9999%, at least about 99.99999%, at least about 99.999999% or more identical to that of the deposited strain.

As mentioned, and according to a specific additional or an alternative embodiment, a functional homolog can also be determined on the basis of a multilocus sequence analysis (MLSA) determination of various functionally conserved genes or fragments thereof e.g., at least one, 2, 3, 4, 5, 6, 7, 8, 9, 10, 11, 12, 13, 14, 15 or more functionally conserved genes or fragments thereof, such as of e.g., 16S, ITS, recA, glnII, atpD, gap, glnA, gltA, gyrB, pnp, rpoB, thrC and dnaK.

According to a specific embodiment, the 16S ribosomal RNA (16S-rRNA) nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain (SEQ ID NO: 3).

According to a specific embodiment, the ITS nucleic acid sequence is at least about 97%, e.g. at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the recA nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the atpD nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the dnaK nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the glnII nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the gap nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the glnA nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the gltA nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the gyrB nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the pnp nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the rpoB nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to a specific embodiment, the thrC nucleic acid sequence is at least about 97%, e.g., at least about 97.1%, at least about 97.2%, at least about 97.3%, at least about 97.4%, at least about 97.5%, at least about 97.6%, at least about 97.7%, at least about 97.8%, at least about 97.9%, at least about 98%, at least about 98.1%, at least about 98.2%, at least about 98.3%, at least about 98.4%, at least about 98.5%, at least about 98.6%, at least about 98.7%, at least about 98.8%, at least about 98.9%, at least about 99%, at least about 99.1%, at least about 99.2%, at least about 99.3%, at least about 99.4%, at least about 99.5%, at least about 99.6%, at least about 99.7%, at least about 99.8%, at least about 99.8%, at least about 99.9%, at least about 99.95%, at least about 99.999%, at least about 99.9999%, at least about 99.99999%, at least about 99.999999% or more identical to that of the deposited strain.

According to an additional or alternative embodiment the deposited strain and the functional homolog is characterized by substantially the same (+/− about 10%, 20%, 40%, 50%, 60% when tested under the same conditions) biochemical profiling (e.g., biochemical fingerprinting) using for example, the GEN III redox chemistry (BIOLOG Inc. 21124 Cabot Blvd. Hayward Calif., 94545, USA), which can analyze both Gram-negative and Gram-positive bacteria, for their ability to metabolize all major classes of biochemicals, in addition to determining other important physiological properties such as pH, salt, and lactic acid tolerance. Further details can be obtained in "Modern Phenotypic Microbial Identification", B. R. Bochner, Encyclopedia of Rapid Microbiological Methods, 2006, v.2, Ch. 3, pp. 55-73, which is incorporated herein by reference in its entirety.

Example 7 of the Examples section provides a metabolite analysis of the deposited strain.

According to an additional or alternative embodiment, the functional homolog is defined by a comparison of coding sequences (gene) order.

According to an additional or alternative embodiment, the functional homolog is defined by a comparison of order of non-coding sequences.

According to an additional or alternative embodiment, the functional homolog is defined by a comparison of order of coding and non-coding sequences.

According to some embodiments of the invention, the combined coding region of the functional homolog is such that it maintains the original order of the coding regions as within the genomic sequence of the bacterial isolate yet without the non-coding regions.

Coding sequences of the deposited strain and their annotations are provided in Table 5 of the Examples section which follows.

For example, in case the genomic sequence has the following coding regions, A, B, C, D, E, F, G, each flanked by non-coding sequences (e.g., regulatory elements, introns and the like), the combined coding region will include a single nucleic acid sequence having the A+B+C+D+E+F+G coding regions combined together while maintaining the original order of their genome, yet without the non-coding sequences.

According to some embodiments of the invention, the combined non-coding region of the functional homolog is such that it maintains the original order of the non-coding regions as within the genomic sequence of the bacterial isolate yet without the coding regions as originally present in the bacterial deposit.

According to some embodiments of the invention, the combined non-coding region and coding region (i.e., the genome) of the functional homolog is such that it maintains the original order of the coding and non-coding regions as within the genomic sequence of the microbial deposit.

As used herein "maintains" relate to at least about 90%, 91%, 92%, 93%, 94%, 95%, 96%, 97%, 98%, 99% or 100% is maintained as compared to the deposited strain.

According to an additional or alternative embodiment, the functional homolog is defined by a comparison of gene content.

According to a specific embodiment, the functional homolog comprises a combined coding region where at least about 90%, at least about 91%, at least about 92%, at least about 93%, at least about 94%, at least about 95%, at least about 96%, at least about 97%, at least about 98%, at least about 99%, or more (e.g., 100%) is identical to a combined coding region existing in genome of the deposited strain.

As used herein "combined coding region" refers to a nucleic acid sequence including all of the coding regions of the bacterial isolate yet without the non-coding regions of the bacterial isolate.

According to an additional or alternative embodiment, the functional homolog is defined by a comparison of nucleotide composition and codon usage.

According to an additional or alternative embodiment, the functional homolog is defined by a method based on random genome fragments and DNA microarray technology. These methods are of sufficiently high resolution to for strain-to-species level identification.

One of ordinary skill in the art, based on knowledge of the classification criteria would know how to identify strains that are considered functional homologs.

An additional and more detailed description of species-to-strain classification can be found in:

Cho and Tiedje 2001 Bacterial species determination from DNA-DNA hybridization by using genome fragments and DNA microarrays;

Coenye et al. 2005 Towards a prokaryotic genomic taxonomy. FEMS Microbiol. Rev. 29:147-167;

Konstantinidis and Tiedje (2005) Genomic insights that advance the species definition for prokaryotes. Proc. Natl. Acad. Sci. USA 102:189-197;

Konstantinidis et al. 2006 Toward a more robust assessment of intraspecies diversity using fewer genetic markers. Appl. Environ. Microbiol. 72:7286-7293.

It is to be understood that one or more methods as described herein can be used to identify a functional homolog.

Genomic data can be obtained by methods which are well known in the art e.g., DNA sequencing, bioinformatics, electrophoresis, an enzyme-based mismatch detection assay and a hybridization assay such as PCR, RT-PCR, RNase protection, in-situ hybridization, primer extension, Southern blot, Northern Blot and dot blot analysis.

According to a specific embodiment, the functional homolog and the deposited strain belong to the same species (*Bacillus amyloliquefaciens*).

According to a specific embodiment, the functional homolog and the deposited strain belong to the same subspecies.

As mentioned, the functional homolog is endowed with or maintains (as defined herein) the functional properties of the deposited strain.

Thus according to a specific embodiment, the bacterial strain has no lecithinase activity as determined by the absence of a white precipitate when the isolated bacterial strain or functional homolog of same is streaked out onto egg yolk agar and incubated for 24 h at 37° C.

According to an additional or an alternative embodiment, the bacterial strain exhibits gamma hemolytic activity when streaked onto 5% sheep blood agar and incubated for 24 h at 37° C.

According to an additional or an alternative embodiment, the bacterial strain is sensitive to an antibiotic selected from the group consisting of erythromycin, gentamicin, tetracycline, streptomycin, vancomycin, chloramphenicol, kanamycin and clindamycin according to the European Food Safety Authority MIC breakpoints for *Bacillus* species such as shown in Table 2 hereinbelow.

According to an additional or an alternative embodiment, the bacterial strain is incapable of colonizing a mammalian (e.g., murine) lung.

According to an additional or an alternative embodiment, the bacterial strain is growth inhibitory effects against bacteria and fungi, as shown in Tables 3 and 4, respectively.

According to an additional or an alternative embodiment, the bacterial strain exhibits a secreted metabolome composition as shown in the Examples section which follows. As used herein "isolated" refers to an isolate of bacteria in which the prevalence (i.e., concentration) of the bacterial stain or functional homolog is enriched over that (exceeds that) found in nature (e.g., in Doenjang, a fermented soybean paste). Thus, the present teachings refer to cultures, preparations, compositions (interchangeably used), which comprise the bacterial strain.

The isolated bacterial strain can be comprised in a composition, preparation, formulation, culture, article of manufacture.

According to some embodiments, the composition, preparation, formulation, culture, article of manufacture, comprises more than 1 microbial strains or species.

According to some embodiments, the composition, preparation, formulation, culture, article of manufacture, comprises 2 microbial strains or species.

According to some embodiments, the composition, preparation, formulation, culture, article of manufacture, comprises 3 microbial strains or species.

According to some embodiments, the composition, preparation, formulation, culture, article of manufacture, comprises 4 microbial strains or species.

According to some embodiments, the composition, preparation, formulation, culture, article of manufacture does not comprise more than 5 different species or strains of microbes.

According to some embodiments, the composition, preparation, formulation, culture, article of manufacture does not comprise more than 4 different species or strains of microbes.

According to some embodiments, the composition, preparation, formulation, culture, article of manufacture does not comprise more than 3 different species or strains of microbes.

According to some embodiments, the composition, preparation, formulation, culture, article of manufacture does not comprise more than 2 different species or strains of microbes.

According to some embodiments of the invention, the composition, preparation, formulation, culture, article of manufacture comprises less than 10 microbial species.

According to some embodiments of the invention, the composition, preparation, formulation, culture, article of manufacture comprises less than 9 microbial species.

According to some embodiments of the invention, the composition, preparation, formulation, culture, article of manufacture comprises less than 8 microbial species.

According to some embodiments of the invention, the composition, preparation, formulation, culture, article of manufacture comprises less than 7 microbial species.

According to some embodiments of the invention, the composition, preparation, formulation, culture, article of manufacture comprises less than 6 microbial species.

According to some embodiments of the invention, the composition, preparation, formulation, culture, article of manufacture comprises less than 5 microbial species.

According to some embodiments of the invention, the composition, preparation, formulation, culture, article of manufacture comprises 4 microbial species.

According to some embodiments of the invention, the composition, preparation, formulation, culture, article of manufacture comprises 3 microbial species.

According to some embodiments of the invention, the composition, preparation, formulation, culture, article of manufacture comprises 2 microbial species.

According to some embodiments of the invention, the composition, preparation, formulation, culture, article of manufacture comprises 3 microbial strains.

According to some embodiments of the invention, the composition, preparation, formulation, culture, article of manufacture comprises 2 microbial strains.

According to a specific embodiment of the invention, the composition, preparation, formulation, culture, article of manufacture comprises a single microbial species i.e., the isolated bacterial stain.

According to a specific embodiment, the composition, preparation, formulation, culture, article of manufacture comprises the bacterial strain at a level of purity of at least about 20%, at least about 30%, at least about 40%, at least about 50%, at least about 60%, at least about 70%, at least about 80%, at least about 85%, at least about 90%, at least about 91%, at least about 92%, at least about 93%, at least about 94%, at least about 95%, 96%, at least about, 97%.

According to a specific embodiment, the composition, preparation, formulation, culture, article of manufacture comprises the bacterial strain at a level of purity of at least about 98%, at least about 99%, at least about 99.1%, at least about 99.2%, at least about 99.3%, at least about 99.4%, at least about 99.5%, at least about 99.6%, at least about 99.7%, at least about 99.8%, at least about 99.9%, at least about 99.95%, at least about 99.99% or more, say 100% pure.

According to a specific embodiment, the microbial strain comprises viable (more than 50%) microbial cells.

As used herein "viable" refers to a microorganism that is alive and capable of regeneration and/or propagation, while in a vegetative, frozen, preserved, or reconstituted state.

According to a specific embodiment, the microbial strain comprises spores of the bacterial strain.

As used herein "spores" or "endospores" refer to microbes that are generally viable, more resistant to environmental influences such as heat and bactericidal than other forms of the same bacterial species, and typically capable of germination and out-growth. Bacteria that are "capable of forming spores" are those bacteria comprising the genes and other necessary abilities to produce spores under suitable environmental conditions.

As used in herein, the term "CFUs" or "Colony Forming Units" refers to the number of microbial cells e.g., bacterial strain, in a defined sample (e g milliliter of liquid, gram of powder) that form colonies and thereafter numbered, on a semi-solid bacteriological growth medium.

According to specific embodiments, the enrichment in the composition, preparation, formulation, culture, article of manufacture is $10^2$ CFUs-$10^9$ CFUs/gr powder or $10^2$ CFUs-$10^9$ CFUs/ml.

According to specific embodiments, the enrichment in the composition, preparation, formulation, culture, article of manufacture is $10^2$ CFUs-$10^8$ CFUs/gr powder or $10^2$ CFUs-$10^8$ CFUs/ml.

According to specific embodiments, the enrichment in the composition, preparation, formulation, culture, article of manufacture is $10^2$ CFUs-$10^7$ CFUs/gr powder or $10^2$ CFUs-$10^7$ CFUs/ml.

According to specific embodiments, the enrichment in the composition, preparation, formulation, culture, article of manufacture is $10^2$ CFUs-$10^6$ CFUs/gr powder or $10^2$ CFUs-$10^6$ CFUs/ml.

According to specific embodiments, the enrichment in the composition, preparation, formulation, culture, article of According to a specific embodiment, the composition, preparation, formulation, culture, article of manufacture comprises the bacterial strain at a level of purity of $10^2$ CFUs-$10^5$ CFUs/gr powder or $10^2$ CFUs-$10^5$ CFUs/ml.

According to specific embodiments, the enrichment in the composition, preparation, formulation, culture, article of manufacture is $10^2$ CFUs-$10^4$ CFUs/gr powder or $10^2$ CFUs-$10^4$ CFUs/ml.

According to specific embodiments, the enrichment in the composition, preparation, formulation, culture, article of manufacture is $10^2$ CFUs-$10^3$ CFUs/gr powder or $10^2$ CFUs-$10^3$ CFUs/ml.

According to specific embodiments, the enrichment in the composition, preparation, formulation, culture, article of manufacture is $10^3$ CFUs-$10^9$ CFUs/gr powder or $10^3$ CFUs-$10^9$ CFUs/ml.

According to specific embodiments, the enrichment in the composition, preparation, formulation, culture, article of manufacture is $10^4$ CFUs-$10^9$ CFUs/gr powder or $10^4$ CFUs-$10^9$ CFUs/ml.

According to specific embodiments, the enrichment in the composition, preparation, formulation, culture, article of manufacture is $10^5$ CFUs-$10^9$ CFUs/gr powder or $10^5$ CFUs-$10^9$ CFUs/ml.

According to specific embodiments, the enrichment in the composition, preparation, formulation, culture, article of manufacture is $10^6$ CFUs-$10^9$ CFUs/gr powder or $10^6$ CFUs-$10^9$ CFUs/ml.

According to specific embodiments, the enrichment in the composition, preparation, formulation, culture, article of manufacture is $10^7$ CFUs-$10^9$ CFUs/gr powder or $10^7$ CFUs-$10^9$ CFUs/ml.

According to specific embodiments, the enrichment in the composition, preparation, formulation, culture, article of manufacture is $10^8$ CFUs-$10^9$ CFUs/gr powder or $10^8$ CFUs-$10^9$ CFUs/ml.

According to specific embodiments, the enrichment in the composition, preparation, formulation, culture, article of manufacture is $10^8$ CFUs-$10^9$ CFUs/gr powder or $10^8$ CFUs-$10^9$ CFUs/ml.

According to a specific embodiment the composition, preparation, formulation, culture, article of manufacture comprises at least about 100 CFUs or spores, at least about $10^2$ CFUs/gr or CFUs/ml, at least about $10^2$ CFUs/gr or CFUs/ml, at least about $10^3$ CFUs/gr or CFUs/ml, at least about $10^4$ CFUs/gr or CFUs/ml, at least about $10^5$ CFUs/gr or CFUs/ml, at least about $10^6$ CFUs/gr or CFUs/ml, at least about $10^7$ CFUs/gr or CFUs/ml, at least about $10^8$ CFUs/gr or CFUs/ml, at least about $10^9$ CFUs/gr or CFUs/ml, at least about $10^{10}$ CFUs/gr or CFUs/ml, at least about $10^{11}$ CFUs/gr or CFUs/ml, at least about $10^{12}$ CFUs/gr or CFUs/ml.

According to a specific embodiment the composition, preparation, formulation, culture, article of manufacture (especially for a liquid formulation) comprises at least about $10^6$ CFUs/gr or CFUs/ml, at least about $10^7$ CFUs/gr or CFUs/ml, at least about $10^8$ CFUs/gr or CFUs/ml, at least about $10^9$ CFUs/gr or CFUs/ml.

According to a specific embodiment the composition, preparation, formulation, culture, article of manufacture (especially for a dry formulation) comprises at least about $10^8$ CFUs/gr or CFUs/ml, at least about $10^9$ CFUs/gr or CFUs/ml, at least about $10^{10}$ CFUs/gr or CFUs/ml, at least about $10^{11}$ CFUs/gr or CFUs/ml, at least about $10^{12}$ CFUs/gr or CFUs/ml.

According to a specific embodiment, the composition, preparation, formulation, culture, article of manufacture is selected from the group consisting of a still culture, whole cultures stored stock of cells (particularly glycerol stocks), agar strip, stored agar plug in glycerol/water, freeze dried stock, and dried stocks such as lyophilisate dried onto filter paper.

According to a specific embodiment, the composition, preparation, culture or formulation is devoid of animal contaminants to render it safe for human use.

As used herein "a culture" refers to a fluid, pellet, scraping, dried sample, lyophilisate or a support, container, or medium such as a plate, paper, filter, matrix, straw, pipette or pipette tip, fiber, needle, gel, swab, tube, vial, particle, etc. that contains the deposited strain or the functional homolog thereof in an amount that exceeds that found in nature, as described hereinabove. In the present invention, an isolated culture of a microbial strain is a culture fluid or a scraping, pellet, dried composition, preparation, formulation, culture, article of manufacture, lyophilisate, or a support, container, or medium that contains the microorganism, in the absence of other organisms (or in combination with other microbes which were preselected and grown for the purpose of combined administration).

According to a specific embodiment, the bacterial strain within the composition, preparation, formulation, culture, article of manufacture is viable.

The bacterial strain can be produced or manufactured using methods which are well known in the art of microbiology.

According to a specific embodiment, the microbial strain is isolated from Doenjang, such as by using Luria Bertani Miller agar (BD, Difco) agar for plating. According to a specific embodiment, representative colonies are picked from plates with the highest dilution still showing colonies. After purification, the strain was stored at −80° C. The stock culture is propagated in LB Miller broth.

According to an aspect, the bacterial strain is cultured under conditions that allow propagation; after which (and/or during which) the bacterial strain is harvested.

Thus, according to some embodiments, cultures of the microbial strain may be prepared using standard static drying and liquid fermentation techniques known in the art. Growth is commonly effected in a bioreactor.

A bioreactor refers to any device or system that supports a biologically active environment. As described herein a bioreactor is a vessel in which microorganisms including the microorganism of the invention can be grown. A bioreactor may be any appropriate shape or size for growing the microorganisms. A bioreactor may range in size and scale from 10 mL (e.g., small scale) to liters to cubic meters (e.g., large scale) and may be made of stainless steel, disposable material (e.g., nylon, plastic bags) or any other appropriate material as known and used in the art. The bioreactor may be a batch type bioreactor, a fed batch type or a continuous-type bioreactor (e.g., a continuous stirred reactor). For example, a bioreactor may be a chemostat as known and used in the art of microbiology for growing and harvesting microorganisms. A bioreactor may be obtained from any commercial supplier (See also Bioreactor System Design, Asenjo & Merchuk, CRC Press, 1995).

For small scale operations, a batch bioreactor may be used, for example, to test and develop new processes, and for processes that cannot be converted to continuous operations.

Microorganisms grown in a bioreactor may be suspended or immobilized. Growth in the bioreactor is generally under aerobic conditions at suitable temperatures and pH for growth. For the organisms of the invention, cell growth can be achieved at temperatures between 5-40° C., with an exemplary temperature range selected from 20 to 10° C., 15 to 28° C., 20 to 30° C., or 15 to 25° C. The pH of the nutrient medium can vary between 4.0 and 9.0. For example, the operating range can be usually slightly acidic to neutral at pH 5.0 to 8.5, or 4.5 to 6.5, or pH 5.0 to 6.0.

According to a specific embodiment, the cell growth is achieved at 20-40° C. at pH of 5.0-8.5.

Typically, maximal cell yield is obtained in 20-72 hours after inoculation. By virtue of the conditions applied in the selection process and general requirements of most microorganisms, a person of ordinary skill in the art would be able to determine essential nutrients and conditions. The microorganisms would typically be grown in aerobic liquid cultures on media which contain sources of carbon, nitrogen, and inorganic salts that can be assimilated by the microorganism and supportive of efficient cell growth. Exemplary carbon sources are hexoses such as glucose, but other sources that are readily assimilated such as amino acids, may be substituted. Many inorganic and proteinaceous materials may be used as nitrogen sources in the growth process. Exemplary nitrogen sources are amino acids and urea but others include gaseous ammonia, inorganic salts of nitrate and ammonium, vitamins, purines, pyrimidines, yeast extract, beef extract, proteose peptone, soybean meal, hydrolysates of casein, distiller's solubles, and the like. Among the inorganic minerals that can be incorporated into the nutrient medium are the customary salts capable of yielding calcium, zinc, iron, manganese, magnesium, copper, cobalt, potassium, sodium, molybdate, phosphate, sulfate, chloride, borate, and like ions.

The culture can be a pure culture, whereby a single microbial strain is included or a mixed culture. This is of course pending the compliance of the microbial strains to co-exist and proliferate under the same culturing conditions. When needed, an antibiotic or other growth-restricting conditions can be employed during culturing to restrict the growth of other microorganisms (contaminants) not desired in the culture/co-culture e.g., temperature, essential nutrients and the like.

According to an alternative or an additional embodiment, the desired combination is produced following culturing, such as when the microbial strains do not share the same or optimal culturing conditions.

The ratio of each type of microorganism in the final product will depend on the intended use (some are listed hereinbelow).

The identity of the microorganism(s) in the culture can be experimentally validated at the nucleic acid level, protein level, metabolite levels, functional level and/or by using classical microbiology tools, e.g., streaking (e.g., with selection).

After production, the microbial strain can be stored or used fresh, either as is or subject to further formulation.

Also contemplated herein are a lysate and/or a fermentation product of the above described methods. Methods of cell lysis of bacterial strains e.g., of the species *B. amyloliquefaciens* are well known in the art.

The formulation of the microbial strain much depends on the intended use. Following is a non-limiting description of various formulations that can be used along with the present teachings.

According to a specific embodiment, the bacterial strain is formulated in a liquid formulation.

According to a specific embodiment, the bacterial strain is formulated in a dry formulation.

According to a specific embodiment, the bacterial strain is formulated in a gel formulation.

Microbial strains formulations used to reduce the incidence of pathogenic microorganisms (bacteria and/or fungi), can be in vivo administered, can be released into the air or in conjunction with an HVAC system, applied to waste, food products, food processing areas, food preparation tools, agricultural products, agricultural water (irrigation water, agricultural soils, agricultural crops) and the like. The formulations of bacteria described herein can be applied in a powder, liquid, foam, gelled, aerosol or solid form. In liquid formulations, the microbial strain formulations may be dispensed from conventional dispensing devices, including pump sprayers, aerosol containers, squirt bottles etc. For application over larger areas, hoses, sprinkler systems or other suitable devices may be used. In the alternative, the formulations can be applied as a dry powder such as lyophilized bacteria or using any of the techniques currently known to a person of skill in the art. The optimal frequency of applications of the microbial strain formulations may depend on the target on which the formulation is to be applied. In certain embodiments, wherein formulations are contemplated, a microorganism is harvested and concentrated using a method that does not markedly decrease the viable cell concentration through centrifugation or filtration.

In embodiments wherein formulations are contemplated for preservation, such preservation may include a process of freezing, freeze-drying and/or spray-drying.

In certain embodiments, the preserved cells can be used in a microbial-based product. The preserved bacterial strain can be provided "as-is" without further dilution or modification. Additionally, in certain embodiments, the bacterial strain can be mixed with a carrier to dilute the concentration of cells to an appropriate concentration for administration. The carrier can be as simple as one element, or a more complex molecule or mixture of molecules in any proportion in order to act as a suitable carrier. This carrier and composition may, in certain instances, have defined properties such as solubility in water or other media. The diluting carrier can be of any composition or combination including but not limited to: lactose, glucose, non-fat dry milk powder, oligosaccharides, glycerol, oil, lecithin, or other materials.

In particular formulations, other chemicals or materials may be used to reduce or absorb moisture and/or oxygen for further protection and preservation of the viable microbial cells. Such chemicals or materials include, but are not limited to: calcium stearate, sodium aluminosilicate, sodium sulfide, sodium carbonate, silica, iron oxides, calcium carbonate, zeolite, bicarbonates, sodium sulfate, silicon dioxide and other silica materials.

In certain embodiments, a microbial strain formulation for administration to a subject or a surface or other target can include a preservation matrix, which contains and preserves the culture. Such a matrix may include a biologically active binding agent, an antioxidant, a polyol, a carbohydrate and a proteinaceous material.

Antioxidants included in a preservation matrix may be provided to retard oxidative damage to the microbial cells during the preservation and storage process.

Polyols (i.e., polyhydric alcohols) included in a preservation matrix may be provided to maintain the native, uncollapsed state of cellular proteins and membranes during the preservation and storage process. In particular, polyols interact with the cell membrane and provide support during the dehydration portion of the preservation process. Examples of polyols include, but are not limited to xylitol, adonitol, glycerol, dulcitol, inositol, mannitol, sorbitol and/or arabitol.

Carbohydrates included in a preservation matrix may be provided to maintain the native, uncollapsed state of cellular proteins and membranes during the preservation and storage process. In particular, carbohydrates provide cell wall integrity during the dehydration portion of the preservation process. Exemplary carbohydrates include, but are not limited to dextrose, lactose, maltose, sucrose, fructose and/or any other monosaccharide, disaccharide or polysaccharide.

A proteinaceous material included in a preservation matrix may provide further protection of the microbial cell during the dehydration portion of the preservation process. Exemplary proteinaceous materials include, but are not limited to skim milk and albumin.

The microbial cells can be preserved within a preservation matrix including coating the cell matrix suspension onto an inert carrier e.g., a maltodextrin bead. The coated beads can then be dried, e.g., by a fluid bed drying method. Fluid bed drying methods are well known in the art. The coated beads can be stored as a powder, placed into gelatin capsules, or pressed into tablets.

In other formulations, the microbial strain contemplated can be formulated as a hard gelatin capsule. Gelatin capsules are commercially available and are well known in the art. In this embodiment, the method further comprises dispensing the cell suspension matrix to a gelatin capsule, chilling the gelatin capsule until the cell suspension matrix forms a non-fluid matrix and to affix the gel to the interior wall of the gelatin capsule, and desiccating the gelatin capsule in a desiccation chamber. Further examples of embodiments of preservation matrices and gelatin capsule formulations may be found in U.S. Pat. No. 6,468,526 which is herein incorporated by reference in its entirety.

In certain applications, the microbial strain may be placed in a microencapsulation formulation. Such microencapsulation formulations may have applicability for example in administration to subjects via oral, nasal, rectal, vaginal or urethral routes. Spray drying is the most commonly used microencapsulation method in the food industry, is economical and flexible, and produces a good quality product. The process involves the dispersion of the core material into a polymer solution, forming an emulsion or dispersion, followed by homogenisation of the liquid, then atomisation of the mixture into the drying chamber. This leads to evaporation of the solvent (water) and hence the formation of matrix type microcapsules.

Examples of microencapsulation can be found for example in U.S. Pat. No. 5,641,209 that is herein incorporated by reference.

An embodiment of preserving by freezing is to prepare frozen beads or pellets comprising the microbial strain. After a suitable fermentation, the liquid is removed from the viable bacteria by a method including but not limited to centrifugation, ultrafiltration, or sedimentation. An additive compound may be added to the bacteria prior to freezing. Suitable additives include but are not limited to, lactose, sucrose, trehalose, maltodextrin, cyclodextrin, spray gum, fish gelatin bloom, and maltitol.

Suitable additives may also serve as cryoprotective agents to improve the stability of the frozen culture. Cryoprotective agents include, but are not limited to, proteins, protein hydrolsates, carbohydrates, or a compound involved in the biosynthesis of nucleic acids. U.S. Publ. Appl. 20070254353. Proteins or protein hydrolysates include but are not limited to, malt extract, milk powder, whey powder, yeast extract, gluten, collagen, gelatin, elastin, keratin, or albumin. Carbohydrates include but are not limited to pentoses (e.g. ribose, xylose), hexoses (e.g. fructose, mannose, sorbose), disaccharides (e.g. sucrose, trehalose, melibiose, lactulose), oligosaccharides (e.g. raffinose), oligofrutoses (e.g. actilight, fribroloses), polysaccharides (e.g. maltodextrins, xanthan gum, pectin, alginate, microcrystalline cellulose, dextran, PEG), and sugar alcohols (sorbitol, manitol). U.S. Publ. Appl. 20070254353.

A foam is defined herein is a composition that is formed by trapping many gas bubbles in a liquid. Methods pertaining to the formulation and administration of foams are set forth in U.S. Pat. Nos. 4,112,942, 5,652,194, 6,140,355, 6,258,374, and 6,558,043, each of which is herein specifically incorporated by reference in its entirety.

A typical foam formulation may, for example, be constructed by introducing a gas into a gel or aqueous pharmaceutical composition such that bubbles of the gas are within the pharmaceutical composition.

A microbial strain formulation can be applied to a surface or simply to the air using an electrostatic spray apparatus. This apparatus should have a chamber for containing the microbial strain formulation and an opening in fluid connection with the chamber through which the microbial strain formulation can be dispensed and deposited on a desired surface. The apparatus should allow for electrically charging the microbial strain formulation. For example, a conductor can be used to connect the chamber to a voltage power source. One of skill in the art would be aware of other suitable devices that can function as such a conductor.

To apply the formulation to a surface or to the air, the formulation is placed into the chamber of the electrostatic spray apparatus. The microbial strain formulation can be pumped into the chamber. When the microbial strain formulation is placed into the chamber, it contacts the conductor, such as a high-voltage DC electrode, and becomes charged. Once the formulation in the chamber is charged, it carries the same charge as the conductor. As a result the formulation and conductor repel each other. This repulsive force discharges the microbial strain formulation through the opening of the nozzle to create streams of droplets. Therefore, no additional gas source is required for atomization of the coating formulation. Accordingly, a cloud of highly charged, highly uniform-sized droplets can be formed.

Since the droplets that are formed carry a charge, when they are deposited on a grounded surface, they will be guided by their electrostatic attraction to the grounded and hence electrically neutral surface. Since the droplets carry the same electrical charge, they will repel each other. This repulsion causes the droplets arriving at the surface to avoid the areas where other droplets have already been deposited and instead land on areas of the surface that have not been coated. In this way, an inherently uniform coating is formed.

One example of a suitable nozzle apparatus that can be used in the method of some embodiments of the invention is an apparatus for electrohydrodynamic spray-coating that is disclosed in U.S. Pat. No. 4,749,125. This apparatus has a metal shim that is placed within the nozzle apparatus to define a plurality of nozzle openings. The metal shim is also connected to a voltage source that allows for the formation of electrically charged droplets of coating formulation.

Aerosol dispending system and automated embodiments thereof are further described hereinbelow.

Lyophilization—Dry microorganism cultures may be prepared according to methods which are well known in the art. In addition to constituents present in the culture medium, the medium may comprise at least one matrix material with or without other stabilizing substances. These materials may be selected from inorganic salts or buffers, at least one other compound which is selected from mono-, oligo- and polysaccharides, polyols, polyethers, amino acids, oligo- and polypeptides, milk-derived compounds, organic carboxylic acids, mineral compounds, organic carrier materials such as wheat semolina bran, alginates, DMSO, PVP (polyvinylpyrrolidone), CMC (carboxymethylcellulose), alpha-tocopherol, beta.-carotene and mixtures thereof.

Examples of suitable saccharide carrier components are sucrose, fructose, maltose, dextrose, lactose and maltodextrin. An example of a suitable polyol is glycerol. Examples of suitable amino acids are glutamic acid, aspartic acid and the salts thereof. An example of a suitable peptide carrier is peptone. An example of a milk-derived compound is sweet whey powder. Suitable organic carboxylic acids are, for example, citric acid, malic acid and L-ascorbic acid. Examples of suitable mineral carriers are montmorillonite and palygorskite.

The microorganism suspension containing the carrier can be dried in various ways. Suitable drying processes are in principle freeze drying, fluidized-bed drying and, spray-drying. Spray-drying also comprises modified spray-drying processes, such as spray-agglomeration or agglomerating spray-drying. The latter process is also known under the name FSD (fluidized spray-dryer) process.

Freeze-drying for preparing dry microorganism cultures according to some embodiments of the present invention can be carried out, for example, on the basis of the freeze-drying process described in U.S. Pat. No. 3,897,307, the contents of which is incorporated completely by reference.

Another drying process contemplated for use according to some embodiments of the present invention is spray-drying. Those methods which can be used according to some embodiments of the present invention are essentially all spray-drying techniques known in the art. The material to be sprayed can, for example, be dried concurrently or countercurrently; spraying can be carried out by means of a single-component or multiple-component nozzle or by means of an atomizer wheel.

The drying process according to some embodiments of the present invention may be carried out in such a manner that a very low residual moisture content is present in the dry material. The percentage water content is typically from about 2 to 3% by weight. This may be achieved by adding a post-drying step subsequently to the spray-drying step. The drying material is, for example, post-dried in a fluidized bed, such as at a temperature in the range of from 15 to 50° C., for a period of, for example, from 15 minutes to 20 hours. Conditioned compressed air or conditioned nitrogen serves as drying gas.

Instead of the above-described physical post-drying processes, it is also conceivable to add specific desiccants to the dry material obtained from the spray-drying. Examples of suitable desiccants are inorganic salts, such as calcium chloride and sodium carbonate, organic polymers, such as the product obtainable under the trade name Kollidion 90 F., and silicon-dioxide-containing desiccants, such as silica gel, zeolites and desiccants which are obtainable under the trade name Tixosil 38, Sipernat 22 S or Aerosil 200.

In certain embodiments, the microbial; strain may be refrigerated after harvesting and concentrating. In certain embodiments, after a suitable fermentation, the liquid is removed from the viable bacteria by a method including but not limited to centrifugation, ultrafiltration, or sedimentation. An additive compound may be added to the bacteria prior to refrigeration. Suitable additives include but are not limited to, lactose, sucrose, trehalose, maltodextrin, cyclodextrin, spray gum, fish gelatin bloom, and maltitol.

Suitable additives may also serve as cryoprotective agents to improve the stability of the refrigerated culture. Cryoprotective agents include, but are not limited to, proteins, protein hydrosolates, carbohydrates, or a compound involved in the biosynthesis of nucleic acids. U.S. Publ.

Appl. 20070254353. Proteins or protein hydrolysates include but are not limited to, malt extract, milk powder, whey powder, yeast extract, gluten, collagen, gelatin, elastin, keratin, or albumin. Carbohydrates include but are not limited to pentoses (e.g. ribose, xylose), hexoses (e.g. fructose, mannose, sorbose), disaccharides (e.g. sucrose, trehalose, melibiose, lactulose), oligosaccharides (e.g. raffinose), oligofrutoses (e.g. actilight, fribroloses), polysaccharides (e.g. maltodextrins, xanthan gum, pectin, alginate, microcrystalline cellulose, dextran, PEG), and sugar alcohols (sorbitol, manitol). U.S. Publ. Appl. 20070254353.

The type of formulation depends on the intended use.

It will be appreciated that the present inventors have identified for the first time certain activities of the bacterial strain *Bacillus amyloliquefaciens*. This bacterial strain was found effective and safe for use in the treatment of respiratory tract infections.

As used herein, the term "treating" includes abrogating, substantially inhibiting, slowing or reversing the progression of a condition, substantially ameliorating clinical or other symptoms of a condition or substantially preventing the appearance of clinical or other symptoms of a condition.

Thus, according to an aspect of the invention there is provided a method of controlling a population of pathogenic bacteria and/or fungi in a respiratory system, the method comprising administering to a subject in need thereof an effective amount of bacteria of the species *Bacillus amyloliquefaciens* or any composition comprising same such as described herein, thereby controlling the population of pathogenic bacteria and/or fungi in the respiratory system.

As used herein "*Bacillus amyloliquefaciens*" refers to a bacterial species in the genus *Bacillus*. It is a gram positive soil bacteria closely related to the species *Bacillus subtilis*. According to a specific embodiment strains of this bacterial species are as described herein, e.g., *Bacillus amyloliquefaciens* 298 and functional homologs thereof.

According to an aspect of the invention there is provided a method of controlling a population of pathogenic bacteria and/or fungi, the method comprising providing an effective amount of the isolated bacterial strain or functional homolog of same or the composition such as described herein, thereby controlling the population of pathogenic bacteria and/or fungi.

As used herein "controlling" refers to preventing or reducing microbial infections such as a bacterial or fungal infection or inhibiting the rate and extent of such infection. Therapeutic treatment is also contemplated.

According to a specific embodiment, the controlling is prevention of an infection.

As described hereinbelow, the present inventors identified the use of the bacterial strain as described herein in controlling various species of microbes.

Thus, according to some embodiments, the present compositions and methods are useful in controlling *E. coli*.

*Escherichia coli* is a Gram-negative, facultatively anaerobic, rod-shaped, coliform bacterium of the genus *Escherichia* that is commonly found in the lower intestine of warm-blooded organisms. Some *E. coli* serotypes can cause serious food poisoning in their hosts, and are occasionally responsible for product recalls due to food contamination. It is most abundant in food and water supply and industrial sites (e.g., paper production).

According to some additional or alternative embodiments, the present compositions and methods are useful in controlling *Pseudomonas aeruginosa*.

*Pseudomonas aeruginosa* is a common Gram-negative, rod-shaped bacterium that can cause disease in plants and animals, including humans. It is the most common cause of infections of burn injuries and of the outer ear (otitis externa), and is the most frequent colonizer of medical devices (e.g., catheters). *Pseudomonas* can be spread by equipment that gets contaminated and is not properly cleaned or on the hands of healthcare workers. *Pseudomonas* can cause community-acquired pneumonias, as well as ventilator-associated pneumonias, being one of the most common agents isolated in several studies. One in ten hospital-acquired infections is from *Pseudomonas*. Cystic fibrosis patients are also predisposed to *P. aeruginosa* infection of the lungs. *P. aeruginosa* may also be a common cause of "hot-tub rash" (dermatitis), caused by lack of proper, periodic attention to water quality. Since these bacteria like moist environments, such as hot tubs and swimming pools, they can cause skin rash or swimmer's ear. *Pseudomonas* is also a common cause of postoperative infection in radial keratotomy surgery patients. The organism is also associated with the skin lesion ecthyma gangrenosum. *P. aeruginosa* is frequently associated with osteomyelitis involving puncture wounds of the foot, believed to result from direct inoculation with *P. aeruginosa* via the foam padding found in tennis shoes, with diabetic patients at a higher risk.

According to some additional or alternative embodiments, the present compositions and methods are useful in controlling *Bacillus cereus*.

*Bacillus cereus* is a Gram-positive, rod-shaped, aerobic, facultatively anaerobic, motile, beta hemolytic bacterium commonly found in soil and food. Some strains are harmful to humans and cause foodborne disease. *Bacillus* foodborne diseases occur due to survival of the bacterial endospores when food is improperly cooked. Cooking temperatures less than or equal to 100° C. (212° F.) allow some *B. cereus* spores to survive. This problem is compounded when food is then improperly refrigerated, allowing the endospores to germinate.

According to some additional or alternative embodiments, the present compositions and methods are useful in controlling *Staphylococcus aureus*.

*Staphylococcus aureus* is a Gram-positive, round-shaped bacterium that is a member of the Firmicutes, and it is a member of the normal flora of the body, frequently found in the nose, respiratory tract, and on the skin. It is often positive for catalase and nitrate reduction and is a facultative anaerobe that can grow without the need for oxygen. It is a common cause of skin infections including abscesses, respiratory infections such as sinusitis, and food poisoning. Pathogenic strains often promote infections by producing virulence factors such as potent protein toxins, and the expression of a cell-surface protein that binds and inactivates antibodies. The emergence of antibiotic-resistant strains of *S. aureus* such as methicillin-resistant *S. aureus* (MRSA) is a worldwide problem in clinical medicine. Despite much research and development there is no approved vaccine for *S. aureus*. Spread of *S. aureus* (including MRSA) generally is through human-to-human contact, although recently some veterinarians have discovered the infection can be spread through pets. Recently, myriad cases of *S. aureus* have been reported in hospitals across America. Transmission of the pathogen is facilitated in medical settings where healthcare worker hygiene is insufficient. *S. aureus* is an incredibly hardy bacterium, as was shown in a study where it survived on polyester for just under three months; polyester is the main material used in hospital privacy curtains. The bacteria are transported on the hands of healthcare workers, who may pick them up from a seemingly healthy patient carrying a benign or commensal strain of *S. aureus*, and then pass it on to the next patient being treated. Introduction of the bacteria into the bloodstream can lead to various complications, including endocarditis, meningitis, and, if it is widespread, sepsis.

According to some additional or alternative embodiments, the present compositions and methods are useful in controlling *Salmonella* Typhimurium.

*Salmonella* Typhimurium. is a serogroup of a rod-shaped, flagellated, facultative anaerobic, Gram-negative bacterium and a member of the genus *Salmonella*. It is a serovar that is a serious human pathogen. The encounter of humans to *S. Typhimurium* is made via fecal-oral route from infected individuals or animals to healthy ones, with food as a common vector. Poor hygiene of patients shedding the organism can lead to secondary infection, as well as consumption of shellfish from polluted bodies of water. Most common source of infection, however, are food of animal origin and drinking water tainted by urine and feces of infected individuals and animals.

According to some additional or alternative embodiments, the present compositions and methods are useful in controlling *Alternaria alternata*.

*Alternaria alternata* is a fungus which has been recorded causing leaf spot and other diseases on over 380 host species of plant. It is an opportunistic pathogen on numerous hosts causing leaf spots, rots and blights on many plant parts. In order to survive, *Alternaria alternata* needs a moist warm environment. It is often found in areas with humid climates, or where there has been significant rainfall. The fungus lives in seeds and seedlings, and is also spread by spores. This disease flourishes in dead plants that have been left in gardens over winter. Additionally, when dead infected debris is added to compost pile it can spread to other vegetables throughout the garden.

According to some additional or alternative embodiments, the present compositions and methods are useful in controlling *Cladosporium sphaerospermum*.

*Cladosporium sphaerospermum* is a fungus belonging to the genus *Cladosporium*. *Cladosporium sphaerospermum* is mainly known as a spoilage agent of harvested fruits and vegetables. *Cladosporium sphaerospermum* is a cosmopolitan fungus that inhabits city buildings and the environment and because of its airborne nature it can move rapidly between locations. *Cladosporium sphaerospermum* is also been shown to inhabit paint films on walls and other surfaces as well as old paintings. This fungus is also able to grow on gypsum-based material with and without paint and wallpaper. Plant materials that are affected include citrus leaves on various other decaying plant leaves, on the stems of herbaceous and woody plants, on fruits and vegetables. The fungus has also been reported from wheat-based bakery items.

According to some additional or alternative embodiments, the pathogenic bacteria and/or fungi are airborne pathogens that typically cause inflammation in the respiratory system e.g., nose, throat, sinuses and the lungs.

Examples of severe infections caused by airborne bacteria include, but are not limited to tuberculosis, pneumonia, and legionellosis.

As mentioned, according to some embodiments, the methods described herein are directed to controlling a population of pathogenic bacteria and/or fungi in a respiratory system which may cause a respiratory tract disease.

For administration by nasal inhalation, the active ingredients for use according to some embodiments of the invention are conveniently delivered in the form of an aerosol spray presentation from a pressurized pack or a nebulizer with the use of a suitable propellant, e.g., dichlorodifluoromethane, trichlorofluoromethane, dichloro-tetrafluoroethane or carbon dioxide. In the case of a pressurized aerosol, the dosage unit may be determined by providing a valve to deliver a metered amount. Capsules and cartridges of, e.g., gelatin for use in a dispenser may be formulated containing a powder mix of the compound and a suitable powder base such as lactose or starch.

In one embodiment, the composition according to the present invention may be administered in an aerosol, for example by way of a nasal spray, for instance for administration to the respiratory tract.

As used herein the term "respiratory tract disease" refers to diseases of the upper and/or lower respiratory tracts. The term disease as used herein is synonymous with the term disorder.

In one embodiment the respiratory tract disease is an upper respiratory tract disease.

Upper respiratory tract diseases include, for example, one or more of throat soreness, sneezing, blocked nose, runny nose or a cough is a symptom of one or more of the group consisting of: tonsillitis, otitis media rhinitis (inflammation of the nasal mucosa); rhinosinusitis or sinusitis (inflammation of the nares and paranasal sinuses, including frontal, ethmoid, maxillary, and sphenoid); nasopharyngitis, rhinopharyngitis or the common cold (inflammation of the nares, pharynx, hypopharynx, uvula, and tonsils); pharyngitis (inflammation of the pharynx, hypopharynx, uvula, and tonsils); epiglottitis or supraglottitis (inflammation of the superior portion of the larynx and upraglottic area); laryngitis (inflammation of the larynx); laryngotracheitis (inflammation of the larynx, trachea, and subglottic area); and tracheitis (inflammation of the trachea and subglottic area).

In one embodiment the respiratory tract disease is a lower respiratory tract disease.

Lower respiratory tract diseases include, for example, bronchitis, acute bronchitis, pneumonia, lung abscesses.

According to some embodiments, the present teachings are directed at controlling pathogenic microbes which include, but are not limited to, *Salmonella* Typhimurium, *Salmonella enterica*, *Salmonella enteritidis*, *Clostridium botulinum*, *Staphylococcus aureus*, *Campylobacter jejuni*, *Yersinia enterocolitica* and *Yersinia pseudotuberculosis*, *Vibrio cholerae* O1, *Vibrio cholerae* non-O1, *Vibrio parahaemolyticus* and other *Vibrio* spp., *Vibrio vulnificus*, *Clostridium perfringens*, *Bacillus cereus*, *Aeromonas hydrophila*, *Plesiomonas shigelloides*, *Shigella* spp., miscellaneous enteric pathogens, and *Streptococcus* spp.

According to some embodiments the diseases caused by the pathogenic microbes include, but are not limited to, staphylococcal infections (caused, for example, by *Staphylococcus aureus*, *Staphylococcus epidermidis*, or *Staphylococcus saprophyticus*), streptococcal infections (caused, for example, by *Streptococcus pyogenes*, *Streptococcus pneumoniae*, or *Streptococcus agalactiae*), enterococcal infections (caused, for example, by *Enterococcus faecalis*) diphtheria (caused, for example, by *Corynebacterium diptheriae*), anthrax (caused, for example, by *Bacillus anthracis*), listeriosis, gangrene (caused, for example, by *Clostridium perfringens*), tetanus (caused, for example, by *Clostridium tetani*), botulism (caused, for example, by *Clostridium botulinum*), toxic enterocolitis (caused, for example, by *Clostridium difficile*), bacterial meningitis (caused, for example, by *Neisseria meningitidis*), bacteremia (caused, for example, by *Neisseria gonorrhoeae*), *E. coli* infections (colibacilliocis), including urinary tract infections and intestinal infections, shigellosis (caused, for example, by *Shigella* species), salmonellosis (caused, for example, by *Salmonella* species), yersinia infections (caused, for example, by *Yersinia pestis, Yersinia pseudotuberculosis*, or *Yersinia enterocolitica*), cholera (caused, for example, by *Vibrio cholerae*), campylobacteriosis (caused, for example, by *Campylobacter jejuni* or *Campylobacter fetus*), gastritis (caused, for example, by *Helicobacter pylori*), pseudomonas infections (caused, for example, by *Pseudomonas aeruginosa* or *Pseudomonas mallei*), Haemophilus influenzae type B (HIB) meningitis, HIB acute epiglottitis, or HIB cellulitis (caused, for example, by Haemophilus influenzae), pertussis (caused, for example, by *Bordetella pertussis*), mycoplasma pneumonia (caused, for example, by *Mycoplasma pneumoniae*), nongonococcal urethritis (caused, for example, by Ureaplasma urealyticum), legionellosis (caused, for example, by *Legionella pneumophila*), syphillis (caused, for example, by *Treponema pallidum*), leptospirosis (caused, for example, by *Leptospira interrogans*), Lyme borreliosis (caused, for example, by *Borrelia burgdorferi*), tuberculosis (caused, for example, by *Mycobacterium tuberculosis*), leprosy (caused, for example, by *Mycobacterium leprae*), actinomycosis (caused, for example, by *Actinomyces* species), nocardiosis (caused, for example, by *Nocardia* species), chlamydia (caused, for example, by *Chlamydia psittaci, Chlamydia trachomatis*, or *Chlamydia pneumoniae*), Rickettsial diseases, including spotted fever (caused, for example, by *Rickettsia ricketsii*) and Rickettsial pox (caused, for example, by *Rickettsia akari*), typhus (caused, for example, by *Rickettsia prowazekii*), brucellosis (caused, for example, by *Brucella abortus, Brucella melitens*, or *Brucella suis*), and tularemia (caused, for example, by *Francisella tularensis*). Diseases with similar origins and symptoms are also known to affect animals.

According to a specific embodiment, the controlling is prophylactic (reduces the incidence of infection).

According to a specific embodiment, the controlling is therapeutic (reduces the symptoms and/or duration of infection).

The bacterial strains/species can be administered to subjects in need thereof using methods which are well known in the art.

When used as a medicament, the bacterial strains/species of the present invention may be used in any suitable form—whether when alone or when present in a combination with other components or ingredients.

The microorganism of the present invention or composition of the present invention may be used in the form of solid or liquid preparations or alternatives thereof. Examples of solid preparations include, but are not limited to tablets, capsules, dusts, granules and powders which may be wettable, spray-dried or freeze-dried. Examples of liquid preparations include, but are not limited to, aqueous, organic or aqueous-organic solutions, suspensions and emulsions.

Suitable examples of forms include one or more of: tablets, pills, capsules, ovules, solutions or suspensions, which may contain flavouring or colouring agents, for immediate-, delayed-, modified-, sustained-, pulsed- or controlled-release applications.

By way of example, if the composition of the present invention is used in a tablet form—such for use as a functional ingredient—the tablets may also contain one or more of: excipients such as microcrystalline cellulose, lactose, sodium citrate, calcium carbonate, dibasic calcium phosphate and glycine; disintegrants such as starch (preferably corn, potato or tapioca starch), sodium starch glycolate, croscarmellose sodium and certain complex silicates; granulation binders such as polyvinylpyrrolidone, hydroxypropylmethylcellulose (HPMC), hydroxypropylcellulose (HPC), sucrose, gelatin and acacia; lubricating agents such as magnesium stearate, stearic acid, glyceryl behenate and talc may be included.

Examples of nutritionally acceptable carriers for use in preparing the forms include, for example, water, salt solutions, alcohol, silicone, waxes, petroleum jelly, vegetable oils, polyethylene glycols, propylene glycol, liposomes, sugars, gelatin, lactose, amylose, magnesium stearate, talc, surfactants, silicic acid, viscous paraffin, perfume oil, fatty acid monoglycerides and diglycerides, petroethral fatty acid esters, hydroxymethyl-cellulose, polyvinylpyrrolidone, and the like.

Exemplary excipients for the forms include lactose, starch, a cellulose, milk sugar or high molecular weight polyethylene glycols.

For aqueous suspensions and/or elixirs, the composition of the present invention may be combined with various sweetening or flavouring agents, colouring matter or dyes, with emulsifying and/or suspending agents and with diluents such as water, propylene glycol and glycerin, and combinations thereof.

The forms may also include gelatin capsules; fibre capsules, fibre tablets etc.; or even beverages.

Further examples of forms are in the form of a cream for example. For some aspects the microorganism may be included in pharmaceutical and/or cosmetic creams such as sun creams and/or after-sun creams for example.

In one aspect, the composition according to the present invention may be administered in an aerosol, for example by way of a nasal spray, for instance for administration to the respiratory tract.

According to a specific embodiment, the microbial species/strains as described herein are dispensed from an aerosol dispensing device (or system).

There are devices known to atomize a liquid and deliver the atomized liquid into the surrounding air.

According to a specific embodiment the aerosol dispensing device is automated.

Such an aerosol dispersing device can work on its own as well as in conjunction with an HVAC system.

Figure 5:
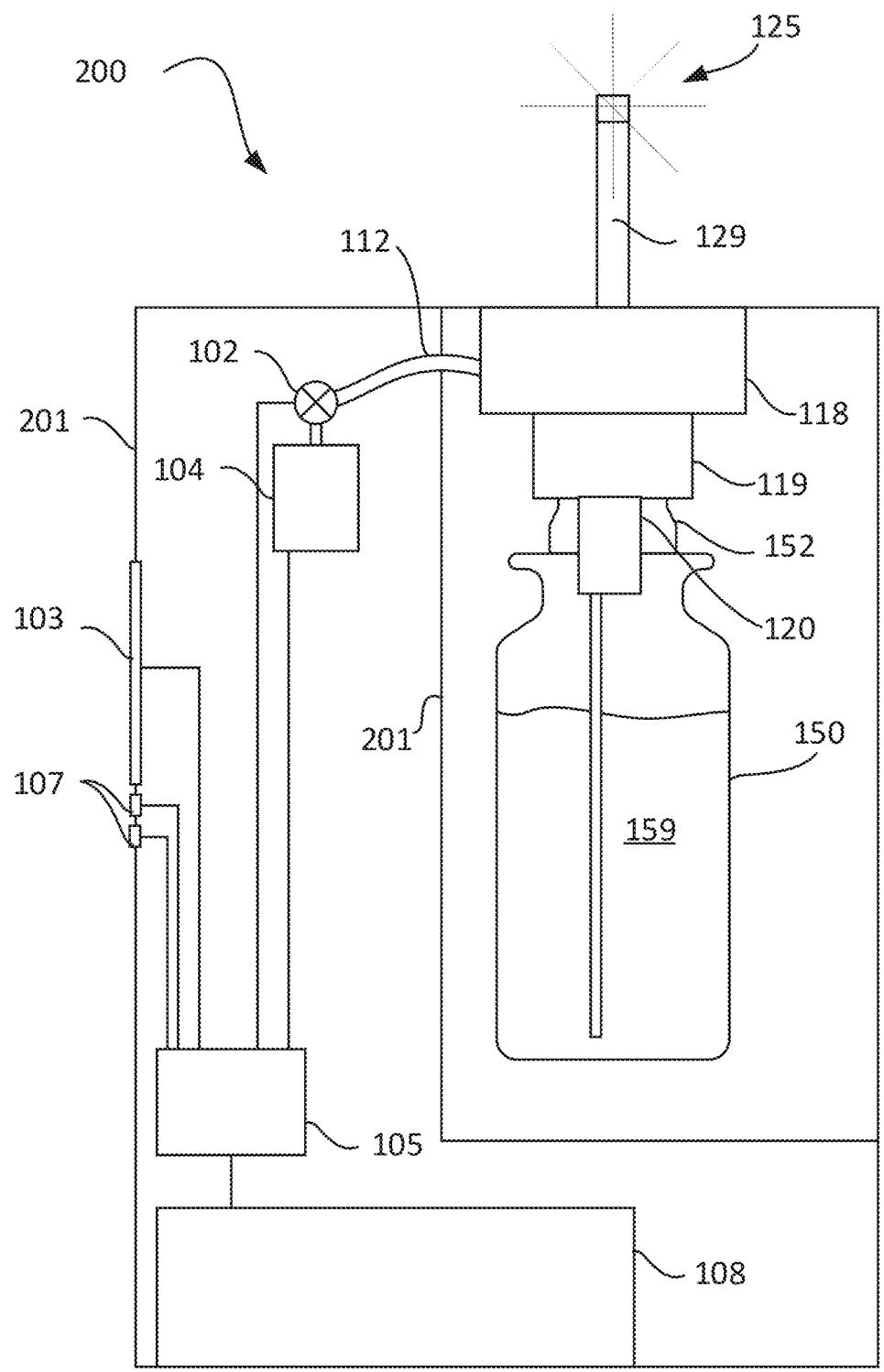
FIG. 5 is a simplified schematic drawing of an example aerosol dispensing device in accordance with some example embodiments.
Figure 6A:
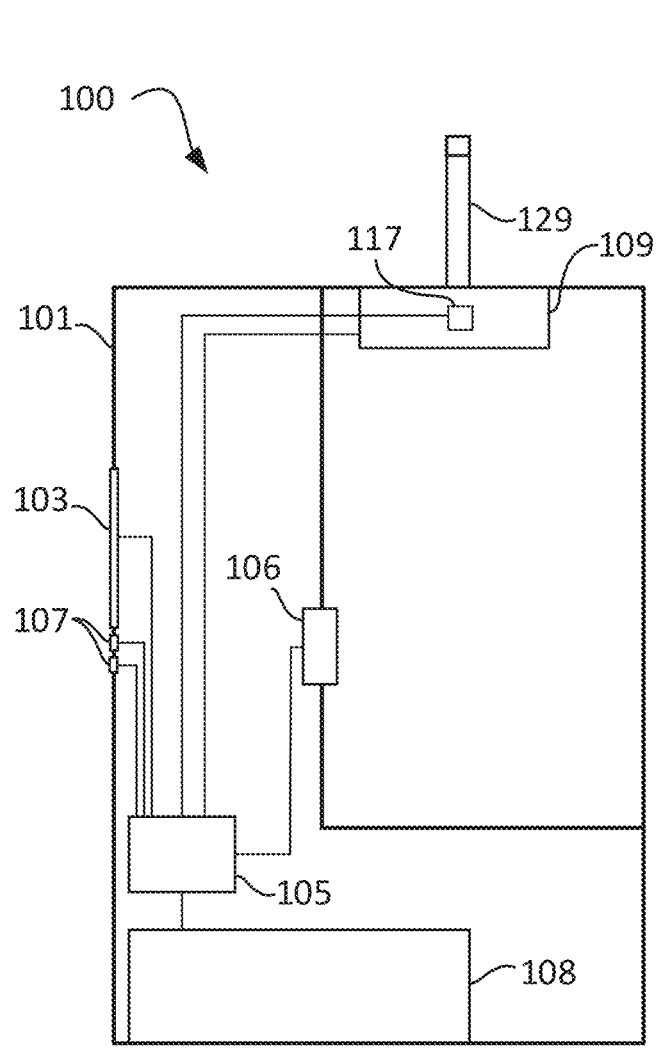
FIGS. 6A and 6B are simplified schematic drawings of an example aerosol dispensing device and an example replaceable cartridge respectively in accordance with some example embodiments.
Figure 6B:
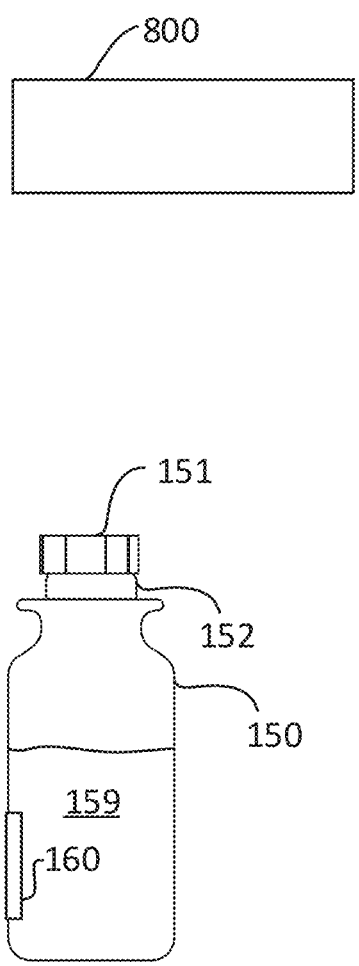
Figure 7:
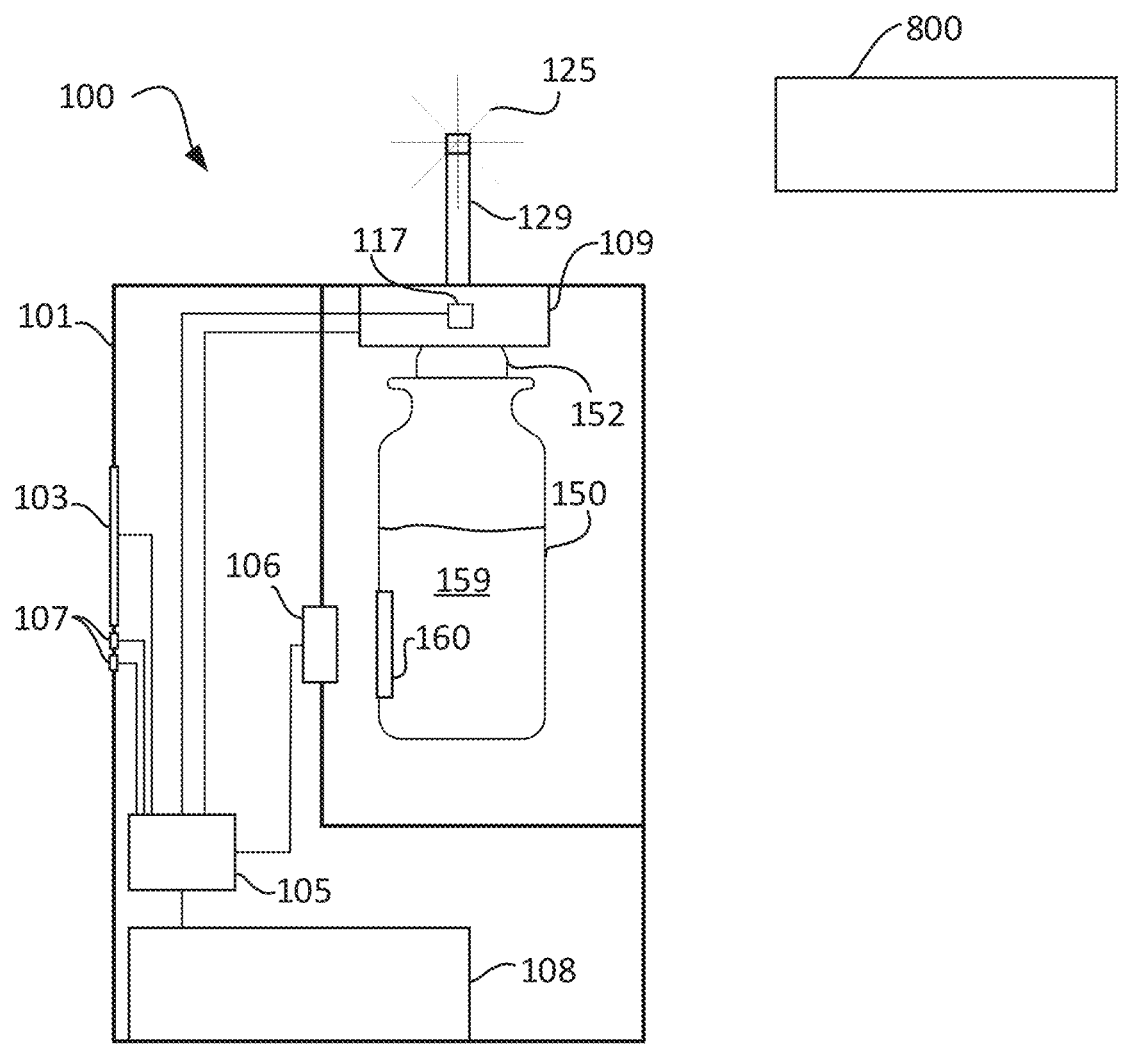
FIG. 7 is a simplified schematic drawing of an example replaceable cartridge installed in an example aerosol dispensing device in accordance with some example embodiments.

Reference is now made to FIG. 5 showing a simplified schematic drawing of an example aerosol dispensing device with a replaceable cartridge that is actuated with compressed air in accordance with some example embodiments. An aerosol dispensing device 200 includes a housing 201 that may house an air compressor 104 to actuate atomizing a liquid 159 contained in a cartridge 150. Pressurized air provided by compressor 104 may be delivered through valve 102 and a channel 112, e.g. a tube to a connector 118. Connector 118 may establish a fluid connection between compressor 104, cartridge 150 and an aerosol outlet 129 from which atomized liquid 125 may be expelled. An atomizer 120 may be integrated in connector 118 or in collar 152 of cartridge 150. Optionally, an adaptor 119 provides a sealed connection between cartridge 150 and connector 118. Although connector 118 and adaptor 119 are shown as two separate elements, it is understood that functionality of these two elements may be integrated into a single part.

According to some example embodiments, at least one of a cartridge for an aerosol dispensing device and the aerosol dispensing device includes a mechanism for stirring liquid contents of the cartridge. Optionally, liquid content in the cartridge may be stirred continuously or periodically during use to maintain a substantially constant concentration of active material over a height of the liquid.

In some example embodiments, device 200 is self-powered with a power source 108. Alternatively, device 200 may be powered by an external power source. In some example embodiments, device 200 includes a user interface including for example a display 103 and one or more user actuated buttons or knobs 107.

Device 200 may be positioned in an indoor environment. The indoor environment may be a public space such as a hospital or a shopping center or may be a personal space such as an office, a home or a vehicle. Optionally, device 200 may be configured to direct aerosol 125 expelled from channel 129 into airflow ducts of a heating, ventilation and air conditioning (HVAC) system. Optionally, circuit 105 is in communication or receives input from an HVAC system and is operated in coordination with the HVAC system. Alternatively, device 200 may be operated independently from an HVAC system and the aerosol may also be dispersed directly into the indoor space, e.g. not through the HVAC ducts.

One such configuration is described in U.S. Pat. No. 8,986,610 entitled "Apparatus and method for dispersing liquid in aerosol," the contents of which is incorporated by reference herein, describes a system and method to deliver an atomized solution to the interior volume of a building or room utilizing a Venturi effect for the atomization. It is described that the solution may contain at least one active material including at least one of a medicament, probiotic, nutraceutical, or combinations thereof. The system includes a solution chamber; a Venturi configuration operatively associated with said solution chamber; an air inlet associated with a pressurized air inlet source; an actuator and a sensor. The solution chamber may be in the form of a replaceable cartridge.

In known automated aerosol dispensing devices, the live organism or active material is typically in the form of a water based solution stored in a replaceable cartridge. A device with embodiments having cartridge replacement embodiments is further described hereinbelow.

Reference is now made to FIGS. 6A and 6B showing a simplified schematic drawing of an example aerosol dispensing device and an example replaceable cartridge respectively and to FIG. 7 showing an example replaceable cartridge installed in an example aerosol dispensing device all in accordance with some example embodiments. An aerosol dispensing device 100 includes a housing 101 that may house an actuator 109 configured to actuate atomization of a liquid 159 in a cartridge 150, an outlet channel 129 from which atomized liquid 125 may be expelled and a circuit 105 configured to control operation of actuator 109. An atomizer 120 for creating aerosol 125 based on actuation with actuator 109, may be integrated as part of actuator 109 or may be integrated in cartridge 150. Optionally, actuator 109 is configured to establish fluid connection with cartridge 150. According to some example embodiments, aerosol dispensing device 100 additionally includes a reader 106 configured to read data on a tag 160 included on cartridge 150.

In some example embodiments, device 100 is self-powered with a power source 108. Alternatively, device 100 may be powered by an external power source. In some example embodiments, device 100 includes a user interface including for example a display 103 and one or more user actuated buttons or knobs 107. Optionally, device 100 additionally includes a sensor 117 configured to sense when cartridge 150 is installed in device 100. Sensor 117 may for example be an opto-coupler sensor that detects a break in a line of sight due to insertion of neck 152 into actuator 109. In another example, sensor 117 may be a button switch that is compressed based on insertion of collar 152 into actuator 109.

Device 100 may be positioned in an indoor environment. The indoor environment may be a public space such as a hospital or a shopping center or may be a personal space such as an office, a home or a vehicle. Optionally, device 100 may be configured to direct aerosol 125 expelled from channel 129 into airflow ducts of a heating, ventilation and air conditioning (HVAC) system. Optionally, circuit 105 is in communication or receives input from an HVAC system and is operated in coordination with the HVAC system. Alternatively, device 100 may be operated independently from an HVAC system and the aerosol may also be dispersed directly into the indoor space, e.g. not through the HVAC ducts.

According to some example embodiments, liquid 159 may include sensitive material such as a pro-biotic, medicament, nutraceutical, or combinations thereof that may be prone to contamination. The material when contaminated may pose a health hazard. Furthermore, any malicious tampering with cartridge 150 may also lead to a hazardous situation. For example an offender may maliciously insert a harmful bacteria or an irritant into cartridge 150. Alternately, an offender may attempt to refill cartridge 150 with unknown or unregulated contents that may not be suitable or safe in general or for a particular indoor space. In other examples, a hazardous situation may be created without malicious intent, for example when a solution in the cartridge has passed its expiration date or when a property of the solution has been altered due to prolonged exposure to humidity or air.

According to some example embodiments, circuit 105 includes safety verification functionality to verify compatibility, authenticity and safety of cartridge 150 when it is inserted into housing 101 and optionally to provide ongoing monitoring while cartridge 150 is maintained in device 100. The verification may be based on input received from reader 106. In some example embodiments, circuit 105 receives data from reader 106 and compares the data received to information stored in memory. Optionally, if an identification code read by reader 106 matches an identification code listed in the memory, verification may be established. The memory may be memory included in circuit 105, memory included in a remote server 800 or memory included in a cloud. Optionally, the information needed to verify authentication of cartridges may be uploaded by a remote server 800 and circuit 105 may access the information based on wireless communication. According to some example embodiments, circuit 105 is configured to terminate dispersion or formation of atomized liquid 125 and provide an alert when cartridge 150 cannot be positively verified.

Reader 106 may be configured to scan a code or interrogate a tag 160 positioned on cartridge 150, when cartridge 150 is installed in device 100 and provide the data to circuit 105. In some examples, reader 106 is or includes a camera or a RFID scanner that is configured to detect data stored on cartridge 150. Preferably, reader 106 is an active reader that is controlled and powered with circuit 105. In some example embodiments, controller 105 activates reader 106 at a defined frequency, e.g. every 5-60 minutes to scan or interrogate tag 160. Additionally or alternatively, controller 105 may activate reader at defined events. For example controller 105 may activate reader when power of device 100 is turned on and during installation of cartridge 150 in the device 100. In some example embodiments communication between reader 106 and tag 160 is wireless or contactless. In other example embodiments, communication between reader 106 and tag 160 is based on electrical contact.

Optionally, cartridge 150 configured for use with device 100 includes tag or code 160 with data to verify its compatibility. Tag or code 160 may be a barcode, e.g. a one dimensional or two dimensional barcode, maybe in passive RFID tag and may be an active RFID tag. Tag or code 160 may be positioned in an inner surface of cartridge 150 that is in contact with fluid 159 or may be positioned on an outer surface of cartridge 150. According to some example embodiments, tag or code 160 may be positioned on cartridge 150 so that it aligns with reader 106 while establishing a sealed connection with actuator 109.

In some example embodiments, tag or code 160 includes passive storage. Information tagged or coded on tag or code 160 may include one or more of the following items: state of a seal on the cartridge, identification data, part number of the product, batch number, production date, expiration date, quantity of material in the cartridge, contents of the cartridge and operating instructions.

Optionally, contents 159 of cartridge 150 are sealed with a seal under cap 151 that is configured to be broken in actuator 109 while inserting cartridge 150 into housing 101. Optionally, breaking of the seal alters data stored in tag or code 160 so that the event may be recorded and detected by reader 106. Optionally, this information may be used to prevent operating device 100 with cartridges that have been refilled. Cartridge 150 may be in the form of a bottle or may be any container that can contain fluid 159 to be dispersed as an aerosol. Typically cartridge 150 is configured to be replaced after its contents have been emptied.

In some example embodiments, tag 160 may be an active tag and reader 106 may transmit data to tag 160 that may be stored in tag 160. Active storage may be a microchip with RAM memory in which case a small power source may be included on cartridge 150. Alternatively, active storage may be an active RFID.

Figure 8:
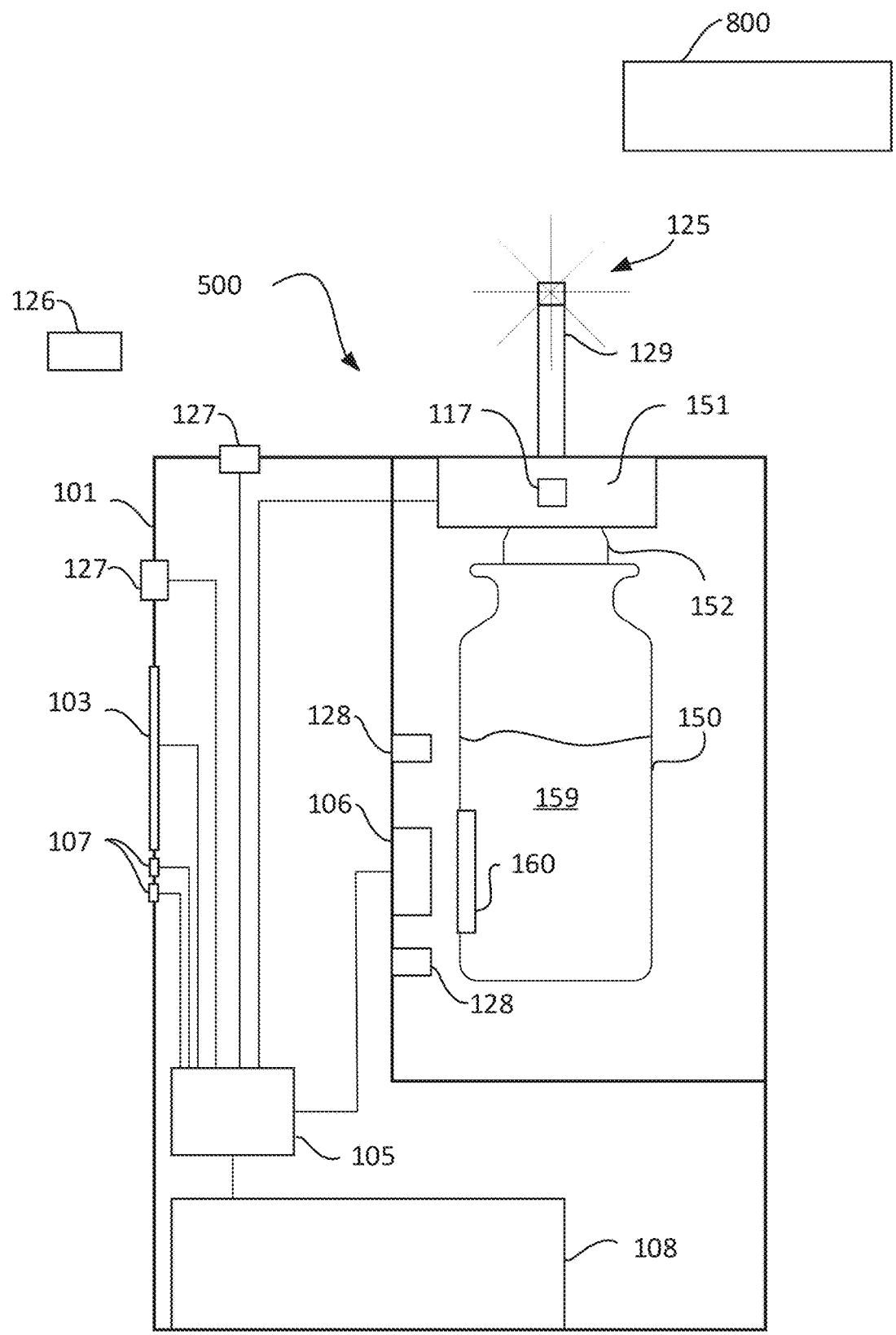
FIG. 8 is simplified schematic drawing of an example aerosol dispensing device including one or more sensors in accordance with some example embodiments.

FIG. 8 shows a simplified schematic drawing of an example aerosol dispensing device including one or more sensors in accordance with some example embodiments. According to some example embodiments, the aerosol dispensing device 500 includes a regulator configured to regulate activity of device 500 installed with a cartridge 150. Functionality of the regulator may be included in circuit 105. Optionally, device 500 includes reader 106 and circuit 105 may regulate activity of device 500 based on information received from reader 106, e.g. instruction that may be specific to liquid 159 contained in the cartridge. Circuit 105 may additionally or alternatively regulate activity of device 500 based on inputs from one or more sensors in communication with circuit 105. In some example embodiment, device 500 includes sensors 128 configured to detect a parameter related to content 159 in cartridge 150. Optionally, sensor 128 is a level sensor for detecting a level of liquid 159 in cartridge 150. Optionally, one sensor 128 may be positioned to sense liquid at 1-3 cm from a bottom of cartridge 150 to detect when contents of cartridge 150 are nearly emptied. In some example embodiments, when contents of cartridge 150 are nearly emptied, circuit 105 may provide an alert on display 103 and may also communicate this information to a remote server 800 in communication with circuit 105. Remote server 800 may then alert a service provider or deliver a new cartridge to the site including device 500.

Device 500 may additionally include sensors 127 that may detect environmental conditions. Optionally, humidity is detected. In some example embodiments, temperature is detected. At times, an expiration date may be adjusted based on the detected environmental conditions. For example an expiration date may be shortened in environments with higher humidity as compared to environments that are more arid. Optionally, frequency or duration of actuation may be adjusted based on output detected from one or more of sensors 127, sensors 128 and based on data read with reader 106.

In some example embodiments, device 500 may be configured to receive input from a stand-alone sensor 126 that is remote from device 500. Input may be received based on tethered or wireless connection. Stand-alone sensor 126 may be for example an air quality probe similar to E4000 indoor air quality probe offered by NanoSense, France, a thermostat associated with an HVAC, or a humidity sensor. Input from remote sensors 126 may similarly be used to adjust an expiration date or to adjust frequency or duration of actuation based on the detected environmental conditions.

According to some example embodiments, the aerosol dispensing device 500 additionally includes safety verification functionality as described herein above to verify compatibility, authenticity and safety of cartridge 150 when it is inserted into device 500 and optionally to provide ongoing monitoring while cartridge 150 is maintained in device 500. In some example embodiments, the safety verification functionality is based on reader 106 reading data on a tag 160 included on cartridge 150 and circuit 105 processing the data.

According to some embodiments the bacterial species/strains as described herein or compositions comprising same are not to be used in the treatment of agricultural water (irrigation water), agricultural soils and agricultural crops.

According to some embodiments, the bacterial species/strains as described herein or compositions comprising same can be used in the treatment of agricultural water (irrigation water), agricultural soils and agricultural crops. In still other embodiments, the formulations of cultured bacteria can be applied in the treatment at food processing facilities. In the case of food processing facilities, agricultural waters and soils, the formulations of cultured bacteria can be applied prophylactically or as a sanitizing agent following an exposure. The product can be used to treat foods including meat and meat products. The meat product can generally be any whole, cut, ground or processed meat product, including, ground beef ("hamburger"), ground turkey, ground chicken, ground pork, beef sausage, pork sausage, chicken sausage, turkey sausage, hot dogs, bologna, salami, cold cuts, game hens, whole chicken, lamb, ham, pork, cube meat, steaks, roasts, fillets, fish, or liver.

Any type of agricultural produce sold in marketplaces, such as those derived from plant or fungi, can be treated by the methods and compositions disclosed herein. Additional types of produce products that can be treated by the disclosed antimicrobial compositions include but are not limited to those derived from leaves, stems, fruit, flowers, seeds, roots, and like components that form the plant, as well as those derived from fungi, including the cap, stem, mycelium and annulus, and like components that form the fungi.

Any type of surface can be treated with the bacterial strains/species as described herein. Examples of surfaces that may be treated include of animate surfaces such, as those of animals or plants, and inanimate surface, such as food, buildings, furniture, objects and the like. Specific examples of surfaces that the composition could be applied to include, but are not limited to the following: meat, grinders, processors, extruders, cutting surfaces, cutting apparatus, blades, seafood, agricultural produce (fruit, vegetables, etc.), nuts, legumes, sprouts, trees, leaves, seeds, bulbs, flowers, animals (livestock and pets), eggs shells, skin, hair, bone, horn, hooves, wool, leather, lawns, fields, soil, floors, walls, countertops, cabinets, toilets, bathtubs, bathrooms (portable and non-portable), sinks, laundry equipment, kitchen appliances (refrigerators, freezers, dishwashers, etc.), heating and refrigeration coils, fans, ceiling fans, heating systems, air conditioning system, ventilation systems, internal and external ducts for ventilation, heating and air conditioning, tabletops, chairs and sofas, desks, luggage, fabrics, clothing, footwear, sports equipment, audio/visual equipment, computers, clocks, boxes (cardboard, wood, etc.), books, paper surfaces, garbage/trash receptacles, building materials, interior and exterior of transportation equipment (automobiles, airplanes, trains, boats, etc.), interior and exterior of spacecraft and other space facilities, trailers, tires, metal, ceramic, tile, linoleum, carpet, wall paper, painted surfaces, plastic, vinyl, polyvinyl chloride (PVC) and the like, plastic, rubber, glass, hose line, plumbing (inside and outside), other application machinery, lighting, heating and cooling filaments, ovens, storage containers, bottles, cans, reception areas, milking parlors, food processing facilities, and the like.

The article of manufacture may be packaged in a form that is appropriate or convenient for shipment, administration, or storage. For example, the product can be placed into a hermetically sealed pouch of plastic, paper, metalized plastic, or metal (e.g. aluminum), bottle, cartridge capsule, plastic bag, or a box.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention.

Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is understood that any Sequence Identification Number (SEQ ID NO) disclosed in the instant application can refer to either a DNA sequence or a RNA sequence, depending on the context where that SEQ ID NO is mentioned, even if that SEQ ID NO is expressed only in a DNA sequence format or a RNA sequence format.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Culture of Animal Cells—A Manual of Basic Technique" by Freshney, Wiley-Liss, N. Y.

(1994), Third Edition; "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

MATERIALS AND METHODS

Strains

Bacillus strain was isolated from home-made Doenjang using Luria Bertani Miller agar (BD, Difco) agar for plating. Representative colonies were picked from plates with the highest dilution still showing colonies. After purification, the strain was stored at −80° C. The stock culture was propagated first in 10 ml LB Miller broth (in 50 ml Falcon sterile tube) for 18 hours (rotary shaker, 120 RPM), and then the culture was 1% diluted into a fresh media and was propagated in the same conditions as described previously, before each experiment.

Reference strains were obtained from ATCC (American Type Culture Collection) and KACC (Korean Agricultural Culture Collection) and KCTC (Korea, Collection for Type Cultures).

16S rDNA Sequencing

Pure cultures of *Bacillus amyloliquefaciens* 298 was grown on LB Miller agar (BD Difco) at 37° C. for 24 hours. The plate was sent to Solgent Inc. (Deajun, South Korea) for bi-directional 16S rDNA sequencing using (5'-AGA GTT TGATCMTGG CTC AG-3', SEQ ID NO: 1) and 1492R (5'-TAC GGY TAC CTT GTT ACG ACTT-3' SEQ ID NO: 2) primers by (Reysenbach, Giver et al. 1992). Bi-directional sequencing results were assembled using Codon Code Aligner (Codon Code Corporation, USA) and compared with reference sequences of *Bacillus* species on the GenBank database (www(dot)ncbi(dot)nlm(dot)nih(dot)gov/Blastn/).

API Test

Specific sugar fermentation pattern was monitored using API 50 CHB strips (Biomerieux). The *Bacillus* strain pellet was prepared using LB Miller agar (BD Difco) at 37° C. for 24 hours and centrifuged 14,000 rpm for 5 min. The pellet was suspended using the preparation media in the kit and applied on different sugars according to the instruction manual.

Hemolysis Test

*B. amyloliquefaciens* 298 was grown at 37° C. for 18 hours in LB broth and then streaked onto 5% sheep blood agar (Hanil Komed) and incubated for 24 h at 37° C. Alpha (a) hemolysis was considered as the partial decomposition of the hemoglobin of the red blood cells, beta ((3) hemolysis as the complete breakdown of the hemoglobin of the red blood cells observed as a clear zone in the agar plate and gamma (y) hemolysis as the lack of hemolysis. *B. cereus* ATCC 27348 was used as a positive control.

Lecithinase Test

*B. amyloliquefaciens* 298 and *B. cereus* ATCC 27348 (positive control) were grown at 37° C. for 18 hours in LB Miller broth and streaked out onto egg yolk agar. The plates were incubated for 24 h at 37° C. and the formation of a white precipitate around the colonies was considered as positive for lecithinase activity (Hong, Huang et al. 2008, Sorokulova, Pinchuk et al. 2008).

Antibiotic Resistance Test

The basic protocol was followed by CLSI recommendation (Jorgensen and Turnidge 2015). Pure cultures of *B. amyloliquefaciens* 298 were cultivated at 37° C. for 18 hours in LB Miller agar. The agar dilution method was used to assess the minimal inhibitory concentration (MIC) of the antibiotics against the strain. A single colony was resuspended in phosphate buffer saline (PBS) 1× and adjusted 0.01 optical density (OD). Ten microliters ($1\times10^5$ CFU/mL) of strain were inoculated on the plates using multipin-inoculator and incubated at 37 C. for 24 hours. The strain was considered susceptible when they were inhibited at a concentration for a specific antimicrobial equal or lower than the established cut-off value and resistant bacterial strain when it was not inhibited at a concentration of a specific antimicrobial higher than the established cut-off value according to the parameters established by the European Food Safety Authority (EFSA).

Inhalation Infection Test

The animal study was approved by Handong Global University Ethical committee. For the experiment, 40 mice were divided into four groups comprising negative control, two positive controls infected with pathogenic microorganisms of *Streptococcus pneumoniae* ATCC49619 and *Bacillus cereus* ATCC27348 and one group infected with the tested microorganism. Potential probiotic *B. amyloliquefaciens* 298 was infected at a dose of $1\times10^7$ CFU/mouse with pre-treatment of cyclophosphamide to induce immunocompromised status. The cyclophosphamide was used to derive immunocompromised animal model to monitor more emphasized influence of infected microorganims so called worst case scenario (Kong, Hellermann et al. 2005).

The *B. amyloliquefaciens* 298 was grown for 18 hours in LB Miller broth (BD Difco) at 37° C. while *S. pneumoniae* ATCC49619 was cultured on 5% Sheep blood agar and sub-cultured to Brain Heart Infusion broth (BD Difco) and incubated at 37° C. The bacterial solution was diluted using 1× PBS to $1\times10^7$ CFU/mouse. The inoculum concentration was determined by enumeration of cultured bacteria on agar plates.

The animal lung infection model was carried out in 4-week-old female ICR mice (Hyo-chang science). The mice were anesthetized during respiratory infection (*Streptococcus pneumoniae* ATCC49619 and *Bacillus cereus* ATCC27348) using 50 µL of bacterial suspension through intranasal route. After 24 h post infection, 2 mice of each group were selected randomly and sacrificed with diethyl ether for enumeration of viable colonies in lungs. Lungs were extracted and homogenized with Phosphate-buffered saline (PBS). Before homogenization, lungs were monitored visually. The homogenized lung samples were diluted and spread on 5% Sheep blood agar to enumerate number of pathogens in the lungs. The plates were incubated for 18 hours. The rest of the mice were monitored during 1 week to measure their survival rates (Ginsberg, Moldawer et al. 1991).

Efficacy Tests

The agar well diffusion assay was performed to evaluate the antagonistic activity of *B. amyloliquefaciens* 298 against the growth of pathogenic bacteria including *Escherichia coli* ATCC 22922, *Pseudomonas aeruginosa*, *B. cereus* ATCC 27348, *Staphylococcus aureus* ATCC 11335, *Salmonella Typhimurium* ATCC 14028 and *Listeria innocua* ATCC 3586. The antagonistic activity of *B. amyloliquefaciens* 298 was also verified against molds such as *Alternaria alternata* (Fries) Keissler (ATCC® MYA-4642™), *Cladosporium sphaerospermum* Penzig (ATCC® MYA-4645™) and *Penicillium chrysogenum* Thom (ATCC® MYA-4644™). Brain Heart Infusion (BHI) Agar was used for the antagonism against pathogenic microorganisms while the Potato Dextrose Agar (PDA) was used for evaluation against molds. Reference pathogens were prepared using BHI broth at 37° C. for 18 hours while *B. amyloliquefaciens* 298 was grown using LB broth at 37° C. for 18 hours. Molds were prepared using PDA at 25° C. with 85% HR for 7 days. Mold spores, pathogens and *B. amyloliquefaciens* 298 were harvested and resuspended in PBS. Pathogens and *B. amyloliquefaciens* 298 were adjusted to an optical density of 0.2 and 100 uL of pathogen suspended in PBS was spread on BHI agar plates. The same amount of mold spore suspension was inoculated on PDA. Wells were made in all the plates and 20 μL of *B. amyloliquefaciens* 298 suspensions were inoculated in the wells while the BHI plates were incubated at 37° C. for 24 hours and PDA plates at 25° C. for 72 hours. The inhibition of pathogens and molds was observed as a clear zone around the *bacillus* strain inoculated wells and 10% hydrogen peroxide served as a positive control.

16S rDNA Sequence

The identity of the strain was confirmed as *B. subtilis* according to the National Center for Biotechnology Information (NCBI) database according to the 16S-rRNA (SEQ ID NO: 3) sequencing result.

Complete Genome Sequence

The complete genome sequence of *B. amyloliquefaciens* 298 was generated using the PacBio RS platform with single-molecule real-time (SMRT) sequencing at Theragenetex (Seoul, South Korea). Annotations were performed by merging the results obtained from the Rapid Annotations using Subsystems Technology (RAST) server, Glimmer 3.02 modeling software, tRNAscan-SE 2.0, and RNAmmer 1.2. In addition, the contigs were searched against the KEGG, UniProt, and Clusters of Orthologous Groups (COG) databases to annotate the gene description.

Metabolite Analysis

Total protein was extracted from growth media of *B. amyloliquefaciens* 298 after 18 hours at 37° C. incubation to evaluate the secreted metabolites of *B. amyloliquefaciens* 298. A stock solution was prepared dissolving 500 g of Trichloroacetic acid (TCA) into 350 ml of distilled water. 1 volume of TCA stock solution was added to 4 volumes of *B. amyloliquefaciens* 298 growth media and incubated at 4° C. for 10 min. The tube was centrifuged at 14,000 rpm for 5 min and supernatant was removed to concentrate the protein pellet. The pellet was washed with 200 μl cold acetone and again concentrated by 14,000 rpm centrifugation for 5 min. This step was repeated for three times and the pellet was sent to be analyzed using LC-LTQ-Orbitrap at Technopark Biocenter (Pohang, South Korea). The raw data was analyzed using UniProt database to match predicted proteins from the growth media of *B. amyloliquefaciens* 298.

Example 1

In-Vitro Safety Evaluation of Lecithinase and Hemolysis Activity

*B. amyloliquefaciens* 298 did not show lecithinase activity observed as the absence of a white precipitate around the *Bacillus* colonies and all *B. amyloliquefaciens* 298 showed negative reaction for hemolysis as well.

TABLE 1

Lecithinase and hemolysis activity of *B. amyloliquefaciens* 298 and *B. cereus* ATCC 27348.

| Strain | Lecithinase activity | Hemolysis activity |
| --- | --- | --- |
| *Bacillus amyloliquefaciens* 298 | Negative | Gamma |
| *Bacillus cereus* ATCC 27348 (positive control) | Positive | Beta |

Example 2

In-vitro Evaluation of Antibiotic Resistance

The agar dilution was used to evaluate the minimal inhibitory concentration (MIC) of antibiotics. *B. amyloliquefaciens* 298 was found to be sensitive to erythromycin, gentamicin, tetracycline, streptomycin, vancomycin, chloramphenicol, kanamycin and clindamycin according to the European Food Safety Authority MIC breakpoints for *Bacillus* species. The determined MIC values are clearly below or equal to the EFSA breakpoint values (Table 2).

TABLE 2

Minimum inhibitory concentrations (MIC) of *B. amyloliquefaciens* 298. Antibiotic resistance test

| | Minimum inhibitory concentration (mg/L) of antibiotics | | | | | | | |
| --- | --- | --- | --- | --- | --- | --- | --- | --- |
| Strain | Ery | Gen | Tet | Str | Van | Chl | Kan | Cli |
| *B. amyloliquefaciens* 298 | ≤0.125 | ≤2 | ≤0.125 | 8 | 0.25 | ≤4 | ≤4 | 0.5 |
| EFSA breakpoint | 4 | 4 | 8 | 8 | 4 | 8 | 8 | 4 |

Ery: Erythromycin;
Gen: Gentamicin;
Tet: Tetracycline;
Str: Streptomycin;
Vm: Vancomycin;
Chl: Chloramphenicol;
Kan: Kanamycin;
Cli: Clindamycin.

Example 3

Respiratory Tract Infection Test

The survival rate after respiratory tract infection of *B. amyloliquefaciens* 298 was 100% while the positive control of pathogenic bacteria infected groups including *S. pneumoniae* and *B. cereus* showed 100% mortality after 24 hours (FIG. 1). Lung pictures were taken and showed strong damage in pathogen infected positive groups while lung of *B. amyloliquefaciens* 298 infected groups showed similar lung status as negative control group (FIG. 2) and any colony of *Bacillus* was found from the homogenized lung of *B. amyloliquefaciens* 298 infected group (data not shown). These data demonstrate that *B. amyloliquefaciens* 298 does not infect lung probably due to lack of colonization in the lung.

Example 4

Efficacy Tests

The antagonism test results of *B. amyloliquefaciens* 298 showed inhibited growth of *E. coli* ATCC 22922, *P. aeruginosa, B. cereus* ATCC 27348 and *S. Typhimurium* ATCC 14028 at different degrees (FIG. 3 and Table 3).

TABLE 3

Antagonistic activity of *Bacillus amyloliquefaciens* 298 against pathogens.

| Pathogens | *B. amyloliquefaciens* 298 |
|---|---|
| *Escherichia coli* ATCC 22922 | 2 |
| *Pseudomonas aeruginosa* | 1 |
| *Bacillus cereus* ATCC 27348 | 2 |
| *Staphylococcus aureus* ATCC 11335 | 1 |
| *Salmonella Typhimurium* ATCC 14028 | 2 |
| *Listeria innocua* ATCC 3586 | NA |

NA: No antagonism was observed

*B. amyloliquefaciens* 298 antagonism against mold indicates positive antagonism against *Alternaria alternata* (Fries) Keissler (ATCC® MYA-4642™) and *Cladosporium sphaerospermum* Penzig (ATCC® MYA-4645™) at variable level (Table 4). The inhibition of the mold growth is evidently expressed as a clear zone around the wells inoculated with the *B. amyloliquefaciens* 298 (FIG. 4). *Penicillium chrysogenum* Thom (ATCC® MYA-4644™) was not inhibited at all for any of the strains used on this experiment, however the mycelium color around the well inoculated with *B. amyloliquefaciens* 298 show and slightly decrease in the intensity (data not shown) from green to white.

TABLE 4

Antifungal activity of *Bacillus amyloliquefaciens* 298 against molds.

| | Inhibition zone (mm) | | |
|---|---|---|---|
| Strain | *Alternaria alternata* (Fries) Keissler (ATCC MYA-4642) | *Cladosporium sphaerospermum* Penzig (ATCC MYA-4645) | *Penicillium chrysogenum* Thom (ATCC MYA-4644) |
| *Bacillus amyloliquefaciens* 298 | 6 | 6 | NA |
| Hydrogen peroxide 10% | 8 | 12 | 10 |

NA: No antagonism was observed

Example 5

Taxonomic Identification

The identity of the strain was confirmed as *B. subtilis* according to the National Center for Biotechnology Information (NCBI) database. API results were monitored for further identification of physiological characteristics.

Example 6

Complete Genome Sequence

A Single run of PacBio provided total number of 151,771 reads which comprises in total of 1,368,609,189 bases. Raw data was assembled using Canu v1.6 and single contig was produced in size of 3,928,316 base pairs (Separate attached text file of "*Bacillus* amyloliquefaciens 298.fasta"). Total number of genes were 3,854 (3,740 coding sequences) and 3,044 annotated genes were found which calculated as 81.39% of total genes (gene annotations are listed in Table 5 below).

TABLE 5

| #ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 387 | 1676 | + | GENE_00001 | Prodigal: 2.6 | CDS | — | — | — | — | O07553 | nhaC_1 | — | — | Na(+)/H(+) antiporter NhaC |
| Contig1 | 1714 | 3096 | − | GENE_00002 | Prodigal: 2.6 | CDS | — | — | — | — | P94426 | gabR_1 | — | — | HTH-type transcriptional regulatory protein GabR |
| Contig1 | 3215 | 3835 | + | GENE_00003 | Prodigal: 2.6 | CDS | — | — | — | — | P21341 | paiB_1 | — | — | Protease synthase and sporulation protein PAI 2 |
| Contig1 | 3884 | 4246 | − | GENE_00004 | Prodigal: 2.6 | CDS | — | — | — | — | — | — | — | — | hypothetical protein |
| Contig1 | 4463 | 5653 | − | GENE_00005 | Prodigal: 2.6 | CDS | — | — | — | — | P43531 | yntM_1 | — | — | Inner membrane transport protein YnfM |
| Contig1 | 5898 | 6476 | + | GENE_00006 | Prodigal: 2.6 | CDS | — | — | — | — | P43506 | bm3R1_1 | — | — | HTH-type transcriptional repressor Bm3R1 |
| Contig1 | 6669 | 6968 | − | GENE_00007 | Prodigal: 2.6 | CDS | — | — | — | — | P23261 | cotF_1 | — | — | Spore coat protein F precursor |
| Contig1 | 6983 | 7180 | − | GENE_00008 | Prodigal: 2.6 | CDS | — | — | — | — | — | — | — | — | hypothetical protein |
| Contig1 | 7199 | 8335 | − | GENE_00009 | Prodigal: 2.6 | CDS | 1.2.99.4 | — | — | — | Q52078 | fdm_1 | — | — | Formaldehyde dismutase |
| Contig1 | 8354 | 8722 | − | GENE_00010 | Prodigal: 2.6 | CDS | — | — | — | — | P23261 | cotF_2 | — | — | Spore coat protein F precursor |
| Contig1 | 8740 | 8985 | − | GENE_00011 | Prodigal: 2.6 | CDS | — | — | — | — | — | — | — | — | hypothetical protein |
| Contig1 | 9336 | 10613 | + | GENE_00012 | Prodigal: 2.6 | CDS | 2.7.13.3 | — | — | — | O32198 | liaS_1 | — | — | Sensor histidine kinase LiaS |
| Contig1 | 10606 | 11241 | + | GENE_00013 | Prodigal: 2.6 | CDS | — | — | — | — | Q7A4R9 | vraR_1 | — | — | Response regulator protein VraR |
| Contig1 | 11340 | 13493 | + | GENE_00014 | Prodigal: 2.6 | CDS | — | — | — | — | P96687 | ydfJ_1 | — | — | Membrane protein YdfJ |
| Contig1 | 13527 | 14249 | − | GENE_00015 | Prodigal: 2.6 | CDS | 2.4.2.- | — | — | — | O33341 | — | — | — | Putative glutamine amidotransferase |
| Contig1 | 14386 | 16014 | − | GENE_00016 | Prodigal: 2.6 | CDS | — | — | — | — | P63389 | yheS_1 | — | — | putative ABC transporter ATP-binding protein YheS |
| Contig1 | 16293 | 16820 | − | GENE_00017 | Prodigal: 2.6 | CDS | 2.3.1.57 | — | — | — | P0A951 | speG | — | — | Spermidine N(1)-acetyltransferase |
| Contig1 | 16939 | 17796 | − | GENE_00018 | Prodigal: 2.6 | CDS | — | PRK04164 | — | — | — | — | — | — | hypothetical protein |
| Contig1 | 18109 | 19212 | + | GENE_00019 | Prodigal: 2.6 | CDS | 1.1.1.6 | — | — | — | P32816 | gldA_1 | — | — | Glycerol dehydrogenase |
| Contig1 | 19359 | 20570 | + | GENE_00020 | Prodigal: 2.6 | CDS | — | — | — | — | P28246 | bcr_1 | — | — | Bicyclomycin resistance protein |
| Contig1 | 20599 | 21834 | − | GENE_00021 | Prodigal: 2.6 | CDS | 2.3.1.179 | — | — | — | P73283 | fabF_1 | — | — | 3-oxoacyl-[acyl-carrier-protein] synthase 2 |
| Contig1 | 21943 | 22782 | + | GENE_00022 | Prodigal: 2.6 | CDS | — | PRK10621 | — | — | — | — | — | — | hypothetical protein |
| Contig1 | 22824 | 23567 | − | GENE_00023 | Prodigal: 2.6 | CDS | — | — | — | — | — | — | — | — | hypothetical protein |
| Contig1 | 23726 | 24184 | − | GENE_00024 | Prodigal: 2.6 | CDS | 2.3.1.57 | — | — | — | P39909 | bltD | — | — | Spermine/spermidine acetyltransferase |
| Contig1 | 24317 | 25138 | + | GENE_00025 | Prodigal: 2.6 | CDS | — | — | — | — | P0A4T9 | tipA | — | — | HTH-type transcriptional activator TipA |
| Contig1 | 25353 | 26225 | + | GENE_00026 | Prodigal: 2.6 | CDS | — | — | — | — | P0ABT8 | yijE | — | — | putative inner membrane transporter YijE |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 26325 | 27008 | + | GENE_00027 | Prodigal: 2.6 | CDS | — | — | PF12535.2 | — | — | — | — | Hydrolase of X-linked nucleoside diphosphate N terminal | hypothetical protein |
| Contig1 | 27140 | 28045 | − | GENE_00028 | Prodigal: 2.6 | CDS | 3.8.1.3 | — | — | — | Q01398 | dehH1 | — | — | Haloacetate dehalogenase H-1 |
| Contig1 | 28067 | 29122 | − | GENE_00029 | Prodigal: 2.6 | CDS | 1.1.1.83 | — | — | — | P76251 | dmlA | — | — | D-malate dehydrogenase [decarboxylating] |
| Contig1 | 29305 | 29991 | + | GENE_00030 | Prodigal: 2.6 | CDS | — | — | — | — | P0ACM2 | ydfH_1 | — | — | putative HTH-type transcriptional regulator YdfH |
| Contig1 | 30131 | 31324 | + | GENE_00031 | Prodigal: 2.6 | CDS | 2.4.1.- | — | — | — | Q53685 | oleD_1 | — | — | Oleandomycin glycosyltransferase |
| Contig1 | 31382 | 31636 | − | GENE_00032 | Prodigal: 2.6 | CDS | — | — | — | — | — | — | — | — | hypothetical protein |
| Contig1 | 31870 | 32139 | + | GENE_00033 | Prodigal: 2.6 | CDS | — | — | — | — | — | — | — | — | hypothetical protein |
| Contig1 | 32276 | 33634 | + | GENE_00034 | Prodigal: 2.6 | CDS | — | — | — | — | P32959 | pbpE | — | — | Penicillin-binding protein 4* |
| Contig1 | 33687 | 33860 | − | GENE_00035 | Prodigal: 2.6 | CDS | — | — | — | — | — | — | — | — | hypothetical protein |
| Contig1 | 34056 | 34622 | + | GENE_00036 | Prodigal: 2.6 | CDS | — | — | — | — | — | — | — | — | hypothetical protein |
| Contig1 | 34674 | 35834 | − | GENE_00037 | Prodigal: 2.6 | CDS | — | — | — | — | Q0CQS6 | pbuE_1 | — | — | Purine efflux pump PbuE |
| Contig1 | 36166 | 36882 | + | GENE_00038 | Prodigal: 2.6 | CDS | — | — | — | — | O05509 | gmuR | — | — | HTH-type transcriptional regulator GmuR |
| Contig1 | 37004 | 37690 | + | GENE_00039 | Prodigal: 2.6 | CDS | — | — | — | — | P0ACL9 | pdhR | — | — | Pyruvate dehydrogenase complex repressor |
| Contig1 | 37680 | 38894 | + | GENE_00040 | Prodigal: 2.6 | CDS | — | — | — | — | P37482 | yycB | — | — | putative transporter YycB |
| Contig1 | 38954 | 39268 | − | GENE_00041 | Prodigal: 2.6 | CDS | — | — | — | — | O69279 | sugE_1 | — | — | Quaternary ammonium compound-resistance protein SugE |
| Contig1 | 39268 | 39597 | − | GENE_00042 | Prodigal: 2.6 | CDS | — | — | — | — | O69279 | sugE_2 | — | — | Quaternary ammonium compound-resistance protein SugE |
| Contig1 | 39670 | 40251 | − | GENE_00043 | Prodigal: 2.6 | CDS | — | — | — | — | O07001 | yvdT | — | — | putative HTH-type transcriptional regulator YvdT |
| Contig1 | 40368 | 41930 | − | GENE_00044 | Prodigal: 2.6 | CDS | — | — | — | — | O07002 | yveA_1 | — | — | Aspartate-proton symporter |
| Contig1 | 42168 | 43022 | − | GENE_00045 | Prodigal: 2.6 | CDS | 1.11.1.6 | — | — | — | P80878 | — | — | — | putative manganese catalase |
| Contig1 | 43134 | 43595 | − | GENE_00046 | Prodigal: 2.6 | CDS | — | — | PF08327.5 | — | O07615 | ydbD_1 | — | Activator of Hsp90 ATPase homolog 1-like protein | hypothetical protein |
| Contig1 | 43723 | 44724 | + | GENE_00047 | Prodigal: 2.6 | CDS | 1.6.5.- | — | — | — | O07615 | yhfP | — | — | Putative quinone oxido-reductase YhfP |
| Contig1 | 45155 | 46573 | + | GENE_00048 | Prodigal: 2.6 | CDS | — | — | — | — | O34718 | iolT | — | — | Major myo-inositol transporter IolT |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 46877 | 46953 | + | GENE_00049 | Aragorn: 1.2 | tRNA | — | — | — | — | — | — | — | — | tRNA-Arg(acg) |
| Contig1 | 46962 | 47035 | + | GENE_00050 | Aragorn: 1.2 | tRNA | — | — | — | — | — | — | — | — | tRNA-Gly(tcc) |
| Contig1 | 47200 | 48746 | + | GENE_00051 | — | rRNA | — | — | — | — | — | — | — | — | 16S ribosomal RNA |
| Contig1 | 48982 | 51906 | + | GENE_00052 | — | rRNA | — | — | — | — | — | — | — | — | 23S ribosomal RNA |
| Contig1 | 51961 | 52071 | + | GENE_00053 | — | rRNA | — | — | — | — | — | — | — | — | 5S ribosomal RNA |
| Contig1 | 52094 | 52170 | + | GENE_00054 | Aragorn: 1.2 | tRNA | — | — | — | — | — | — | — | — | tRNA-Met(cat) |
| Contig1 | 52181 | 52257 | + | GENE_00055 | Aragorn: 1.2 | tRNA | — | — | — | — | — | — | — | — | tRNA-Asp(gtc) |
| Contig1 | 52439 | 53416 | + | GENE_00056 | Prodigal: 2.6 | CDS | 2.7.4.16 | — | — | — | P0AGG0 | thiL | — | — | Thiamine-monophosphate kinase |
| Contig1 | 53432 | 53908 | + | GENE_00057 | Prodigal: 2.6 | CDS | — | — | — | — | O05515 | tsaE | — | — | tRNA threonylcarbamoyl-adenosine biosynthesis protein TsaE |
| Contig1 | 53889 | 54578 | + | GENE_00058 | Prodigal: 2.6 | CDS | — | — | — | — | O05516 | tsaB | — | — | tRNA threonylcarbamoyl-adenosine biosynthesis protein TsaB |
| Contig1 | 54589 | 55044 | + | GENE_00059 | Prodigal: 2.6 | CDS | 2.3.1.- | — | — | — | P21340 | paiA_1 | — | — | Protease synthase and sporulation negative regulatory protein PAI 1 |
| Contig1 | 55037 | 56077 | + | GENE_00060 | Prodigal: 2.6 | CDS | 2.3.1.- | — | — | — | O05518 | tsaD | — | — | tRNA N6-adenosine threonylcarbamoyl-transferase |
| Contig1 | 56300 | 58228 | − | GENE_00061 | Prodigal: 2.6 | CDS | — | — | — | — | P63389 | yheS_2 | — | — | putative ABC transporter ATP-binding protein YheS |
| Contig1 | 58368 | 58880 | + | GENE_00062 | Prodigal: 2.6 | CDS | — | — | — | — | Q5L3F4 | moaC | — | — | Cyclic pyranopterin monophosphate synthase accessory protein |
| Contig1 | 58877 | 59524 | + | GENE_00063 | Prodigal: 2.6 | CDS | — | — | — | — | O05521 | rex | — | — | Redox-sensing transcriptional repressor Rex |
| Contig1 | 59543 | 59713 | + | GENE_00064 | Prodigal: 2.6 | CDS | — | — | — | — | O05522 | tatAy | — | — | Sec-independent protein translocase protein TatAy |
| Contig1 | 59729 | 60478 | + | GENE_00065 | Prodigal: 2.6 | CDS | — | — | — | — | O05523 | tatC2 | — | — | Sec-independent protein translocase protein TatCy |
| Contig1 | 60520 | 60711 | − | GENE_00066 | Prodigal: 2.6 | CDS | — | — | — | — | — | — | — | — | hypothetical protein |
| Contig1 | 60708 | 61442 | − | GENE_00067 | Prodigal: 2.6 | CDS | — | — | PF02517.10 | — | — | — | — | — | CAAX amino terminal protease self-immunity |
| Contig1 | 61679 | 61963 | + | GENE_00068 | Prodigal: 2.6 | CDS | — | — | — | — | P28599 | groS | — | — | 10 kDa chaperonin |
| Contig1 | 62005 | 63639 | + | GENE_00069 | Prodigal: 2.6 | CDS | — | — | — | — | P28598 | groL | — | — | 60 kDa chaperonin |
| Contig1 | 63872 | 64231 | − | GENE_00070 | Prodigal: 2.6 | CDS | — | — | — | — | — | — | — | — | hypothetical protein |
| Contig1 | 64253 | 66145 | − | GENE_00071 | Prodigal: 2.6 | CDS | 3.1.-.- | — | — | — | O31998 | yokI_1 | — | — | putative ribonuclease YokI |
| Contig1 | 66563 | 67132 | + | GENE_00072 | Prodigal: 2.6 | CDS | — | — | PF01420.13 | — | — | — | — | — | Type I restriction modification DNA specificity domain protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 67153 | 68745 | + | GENE_00073 | Prodigal: 2.6 | CDS | 2.1.1.72 | — | — | — | Q89Z59 | — | — | — | putative type I restriction enzymeP M protein |
| Contig1 | 68735 | 69967 | + | GENE_00074 | Prodigal: 2.6 | CDS | — | PRK09737 | — | — | — | — | — | — | EcoKI restriction-modification system protein HsdS |
| Contig1 | 69989 | 73147 | + | GENE_00075 | Prodigal: 2.6 | CDS | 3.1.21.3 | — | — | — | Q7A801 | hsdR | — | — | Type-1 restriction enzyme R protein |
| Contig1 | 73243 | 75732 | – | GENE_00076 | Prodigal: 2.6 | CDS | — | — | PF07719.11 | — | — | — | — | — | Tetratricopeptide repeat protein |
| Contig1 | 75933 | 76994 | + | GENE_00077 | Prodigal: 2.6 | CDS | 1.1.1.14 | — | — | — | Q06004 | gutB_1 | — | — | Sorbitol dehydrogenase |
| Contig1 | 77068 | 78444 | + | GENE_00078 | Prodigal: 2.6 | CDS | — | — | — | — | P31435 | yicJ | — | — | Inner membrane symporter YicJ |
| Contig1 | 78546 | 79508 | + | GENE_00079 | Prodigal: 2.6 | CDS | 2.7.1.92 | — | — | — | Q9KAG8 | iolC_1 | — | — | 5-dehydro-2-deoxygluconokinase |
| Contig1 | 79742 | 80059 | + | GENE_00080 | Prodigal: 2.6 | CDS | — | — | — | — | — | — | — | — | hypothetical protein |
| Contig1 | 80174 | 80860 | + | GENE_00081 | Prodigal: 2.6 | CDS | — | — | — | — | P54617 | — | — | Phage shock protein A homolog | hypothetical protein |
| Contig1 | 80911 | 81936 | + | GENE_00082 | Prodigal: 2.6 | CDS | — | — | PF08271.6 | — | — | — | — | — | TFHB zinc-binding protein |
| Contig1 | 81936 | 82697 | + | GENE_00083 | Prodigal: 2.6 | CDS | — | — | — | — | — | — | — | — | hypothetical protein |
| Contig1 | 82724 | 83728 | + | GENE_00084 | Prodigal: 2.6 | CDS | — | — | — | — | — | — | — | — | hypothetical protein |
| Contig1 | 83771 | 85702 | + | GENE_00085 | Prodigal: 2.6 | CDS | 2.3.1.- | — | — | — | Q7A3D6 | oatA | — | — | O-acetyltransferase OatA |
| Contig1 | 85974 | 86834 | – | GENE_00086 | Prodigal: 2.6 | CDS | — | — | — | — | O05403 | rsiV | — | — | Anti-sigma-V factor RsiV |
| Contig1 | 86834 | 87331 | – | GENE_00087 | Prodigal: 2.6 | CDS | — | — | — | — | O05404 | sigV_1 | — | — | RNA polymerase sigma factor SigV |
| Contig1 | 87520 | 88560 | – | GENE_00088 | Prodigal: 2.6 | CDS | 1.1.1.14 | — | — | — | Q06004 | gutB_2 | — | — | Sorbitol dehydrogenase |
| Contig1 | 88920 | 89288 | + | GENE_00089 | Prodigal: 2.6 | CDS | — | — | PF03330.12 | — | — | — | — | — | Rare lipoprotein A (RlpA)-like double-psi beta-barrel |
| Contig1 | 89354 | 90400 | + | GENE_00090 | Prodigal: 2.6 | CDS | — | — | — | MF_00671 | — | tolB | — | — | Protein TolB |
| Contig1 | 90431 | 90589 | – | GENE_00091 | Prodigal: 2.6 | CDS | — | — | — | — | — | — | — | — | hypothetical protein |
| Contig1 | 90688 | 90897 | – | GENE_00092 | Prodigal: 2.6 | CDS | — | — | — | — | — | — | — | — | hypothetical protein |
| Contig1 | 91105 | 92643 | – | GENE_00093 | Prodigal: 2.6 | CDS | — | — | PF07726.5 | — | P07788 | cotA | — | — | Spore coat protein A |
| Contig1 | 92753 | 94138 | + | GENE_00094 | Prodigal: 2.6 | CDS | — | — | — | — | P46349 | gabP_1 | — | — | GABA permease |
| Contig1 | 94475 | 95437 | + | GENE_00095 | Prodigal: 2.6 | CDS | — | — | — | — | — | — | — | — | ATPase family associated with various cellular activities (AAA) |
| Contig1 | 95437 | 96606 | + | GENE_00096 | Prodigal: 2.6 | CDS | — | — | — | — | — | — | — | — | hypothetical protein |
| Contig1 | 96625 | 98832 | + | GENE_00097 | Prodigal: 2.6 | CDS | 2.3.2.13 | — | — | — | Q9HZX3 | tgpA | — | — | Protein-glutamine gamma-glutamyltransferase |
| Contig1 | 98987 | 100537 | + | GENE_00098 | Prodigal: 2.6 | CDS | 6.3.5.2 | — | — | — | P99105 | guaA | — | — | GMP synthase [glutamine-hydrolyzing] |
| Contig1 | 100734 | 101501 | – | GENE_00099 | Prodigal: 2.6 | CDS | — | — | — | — | — | — | — | — | hypothetical protein |
| Contig1 | 101831 | 102364 | + | GENE_00100 | Prodigal: 2.6 | CDS | — | — | — | — | O05404 | sigV_2 | — | — | RNA polymerase sigma factor SigV |
| Contig1 | 102346 | 103788 | + | GENE_00101 | Prodigal: 2.6 | CDS | — | — | — | — | — | — | — | — | hypothetical protein |
| Contig1 | 104147 | 105469 | + | GENE_00102 | Prodigal: 2.6 | CDS | — | — | — | — | O34987 | pbuG | — | — | Guanine/hypoxanthine permease PbuG |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 105667 | 106449 | + | GENE_00103 | Prodigal: 2.6 | CDS | — | — | — | — | — | — | — | — | hypothetical protein |
| Contig1 | 106579 | 106761 | + | GENE_00104 | Prodigal: 2.6 | CDS | — | — | — | — | — | — | — | — | hypothetical protein |
| Contig1 | 106883 | 107432 | + | GENE_00105 | Prodigal: 2.6 | CDS | — | — | — | — | — | — | — | — | hypothetical protein |
| Contig1 | 107431 | 107628 | + | GENE_00106 | Prodigal: 2.6 | CDS | — | — | — | — | — | — | — | — | hypothetical protein |
| Contig1 | 107941 | 108429 | + | GENE_00107 | Prodigal: 2.6 | CDS | 5.4.99.18 | — | — | — | Q9WYS7 | purE | — | — | N5-carboxyaminoimidazole ribonucleotide mutase |
| Contig1 | 108383 | 109564 | + | GENE_00108 | Prodigal: 2.6 | CDS | 6.3.4.18 | PRK04164 | — | — | Q7A695 | purK | — | — | N5-carboxyaminoimidazole ribonucleotide synthase |
| Contig1 | 109564 | 110856 | + | GENE_00109 | Prodigal: 2.6 | CDS | 4.3.2.2 | — | — | — | P12047 | purB | — | — | Adenylosuccinate lyase |
| Contig1 | 110932 | 111651 | + | GENE_00110 | Prodigal: 2.6 | CDS | 6.3.2.6 | — | — | — | P12046 | purC | — | — | Phosphoribosyl-aminoimidazole-succinocarboxamide synthase |
| Contig1 | 111651 | 111905 | + | GENE_00111 | Prodigal: 2.6 | CDS | — | — | — | — | — | — | — | — | Phosphoribosylformyl-glycinamidine synthase subunit PurS |
| Contig1 | 111902 | 112585 | + | GENE_00112 | Prodigal: 2.6 | CDS | 6.3.5.3 | PRK05974 | — | — | P99166 | purQ | — | — | Phosphoribosylformyl-glycinamidine synthase 1 |
| Contig1 | 112569 | 114797 | + | GENE_00113 | Prodigal: 2.6 | CDS | 6.3.5.3 | — | — | — | P65901 | purL | — | — | Phosphoribosylformyl-glycinamidine synthase 2 |
| Contig1 | 114773 | 116203 | + | GENE_00114 | Prodigal: 2.6 | CDS | 2.4.2.14 | — | — | — | P00497 | purF | — | — | Amidophosphoribosyl-transferase precursor |
| Contig1 | 116295 | 117335 | + | GENE_00115 | Prodigal: 2.6 | CDS | 6.3.3.1 | — | — | — | Q81ZH0 | purM | — | — | Phosphoribosylformyl-glycinamidine cyclo-ligase |
| Contig1 | 117332 | 117919 | + | GENE_00116 | Prodigal: 2.6 | CDS | 2.1.2.2 | — | — | — | P99162 | purN | — | — | Phosphoribosyl-glycinamide formyltransferase |
| Contig1 | 117916 | 119454 | + | GENE_00117 | Prodigal: 2.6 | CDS | — | — | — | — | P67544 | purH | — | — | Bifunctional purine biosynthesis protein PurH |
| Contig1 | 119468 | 120736 | + | GENE_00118 | Prodigal: 2.6 | CDS | 6.3.4.13 | — | — | — | P12039 | purD | — | — | Phosphoribosylamine-glycine ligase |
| Contig1 | 120873 | 121106 | − | GENE_00119 | Prodigal: 2.6 | CDS | — | — | — | — | — | — | — | — | hypothetical protein |
| Contig1 | 121225 | 122967 | + | GENE_00120 | Prodigal: 2.6 | CDS | 3.5.4.2 | — | — | — | O34909 | yerA | — | — | Putative adenine deaminase YerA |
| Contig1 | 122992 | 123987 | + | GENE_00121 | Prodigal: 2.6 | CDS | — | — | — | — | O34968 | yerB | — | — | Putative lipoprotein YerB precursor |
| Contig1 | 123990 | 124301 | + | GENE_00122 | Prodigal: 2.6 | CDS | — | — | PF01371.13 | — | P39812 | — | — | — | Trp repressor protein |
| Contig1 | 124336 | 125910 | − | GENE_00123 | Prodigal: 2.6 | CDS | 1.4.1.13 | — | — | — | — | gltA_1 | — | — | Glutamate synthase [NADPH] large chain |
| Contig1 | 126106 | 126795 | + | GENE_00124 | Prodigal: 2.6 | CDS | 2.5.1.- | — | — | — | O34790 | pcrB | — | — | Heptaprenylglyceryl phosphate synthase |
| Contig1 | 126853 | 129072 | + | GENE_00125 | Prodigal: 2.6 | CDS | 3.6.4.12 | — | — | — | O34580 | pcrA | — | — | ATP-dependent DNA helicase PcrA |
| Contig1 | 129094 | 131103 | + | GENE_00126 | Prodigal: 2.6 | CDS | 6.5.1.2 | — | — | — | O87703 | ligA | — | — | DNA ligase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 131119 | 132315 | + | GENE_00127 | Prodigal: 2.6 | CDS | — | — | PF07537.5 | — | — | — | — | — | CamS sex pheromone cAM373 precursor |
| Contig1 | 132552 | 133547 | + | GENE_00128 | Prodigal: 2.6 | CDS | 2.7.1.39 | — | — | MF_00301 | — | thrB_1 | — | — | Homoserine kinase |
| Contig1 | 133584 | 134276 | - | GENE_00129 | Prodigal: 2.6 | CDS | — | PRK09977 | — | — | — | — | — | — | putative Mg(2+) transport ATPase |
| Contig1 | 134397 | 135875 | - | GENE_00130 | Prodigal: 2.6 | CDS | — | — | — | — | Q7A4Q7 | putP_1 | — | — | Sodium/proline symporter |
| Contig1 | 136296 | 136586 | + | GENE_00131 | Prodigal: 2.6 | CDS | 6.3.5.- | — | — | — | P68808 | gate | — | — | Aspartyl/glutamyl-tRNA(Asn/Gln) amidotransferase subunit C |
| Contig1 | 136601 | 138058 | + | GENE_00132 | Prodigal: 2.6 | CDS | 6.3.5.- | — | — | — | P63489 | gatA | — | — | Glutamyl-tRNA(Gln) amidotransferase subunit A |
| Contig1 | 138072 | 139502 | + | GENE_00133 | Prodigal: 2.6 | CDS | 6.3.5.- | — | — | — | O30509 | gatB | — | — | Aspartyl/glutamyl-tRNA(Asn/Gln) amidotransferase subunit B |
| Contig1 | 139565 | 140413 | - | GENE_00134 | Prodigal: 2.6 | CDS | — | — | — | — | P0ACS9 | acrR | — | — | HTH-type transcriptional regulator AcrR |
| Contig1 | 140542 | 143685 | + | GENE_00135 | Prodigal: 2.6 | CDS | — | — | — | — | O31501 | swrC | — | — | Swarming motility protein SwrC |
| Contig1 | 143838 | 144749 | + | GENE_00136 | Prodigal: 2.6 | CDS | 2.7.1.107 | — | — | — | O31502 | dagK | — | — | Diacylglycerol kinase |
| Contig1 | 144897 | 146273 | + | GENE_00137 | Prodigal: 2.6 | CDS | 2.1.1.189 | — | — | — | O31503 | rlmCD_1 | — | — | 23S rRNA (uracil-C(5))-methyltransferase RlmCD |
| Contig1 | 147055 | 150009 | + | GENE_00138 | Prodigal: 2.6 | CDS | — | — | — | — | — | — | — | — | hypothetical protein |
| Contig1 | 151010 | 151405 | - | GENE_00139 | Prodigal: 2.6 | CDS | — | — | — | — | — | — | — | — | hypothetical protein |
| Contig1 | 151418 | 151699 | - | GENE_00140 | Prodigal: 2.6 | CDS | — | — | — | — | — | — | — | — | hypothetical protein |
| Contig1 | 151831 | 152130 | - | GENE_00141 | Prodigal: 2.6 | CDS | — | — | — | — | — | — | — | — | hypothetical protein |
| Contig1 | 152313 | 152855 | - | GENE_00142 | Prodigal: 2.6 | CDS | — | — | — | — | — | — | — | — | hypothetical protein |
| Contig1 | 152988 | 153461 | - | GENE_00143 | Prodigal: 2.6 | CDS | — | — | — | — | C0H3X4 | yezG | — | — | putative antitoxin YezG |
| Contig1 | 153466 | 155472 | - | GENE_00144 | Prodigal: 2.6 | CDS | 3.1.-.- | — | — | — | O31506 | yeeF | — | — | Putative ribonuclease YeeF |
| Contig1 | 155771 | 156490 | + | GENE_00145 | Prodigal: 2.6 | CDS | — | — | — | — | P67181 | — | — | — | putative transcriptional regulatory protein |
| Contig1 | 156670 | 156972 | + | GENE_00146 | Prodigal: 2.6 | CDS | — | — | — | — | — | — | — | — | hypothetical protein |
| Contig1 | 157149 | 158018 | + | GENE_00147 | Prodigal: 2.6 | CDS | 2.7.7.- | — | — | — | P17585 | aadK | — | — | Aminoglycoside 6-adenylyltransferase |
| Contig1 | 158152 | 158400 | + | GENE_00148 | Prodigal: 2.6 | CDS | — | — | PF11007.2 | — | — | — | — | — | Spore coat associated protein JA (CotJA) |
| Contig1 | 158384 | 158647 | + | GENE_00149 | Prodigal: 2.6 | CDS | — | — | PF12652.1 | — | — | — | — | — | CotJB protein |
| Contig1 | 158662 | 159231 | + | GENE_00150 | Prodigal: 2.6 | CDS | 1.11.1.6 | — | — | — | P603555 | — | — | — | Manganese catalase |
| Contig1 | 159320 | 159853 | + | GENE_00151 | Prodigal: 2.6 | CDS | — | PRK03624 | — | — | — | — | — | — | putative acetyltransferase |
| Contig1 | 159884 | 160162 | + | GENE_00152 | Prodigal: 2.6 | CDS | — | — | — | — | — | — | — | — | hypothetical protein |
| Contig1 | 160277 | 160966 | + | GENE_00153 | Prodigal: 2.6 | CDS | — | — | — | — | — | — | — | — | hypothetical protein |
| Contig1 | 160999 | 161325 | - | GENE_00154 | Prodigal: 2.6 | CDS | 1.14.99.3 | — | — | — | O31534 | hmoA | — | — | Heme-degrading monooxygenase HmoA |
| Contig1 | 161410 | 161775 | - | GENE_00155 | Prodigal: 2.6 | CDS | — | — | PF12681.1 | — | — | — | — | — | Glyoxalase-like domain protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 161934 | 162800 | + | GENE_00156 | Prodigal: 2.6 | CDS | — | — | — | — | P54504 | rsbRD_1 | — | — | RsbT co-antagonist protein RsbRD |
| Contig1 | 163082 | 164110 | + | GENE_00157 | Prodigal: 2.6 | CDS | — | — | — | — | P0AG78 | sbp | — | — | Sulfate-binding protein precursor |
| Contig1 | 164126 | 164962 | + | GENE_00158 | Prodigal: 2.6 | CDS | — | — | — | — | P27367 | cysT | — | — | Sulfate transport system permease protein CysT |
| Contig1 | 164973 | 165836 | + | GENE_00159 | Prodigal: 2.6 | CDS | — | — | — | — | P27370 | cysW | — | — | Sulfate transport system permease protein CysW |
| Contig1 | 165850 | 166920 | + | GENE_00160 | Prodigal: 2.6 | CDS | 3.6.3.25 | — | — | — | P14788 | cysA | — | — | Sulfate/thiosulfate import ATP-binding protein CysA |
| Contig1 | 167039 | 167212 | + | GENE_00161 | Prodigal: 2.6 | CDS | — | — | — | — | — | — | — | — | hypothetical protein |
| Contig1 | 167242 | 167544 | + | GENE_00162 | Prodigal: 2.6 | CDS | 2.7.1.26 | — | — | — | P94465 | ribR | — | — | RNA-binding riboflavin kinase RibR |
| Contig1 | 167635 | 168279 | — | GENE_00163 | Prodigal: 2.6 | CDS | — | — | — | — | P0AAC4 | ybhL | — | — | Inner membrane protein YbhL |
| Contig1 | 168318 | 168830 | + | GENE_00164 | Prodigal: 2.6 | CDS | — | — | — | — | P0ACR9 | mprA | — | — | Transcriptional repressor MprA |
| Contig1 | 168981 | 170102 | + | GENE_00165 | Prodigal: 2.6 | CDS | 1.14.13.114 | — | — | — | P86491 | — | — | — | 6-hydroxynicotinate 3-monooxygenase precursor |
| Contig1 | 170139 | 171209 | — | GENE_00166 | Prodigal: 2.6 | CDS | — | — | — | — | — | — | — | — | hypothetical protein |
| Contig1 | 171374 | 174556 | + | GENE_00167 | Prodigal: 2.6 | CDS | — | — | — | — | P14779 | — | — | — | Bifunctional P-450/NADPH-P450 reductase |
| Contig1 | 175021 | 175614 | + | GENE_00168 | Prodigal: 2.6 | CDS | — | — | — | — | — | — | — | — | hypothetical protein |
| Contig1 | 175607 | 175918 | + | GENE_00169 | Prodigal: 2.6 | CDS | — | — | PF12840.1 | — | — | — | — | — | Helix-turn-helix domain protein |
| Contig1 | 175919 | 176809 | + | GENE_00170 | Prodigal: 2.6 | CDS | 3.6.3.- | — | — | — | P32010 | drrA_1 | — | — | Daunorubicin/doxorubicin resistance ATP-binding protein DrrA |
| Contig1 | 176824 | 177564 | + | GENE_00171 | Prodigal: 2.6 | CDS | — | — | — | — | P0AFP9 | ybhR_1 | — | — | Inner membrane transport permease YbhR |
| Contig1 | 177621 | 177761 | + | GENE_00172 | Prodigal: 2.6 | CDS | — | — | — | — | — | — | — | — | hypothetical protein |
| Contig1 | 178340 | 180268 | + | GENE_00173 | Prodigal: 2.6 | CDS | — | — | — | — | Q797B3 | ltaS1 | — | — | Lipoteichoic acid synthase 1 |
| Contig1 | 180484 | 181248 | + | GENE_00174 | Prodigal: 2.6 | CDS | 2.7.7.33 | — | — | — | Q8Z5I4 | rfbF | — | — | Glucose-1-phosphate cytidylyltransferase |
| Contig1 | 181321 | 182223 | + | GENE_00175 | Prodigal: 2.6 | CDS | 4.2.1.45 | — | — | — | P26397 | rfbG | — | — | CDP-glucose 4,6-dehydratase |
| Contig1 | 182248 | 183159 | + | GENE_00176 | Prodigal: 2.6 | CDS | — | — | PF03407.10 | — | — | — | — | — | Nucleotide-diphospho-sugar transferase |
| Contig1 | 183188 | 184348 | + | GENE_00177 | Prodigal: 2.6 | CDS | 2.4.1.212 | — | — | — | Q7BLV3 | hyaD | — | — | Hyaluronan synthase |
| Contig1 | 184361 | 185302 | + | GENE_00178 | Prodigal: 2.6 | CDS | — | — | — | — | — | — | — | — | hypothetical protein |
| Contig1 | 185331 | 186560 | — | GENE_00179 | Prodigal: 2.6 | CDS | — | — | — | — | P52067 | fsr | — | — | Fosmidomycin resistance protein |
| Contig1 | 186678 | 188063 | — | GENE_00180 | Prodigal: 2.6 | CDS | — | — | — | — | O07576 | yhdG_1 | — | — | putative amino acid permease YhdG |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 188308 | 189765 | + | GENE_00181 | Prodigal: 2.6 | CDS | 1.2.1.3 | — | — | — | O06478 | yfmT | — | — | Putative aldehyde dehydrogenase YfmT |
| Contig1 | 189781 | 190635 | + | GENE_00182 | Prodigal: 2.6 | CDS | — | — | — | — | O06477 | yfmS | — | — | Putative sensory transducer protein YfmS |
| Contig1 | 190766 | 191665 | + | GENE_00183 | Prodigal: 2.6 | CDS | 1.-.-.- | — | — | — | P0AG84 | yghA | — | — | putative oxidoreductase YghA |
| Contig1 | 191713 | 192780 | − | GENE_00184 | Prodigal: 2.6 | CDS | 2.4.1.- | — | — | — | O31986 | sunS_1 | — | — | SPBc2 prophage-derived glycosyltransferase SunS |
| Contig1 | 192939 | 194828 | + | GENE_00185 | Prodigal: 2.6 | CDS | — | — | — | — | P43672 | uup | — | — | ABC transporter ATP-binding protein uup |
| Contig1 | 195017 | 195439 | + | GENE_00186 | Prodigal: 2.6 | CDS | — | — | — | — | O06474 | yfmP | — | — | HTH-type transcriptional regulator YfmP |
| Contig1 | 195503 | 196687 | + | GENE_00187 | Prodigal: 2.6 | CDS | — | — | — | — | O06473 | yfmO | — | — | Multidrug efflux protein YfmO |
| Contig1 | 196731 | 198287 | − | GENE_00188 | Prodigal: 2.6 | CDS | — | — | — | — | P63389 | yheS_3 | — | — | putative ABC transporter ATP-binding protein YheS |
| Contig1 | 198459 | 199589 | + | GENE_00189 | Prodigal: 2.6 | CDS | 3.6.4.13 | — | — | — | P54475 | cshB_1 | — | — | DEAD-box ATP-dependent RNA helicase CshB |
| Contig1 | 199663 | 200109 | + | GENE_00190 | Prodigal: 2.6 | CDS | — | — | PF00583.18 | — | — | — | — | — | Acetyltransferase (GNAT) family protein |
| Contig1 | 200160 | 201179 | − | GENE_00191 | Prodigal: 2.6 | CDS | 1.-.-.- | — | — | — | O34812 | yfmj | — | — | Putative NADP-dependent oxidoreductase YfmJ |
| Contig1 | 201308 | 201679 | − | GENE_00192 | Prodigal: 2.6 | CDS | — | — | — | — | — | — | — | — | hypothetical protein |
| Contig1 | 201849 | 202196 | + | GENE_00193 | Prodigal: 2.6 | CDS | — | — | — | — | P80241 | yflT | — | — | General stress protein 17M |
| Contig1 | 202360 | 203625 | + | GENE_00194 | Prodigal: 2.6 | CDS | 4.2.2.2 | — | — | — | P39116 | pel | — | — | Pectate lyase precursor |
| Contig1 | 203750 | 205186 | + | GENE_00195 | Prodigal: 2.6 | CDS | — | — | — | — | O34726 | yflS | — | — | Putative malate transporter YflS |
| Contig1 | 205251 | 205991 | + | GENE_00196 | Prodigal: 2.6 | CDS | — | — | PF01391.12 | — | — | — | — | — | Collagen triple helix repeat (20 copies) |
| Contig1 | 206444 | 211927 | − | GENE_00197 | Prodigal: 2.6 | CDS | — | — | — | — | — | — | — | — | hypothetical protein |
| Contig1 | 212093 | 212272 | − | GENE_00198 | Prodigal: 2.6 | CDS | — | — | — | — | — | — | — | — | hypothetical protein |
| Contig1 | 212536 | 212685 | − | GENE_00199 | Prodigal: 2.6 | CDS | — | — | — | — | — | — | — | — | hypothetical protein |
| Contig1 | 212678 | 214927 | − | GENE_00200 | Prodigal: 2.6 | CDS | — | — | — | — | — | — | — | — | hypothetical protein |
| Contig1 | 214931 | 215116 | − | GENE_00201 | Prodigal: 2.6 | CDS | — | — | — | — | — | — | — | — | hypothetical protein |
| Contig1 | 215132 | 215323 | − | GENE_00202 | Prodigal: 2.6 | CDS | — | — | — | — | — | — | — | — | hypothetical protein |
| Contig1 | 215619 | 217223 | + | GENE_00203 | Prodigal: 2.6 | CDS | 2.7.13.3 | — | — | — | O34427 | citS | — | — | Sensor protein CitS |
| Contig1 | 217220 | 217900 | + | GENE_00204 | Prodigal: 2.6 | CDS | — | — | — | — | O34534 | citT | — | — | Transcriptional regulatory protein CitT |
| Contig1 | 217913 | 218875 | + | GENE_00205 | Prodigal: 2.6 | CDS | — | — | PF03401.8 | — | — | — | — | — | Tripartite tricarboxylate transporter family receptor |
| Contig1 | 219068 | 220366 | + | GENE_00206 | Prodigal: 2.6 | CDS | — | — | — | — | P55069 | citM | — | — | Mg(2+)citrate complex secondary transporter |
| Contig1 | 220418 | 221212 | + | GENE_00207 | Prodigal: 2.6 | CDS | 3.-.-.- | — | — | — | O34409 | yflN_1 | — | — | putative metallo-hydrolase YflN |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 221336 | 222427 | + | GENE_00208 | Prodigal: 2.6 | CDS | 1.14.13.165 | — | — | — | O34453 | nos | — | — | Nitric oxide synthase oxygenase |
| Contig1 | 222421 | 222693 | — | GENE_00209 | Prodigal: 2.6 | CDS | 3.6.1.7 | PRK11536 | — | — | O35031 | acyP | — | — | Acylphosphatase |
| Contig1 | 222761 | 223420 | + | GENE_00210 | Prodigal: 2.6 | CDS | — | — | — | — | — | — | — | — | 6-N-hydroxylaminopurine resistance protein |
| Contig1 | 223461 | 223595 | — | GENE_00211 | Prodigal: 2.6 | CDS | — | — | — | — | — | — | — | — | hypothetical protein |
| Contig1 | 223775 | 223930 | — | GENE_00212 | Prodigal: 2.6 | CDS | — | — | — | — | — | — | — | — | hypothetical protein |
| Contig1 | 224013 | 224324 | — | GENE_00213 | Prodigal: 2.6 | CDS | — | — | — | — | — | — | — | — | hypothetical protein |
| Contig1 | 224381 | 225130 | — | GENE_00214 | Prodigal: 2.6 | CDS | 3.4.11.18 | — | — | — | O34484 | mapB | — | — | Methionine aminopeptidase 2 |
| Contig1 | 225295 | 226677 | + | GENE_00215 | Prodigal: 2.6 | CDS | — | — | — | — | P69786 | ptsG_1 | — | — | PTS system glucose-specific EIICB component |
| Contig1 | 226803 | 227246 | + | GENE_00216 | Prodigal: 2.6 | CDS | — | — | PF10787.3 | — | — | — | — | — | putative protein from bacillus cereus group |
| Contig1 | 227287 | 229224 | — | GENE_00217 | Prodigal: 2.6 | CDS | — | — | — | — | O34952 | ltaS2_1 | — | — | Lipoteichoic acid synthase 2 |
| Contig1 | 229470 | 229847 | + | GENE_00218 | Prodigal: 2.6 | CDS | — | PRK10203 | — | — | — | — | — | — | hypothetical protein |
| Contig1 | 229857 | 230288 | — | GENE_00219 | Prodigal: 2.6 | CDS | — | — | — | — | P96698 | cotP_1 | — | — | Spore coat protein P |
| Contig1 | 230304 | 230546 | — | GENE_00220 | Prodigal: 2.6 | CDS | — | — | PF10676.3 | — | — | — | — | — | Spore germination protein gerPA/gerPF |
| Contig1 | 230561 | 230821 | — | GENE_00221 | Prodigal: 2.6 | CDS | — | — | PF10676.3 | — | — | — | — | — | Spore germination protein gerPA/gerPF |
| Contig1 | 231094 | 232509 | + | GENE_00222 | Prodigal: 2.6 | CDS | — | — | — | — | — | — | — | — | PTS system trehalose-specific EIIBC component |
| Contig1 | 232585 | 234270 | + | GENE_00223 | Prodigal: 2.6 | CDS | 3.2.1.93 | — | — | — | P36672 | treB | — | — | Trehalose-6-phosphate hydrolase |
| Contig1 | 234294 | 235010 | + | GENE_00224 | Prodigal: 2.6 | CDS | — | — | — | — | P39795 | treA | — | — | Trehalose operon transcriptional repressor |
| Contig1 | 235144 | 235809 | + | GENE_00225 | Prodigal: 2.6 | CDS | 1.-.-.- | — | — | — | P39796 | treR | — | — | Putative NAD(P)H nitroreductase YfkO |
| Contig1 | 235845 | 236606 | — | GENE_00226 | Prodigal: 2.6 | CDS | — | — | PF07907.5 | — | O34475 | yfkO | — | — | YibE/F-like protein |
| Contig1 | 236603 | 237742 | — | GENE_00227 | Prodigal: 2.6 | CDS | — | — | PF07907.5 | — | — | — | — | — | YibE/F-like protein |
| Contig1 | 237953 | 242245 | — | GENE_00228 | Prodigal: 2.6 | CDS | — | — | — | — | O34313 | yfkN | — | — | Trifunctional nucleotide phosphoesterase protein YfkN precursor |
| Contig1 | 242466 | 242981 | + | GENE_00229 | Prodigal: 2.6 | CDS | 3.2.-.- | — | — | — | P80876 | yfkM | — | — | General stress protein 18 |
| Contig1 | 243002 | 244033 | — | GENE_00230 | Prodigal: 2.6 | CDS | — | — | — | — | P46828 | ccpA_1 | — | — | Catabolite control protein A |
| Contig1 | 244170 | 245054 | — | GENE_00231 | Prodigal: 2.6 | CDS | 1.1.1.25 | — | — | — | Q8Y9N5 | aroE_1 | — | — | Shikimate dehydrogenase |
| Contig1 | 245119 | 245880 | — | GENE_00232 | Prodigal: 2.6 | CDS | 4.2.1.10 | — | — | — | P24670 | aroD | — | — | 3-dehydroquinate dehydratase |
| Contig1 | 245907 | 247100 | — | GENE_00233 | Prodigal: 2.6 | CDS | — | — | — | — | P76197 | ydiM | — | — | Inner membrane transport protein YdiM |
| Contig1 | 247436 | 247651 | — | GENE_00234 | Prodigal: 2.6 | CDS | — | — | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 247807 | 248280 | + | GENE_00235 | Prodigal: 2.6 | CDS | 3.1.3.48 | — | — | — | O35016 | yfkJ | — | — | Low molecular weight protein-tyrosine-phosphatase YfkJ |
| Contig1 | 248294 | 248620 | + | GENE_00236 | Prodigal: 2.6 | CDS | — | — | — | — | — | — | — | — | hypothetical protein |
| Contig1 | 248632 | 249471 | + | GENE_00237 | Prodigal: 2.6 | CDS | — | PRK01637 | — | — | — | — | — | — | hypothetical protein |
| Contig1 | 249515 | 249622 | + | GENE_00238 | Prodigal: 2.6 | CDS | — | — | — | — | — | — | — | — | hypothetical protein |
| Contig1 | 249657 | 250835 | − | GENE_00239 | Prodigal: 2.6 | CDS | — | — | — | — | P21503 | ycaD | — | — | putative MFS-type transporter YcaD |
| Contig1 | 250994 | 252049 | + | GENE_00240 | Prodigal: 2.6 | CDS | — | — | — | — | O34840 | yfkE | — | — | Putative cation exchanger YfkE |
| Contig1 | 252123 | 252914 | + | GENE_00241 | Prodigal: 2.6 | CDS | — | — | — | — | — | — | — | — | hypothetical protein |
| Contig1 | 252942 | 253775 | − | GENE_00242 | Prodigal: 2.6 | CDS | — | — | — | — | O35043 | yfkC | — | — | putative MscS family protein YfkC |
| Contig1 | 253782 | 254903 | − | GENE_00243 | Prodigal: 2.6 | CDS | 4.3.99.3 | — | — | MF_00917 | — | queE_1 | — | — | 7-carboxy-7-deazaguanine synthase |
| Contig1 | 255050 | 255235 | + | GENE_00244 | Prodigal: 2.6 | CDS | — | — | — | — | — | — | — | — | hypothetical protein |
| Contig1 | 255336 | 256127 | + | GENE_00245 | Prodigal: 2.6 | CDS | 3.5.1.- | — | — | — | O34928 | pdaA_1 | — | — | Peptidoglycan-N-acetylmuramic acid deacetylase PdaA precursor |
| Contig1 | 256162 | 257022 | − | GENE_00246 | Prodigal: 2.6 | CDS | 1.1.1.60 | — | — | — | P0ABQ2 | garR_1 | — | — | 2-hydroxy-3-oxopropionate reductase |
| Contig1 | 257073 | 257720 | − | GENE_00247 | Prodigal: 2.6 | CDS | — | — | — | — | — | — | — | — | hypothetical protein |
| Contig1 | 257784 | 258743 | − | GENE_00248 | Prodigal: 2.6 | CDS | — | — | — | — | Q9WZ31 | corA_1 | — | — | Magnesium transport protein CorA |
| Contig1 | 258850 | 259713 | + | GENE_00249 | Prodigal: 2.6 | CDS | 3.2.2.21 | — | — | — | P37878 | alkA | — | — | DNA-3-methyladenine glycosylase |
| Contig1 | 259858 | 261258 | + | GENE_00250 | Prodigal: 2.6 | CDS | 2.1.1.189 | — | — | — | O31503 | rlmCD_2 | — | — | 23S rRNA (uracil-C(5))-methyltransferase RlmCD |
| Contig1 | 263169 | 264152 | + | GENE_00251 | Prodigal: 2.6 | CDS | 1.-.-.- | — | — | — | P67717 | dus | — | — | putative tRNA-dihydrouridine synthase |
| Contig1 | 264310 | 264789 | + | GENE_00252 | Prodigal: 2.6 | CDS | — | — | — | — | — | — | — | — | hypothetical protein |
| Contig1 | 265064 | 266065 | + | GENE_00253 | Prodigal: 2.6 | CDS | 1.1.1.- | — | — | — | O31404 | acoA | — | — | Acetoin:2,6-dichlorophenol-indophenol oxidoreductase subunit alpha |
| Contig1 | 266067 | 267095 | + | GENE_00254 | Prodigal: 2.6 | CDS | 1.1.1.- | — | — | — | P27746 | acoB | — | — | Acetoin:2,6-dichlorophenol-indophenol oxidoreductase subunit beta |
| Contig1 | 267110 | 268303 | + | GENE_00255 | Prodigal: 2.6 | CDS | 2.3.1.12 | — | — | — | P65636 | pdhC_1 | — | — | Dihydrolipoyllysine-residue acetyltransferase component of pyruvate dehydrogenase complex |
| Contig1 | 268318 | 269697 | + | GENE_00256 | Prodigal: 2.6 | CDS | 1.8.1.4 | — | — | — | P11959 | pdhD_1 | — | — | Dihydrolipoyl dehydrogenase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 269804 | 271612 | + | GENE_00257 | Prodigal: 2.6 | CDS | — | — | — | — | O31551 | acoR | — | — | Acetoin dehydrogenase operon transcriptional activator AcoR |
| Contig1 | 271678 | 271860 | + | GENE_00258 | Prodigal: 2.6 | CDS | — | — | — | — | O31552 | sspH | — | — | Small, acid-soluble spore protein H |
| Contig1 | 272031 | 273380 | + | GENE_00259 | Prodigal: 2.6 | CDS | 3.2.1.122 | — | — | — | P54716 | glvA | — | — | Maltose-6′-phosphate glucosidase |
| Contig1 | 273449 | 274210 | + | GENE_00260 | Prodigal: 2.6 | CDS | — | — | — | — | P54717 | glvR | — | — | HTH-type transcriptional regulator GlvR |
| Contig1 | 274227 | 275813 | + | GENE_00261 | Prodigal: 2.6 | CDS | — | — | — | — | P54715 | malP | — | — | PTS system maltose-specific EIICB component |
| Contig1 | 276002 | 278326 | + | GENE_00262 | Prodigal: 2.6 | CDS | 5.1.3.- | — | — | — | Q44492 | algE5 | — | — | Poly(beta-D-mannuronate) C5 epimerase 5 |
| Contig1 | 278624 | 280357 | + | GENE_00263 | Prodigal: 2.6 | CDS | 3.6.3.- | — | — | — | Q99T13 | — | — | — | Putative multidrug export ATP-binding/permease protein |
| Contig1 | 280338 | 282155 | + | GENE_00264 | Prodigal: 2.6 | CDS | — | — | — | — | Q9WYC4 | — | — | — | putative ABC transporter ATP-binding protein |
| Contig1 | 282322 | 282726 | + | GENE_00265 | Prodigal: 2.6 | CDS | 1.-.-.- | — | — | — | P54720 | catD | — | — | Putative oxidoreductase CatD |
| Contig1 | 282743 | 283600 | + | GENE_00266 | Prodigal: 2.6 | CDS | 1.13.11.2 | — | — | — | P54721 | catE | — | — | Catechol-2,3-dioxygenase |
| Contig1 | 283991 | 284938 | + | GENE_00267 | Prodigal: 2.6 | CDS | 2.5.1.- | — | — | — | O31652 | ctaB1 | — | — | Protoheme IX farnesyltransferase 1 |
| Contig1 | 284976 | 285527 | - | GENE_00268 | Prodigal: 2.6 | CDS | — | — | PF03551.8 | — | — | — | — | — | Transcriptional regulator PadR-like family protein |
| Contig1 | 285761 | 286363 | + | GENE_00269 | Prodigal: 2.6 | CDS | — | — | — | MF_01216 | — | azoR | — | — | FMN-dependent NADH-azoreductase |
| Contig1 | 286354 | 287442 | + | GENE_00270 | Prodigal: 2.6 | CDS | — | — | — | — | Q5HKP7 | icaC | — | — | putative poly-beta-1,6-N-acetyl-D-glucosamine export protein |
| Contig1 | 287299 | 287580 | - | GENE_00271 | Prodigal: 2.6 | CDS | — | — | — | — | — | — | — | — | hypothetical protein |
| Contig1 | 287699 | 290110 | + | GENE_00272 | Prodigal: 2.6 | CDS | — | — | — | — | Q0VZ70 | cmdD_1 | — | — | Chondramide synthase cmdD |
| Contig1 | 290133 | 290405 | + | GENE_00273 | Prodigal: 2.6 | CDS | — | — | — | — | P11540 | — | — | — | Barstar |
| Contig1 | 290431 | 290973 | + | GENE_00274 | Prodigal: 2.6 | CDS | 3.-.-.- | — | — | — | O31562 | yfiT | — | — | Putative metal-dependent hydrolase YfiT |
| Contig1 | 290933 | 292525 | - | GENE_00275 | Prodigal: 2.6 | CDS | — | — | — | — | P96712 | bmr3_1 | — | — | Multidrug resistance protein 3 |
| Contig1 | 292634 | 293116 | - | GENE_00276 | Prodigal: 2.6 | CDS | — | — | — | — | O34777 | ohrR_1 | — | — | Organic hydroperoxide resistance transcriptional regulator |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 293285 | 295855 | + | GENE_00277 | Prodigal: 2.6 | CDS | 2.3.2.3 | — | — | — | C0H3X7 | mprF | — | — | Phosphatidylglycerol lysyltransferase |
| Contig1 | 295948 | 296832 | + | GENE_00278 | Prodigal: 2.6 | CDS | 5.1.-.- | — | — | — | P37757 | yddE | — | — | putative isomerase YddE |
| Contig1 | 296909 | 297493 | + | GENE_00279 | Prodigal: 2.6 | CDS | 1.-.-.- | — | — | — | P0ACY1 | ydjA | — | — | Putative NAD(P)H nitroreductase YdjA |
| Contig1 | 297532 | 297723 | − | GENE_00280 | Prodigal: 2.6 | CDS | — | — | — | — | — | — | — | — | hypothetical protein |
| Contig1 | 297794 | 297904 | − | GENE_00281 | Prodigal: 2.6 | CDS | — | — | — | — | — | — | — | — | hypothetical protein |
| Contig1 | 297962 | 298861 | − | GENE_00282 | Prodigal: 2.6 | CDS | — | — | — | — | Q7A6Q5 | — | — | — | Epimerase family protein |
| Contig1 | 298952 | 299743 | + | GENE_00283 | Prodigal: 2.6 | CDS | — | — | — | — | P66003 | recX | — | — | Regulatory protein RecX |
| Contig1 | 299750 | 300061 | + | GENE_00284 | Prodigal: 2.6 | CDS | — | — | — | — | — | — | — | — | hypothetical protein |
| Contig1 | 300202 | 301401 | + | GENE_00285 | Prodigal: 2.6 | CDS | — | — | — | — | P77389 | ydhP_1 | — | — | Inner membrane transport protein YdhP |
| Contig1 | 301441 | 301830 | − | GENE_00286 | Prodigal: 2.6 | CDS | — | — | — | — | — | — | — | — | hypothetical protein |
| Contig1 | 301793 | 302704 | − | GENE_00287 | Prodigal: 2.6 | CDS | 3.4.21.- | — | — | — | P39790 | mpr | — | — | Extracellular metalloprotease precursor |
| Contig1 | 303126 | 303395 | + | GENE_00288 | Prodigal: 2.6 | CDS | — | — | — | — | — | — | — | — | hypothetical protein |
| Contig1 | 303527 | 304054 | + | GENE_00289 | Prodigal: 2.6 | CDS | — | — | — | — | P96729 | ywsB_1 | — | — | Cell wall-binding protein YwsB precursor |
| Contig1 | 304140 | 304475 | + | GENE_00290 | Prodigal: 2.6 | CDS | — | — | — | — | — | — | — | — | hypothetical protein |
| Contig1 | 304468 | 305328 | + | GENE_00291 | Prodigal: 2.6 | CDS | 3.3.2.10 | — | — | — | O52866 | — | — | — | Soluble epoxide hydrolase |
| Contig1 | 305539 | 306519 | + | GENE_00292 | Prodigal: 2.6 | CDS | 2.4.-.- | — | — | — | Q45539 | csbB | — | — | Putative glycosyltransferase CsbB |
| Contig1 | 306556 | 309141 | + | GENE_00293 | Prodigal: 2.6 | CDS | — | — | PF09586 | — | — | — | — | — | Bacterial membrane protein YfhO |
| Contig1 | 309138 | 310121 | + | GENE_00294 | Prodigal: 2.6 | CDS | — | — | — | — | — | — | — | — | hypothetical protein |
| Contig1 | 310347 | 311441 | + | GENE_00295 | Prodigal: 2.6 | CDS | 3.2.2. | — | — | — | O31584 | yfhQ | — | — | putative A/G-specific adenine glycosylase YfhQ |
| Contig1 | 311448 | 311672 | − | GENE_00296 | Prodigal: 2.6 | CDS | — | — | — | — | — | — | — | — | hypothetical protein |
| Contig1 | 311754 | 312506 | + | GENE_00297 | Prodigal: 2.6 | CDS | 1.3.1.104 | — | PF04632.6 | — | P71079 | fabL | — | — | Enoyl-[acyl-carrier-protein] reductase [NADPH] FabL |
| Contig1 | 312572 | 312742 | + | GENE_00298 | Prodigal: 2.6 | CDS | — | — | — | — | P84585 | — | — | — | Small, acid-soluble spore protein gamma-type |
| Contig1 | 312903 | 313169 | + | GENE_00299 | Prodigal: 2.6 | CDS | — | — | — | — | — | — | — | — | hypothetical protein |
| Contig1 | 313305 | 313835 | + | GENE_00300 | Prodigal: 2.6 | CDS | — | — | — | — | — | — | — | — | hypothetical protein |
| Contig1 | 313917 | 315659 | + | GENE_00301 | Prodigal: 2.6 | CDS | 3.6.3.- | — | — | — | Q99T13 | — | — | — | Putative multidrug export ATP-binding/permease protein |
| Contig1 | 315739 | 316803 | − | GENE_00302 | Prodigal: 2.6 | CDS | — | — | — | — | — | — | — | — | Fusaric acid resistance protein family protein |
| Contig1 | 317013 | 318302 | − | GENE_00303 | Prodigal: 2.6 | CDS | 5.4.3.8 | — | — | — | Q81YV0 | hemL1 | — | — | Glutamate-1-semialdehyde 2,1-aminomutase 1 |
| Contig1 | 318460 | 318933 | + | GENE_00304 | Prodigal: 2.6 | CDS | 1.11.1.15 | — | — | — | Q83CY8 | bcp | — | — | Putative peroxiredoxin bcp |
| Contig1 | 319058 | 319495 | + | GENE_00305 | Prodigal: 2.6 | CDS | — | — | — | — | P71086 | perR | — | — | Peroxide operon regulator |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 319530 | 319883 | − | GENE_00306 | Prodigal: 2.6 | CDS | — | PRK02935 | — | — | — | — | — | — | hypothetical protein |
| Contig1 | 320086 | 320970 | + | GENE_00307 | Prodigal: 2.6 | CDS | — | — | — | — | — | — | — | — | hypothetical protein |
| Contig1 | 321265 | 322812 | + | GENE_00308 | — | rRNA | — | — | — | — | — | — | — | — | 16S ribosomal RNA |
| Contig1 | 322990 | 325915 | + | GENE_00309 | — | rRNA | — | — | — | — | — | — | — | — | 23S ribosomal RNA |
| Contig1 | 326021 | 326131 | + | GENE_00310 | — | rRNA | — | — | — | — | — | — | — | — | 5S ribosomal RNA |
| Contig1 | 326144 | 326218 | + | GENE_00311 | Aragorn: 1.2 | tRNA | — | — | — | — | — | — | — | — | tRNA-Asn(gtt) |
| Contig1 | 326224 | 326314 | + | GENE_00312 | Aragorn: 1.2 | tRNA | — | — | — | — | — | — | — | — | tRNA-Ser(gga) |
| Contig1 | 326351 | 326423 | + | GENE_00313 | Aragorn: 1.2 | tRNA | — | — | — | — | — | — | — | — | tRNA-Glu(ttc) |
| Contig1 | 326433 | 326508 | + | GENE_00314 | Aragorn: 1.2 | tRNA | — | — | — | — | — | — | — | — | tRNA-Val(tac) |
| Contig1 | 326516 | 326592 | + | GENE_00315 | Aragorn: 1.2 | tRNA | — | — | — | — | — | — | — | — | tRNA-Met(cat) |
| Contig1 | 326601 | 326677 | + | GENE_00316 | Aragorn: 1.2 | tRNA | — | — | — | — | — | — | — | — | tRNA-Asp(gtc) |
| Contig1 | 326688 | 326763 | + | GENE_00317 | Aragorn: 1.2 | tRNA | — | — | — | — | — | — | — | — | tRNA-Phe(gaa) |
| Contig1 | 326767 | 326840 | + | GENE_00318 | Aragorn: 1.2 | tRNA | — | — | — | — | — | — | — | — | tRNA-Thr(tgt) |
| Contig1 | 326851 | 326935 | + | GENE_00319 | Aragorn: 1.2 | tRNA | — | — | — | — | — | — | — | — | tRNA-Tyr(gta) |
| Contig1 | 326946 | 327019 | + | GENE_00320 | Aragorn: 1.2 | tRNA | — | — | — | — | — | — | — | — | tRNA-Trp(cca) |
| Contig1 | 327049 | 327124 | + | GENE_00321 | Aragorn: 1.2 | tRNA | — | — | — | — | — | — | — | — | tRNA-His(gtg) |
| Contig1 | 327133 | 327206 | + | GENE_00322 | Aragorn: 1.2 | tRNA | — | — | — | — | — | — | — | — | tRNA-Gln(ttg) |
| Contig1 | 327259 | 327333 | + | GENE_00323 | Aragorn: 1.2 | tRNA | — | — | — | — | — | — | — | — | tRNA-Gly(gcc) |
| Contig1 | 327339 | 327409 | + | GENE_00324 | Aragorn: 1.2 | tRNA | — | — | — | — | — | — | — | — | tRNA-Cys(gca) |
| Contig1 | 327417 | 327505 | + | GENE_00325 | Aragorn: 1.2 | tRNA | — | — | — | — | — | — | — | — | tRNA-Leu(taa) |
| Contig1 | 327752 | 327835 | + | GENE_00326 | Aragorn: 1.2 | tRNA | — | — | — | — | — | — | — | — | tRNA-Leu(caa) |
| Contig1 | 328053 | 328574 | + | GENE_00327 | Prodigal: 2.6 | CDS | — | — | PF03553.8 | — | — | — | — | — | Na+/H+ antiporter family protein |
| Contig1 | 328648 | 329346 | + | GENE_00328 | Prodigal: 2.6 | CDS | 3.4.21.- | — | — | — | P58495 | — | — | — | putative peptidase |
| Contig1 | 329627 | 331399 | + | GENE_00329 | Prodigal: 2.6 | CDS | 4.1.99.17 | — | — | — | P45740 | thiC | — | — | Phosphomethyl-pyrimidine synthase |
| Contig1 | 331440 | 332795 | − | GENE_00330 | Prodigal: 2.6 | CDS | 1.21.-.- | — | — | — | O06997 | yvdP_1 | — | — | putative FAD-linked oxidoreductase YvdP |
| Contig1 | 333050 | 333229 | + | GENE_00331 | Prodigal: 2.6 | CDS | — | — | — | — | — | — | — | — | hypothetical protein |
| Contig1 | 333232 | 334953 | + | GENE_00332 | Prodigal: 2.6 | CDS | — | — | — | — | P42061 | appA_1 | — | — | Oligopeptide-binding protein AppA precursor |
| Contig1 | 335022 | 335978 | + | GENE_00333 | Prodigal: 2.6 | CDS | — | — | — | — | P0AEF8 | dppB_1 | — | — | Dipeptide transport system permease protein DppB |
| Contig1 | 335991 | 336896 | + | GENE_00334 | Prodigal: 2.6 | CDS | — | — | — | — | P75799 | gsiD | — | — | Glutathione transport system permease protein GsiD |
| Contig1 | 336893 | 337879 | + | GENE_00335 | Prodigal: 2.6 | CDS | — | — | — | — | P24136 | oppD_1 | — | — | Oligopeptide transport ATP-binding protein OppD |
| Contig1 | 337872 | 338231 | + | GENE_00336 | Prodigal: 2.6 | CDS | — | — | — | — | P24137 | oppF_1 | — | — | Oligopeptide-binding ATP-binding protein OppF |
| Contig1 | 338228 | 338836 | + | GENE_00337 | Prodigal: 2.6 | CDS | — | — | — | — | P24137 | oppF_2 | — | — | Oligopeptide transport ATP-binding protein OppF |
| Contig1 | 338909 | 340354 | − | GENE_00338 | Prodigal: 2.6 | CDS | 1.11.1.6 | — | — | — | P26901 | katA_1 | — | — | Vegetative catalase |
| Contig1 | 340611 | 341546 | + | GENE_00339 | Prodigal: 2.6 | CDS | — | — | PF04909.8 | — | — | — | — | — | Amidohydrolase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 341770 | 342537 | + | GENE_00340 | Prodigal: 2.6 | CDS | 3.6.3.- | — | — | — | P97027 | ssuB_1 | — | — | Aliphatic sulfonates import ATP-binding protein SsuB |
| Contig1 | 342553 | 343542 | + | GENE_00341 | Prodigal: 2.6 | CDS | — | — | — | — | P40400 | ssuA | — | — | Putative aliphatic sulfonates-binding protein precursor |
| Contig1 | 343542 | 344375 | + | GENE_00342 | Prodigal: 2.6 | CDS | — | — | — | — | P40401 | ssuC_1 | — | — | Putative aliphatic sulfonates transport permease protein SsuC |
| Contig1 | 344400 | 345536 | + | GENE_00343 | Prodigal: 2.6 | CDS | 1.14.14.5 | — | — | — | P40402 | ssuD | — | — | Alkanesulfonate monooxygenase |
| Contig1 | 345711 | 345980 | + | GENE_00344 | Prodigal: 2.6 | CDS | — | — | — | — | O31587 | rpsN2 | — | — | Alternate 30S ribosomal protein S14 |
| Contig1 | 346001 | 346468 | − | GENE_00345 | Prodigal: 2.6 | CDS | — | — | — | — | — | — | — | — | hypothetical protein |
| Contig1 | 346465 | 346671 | − | GENE_00346 | Prodigal: 2.6 | CDS | — | — | PF01381.16 | — | — | — | — | — | Helix-turn-helix |
| Contig1 | 346857 | 346930 | + | GENE_00347 | Aragorn: 1.2 | tRNA | — | — | — | — | — | — | — | — | tRNA-Gly(tcc) |
| Contig1 | 347020 | 347643 | + | GENE_00348 | Prodigal: 2.6 | CDS | — | — | — | — | — | — | — | — | hypothetical protein |
| Contig1 | 347728 | 348888 | + | GENE_00349 | Prodigal: 2.6 | CDS | 1.1.-.- | — | — | — | P97030 | queG | — | — | Epoxyqueuosine reductase |
| Contig1 | 348963 | 349874 | + | GENE_00350 | Prodigal: 2.6 | CDS | — | — | PF12671.1 | — | — | — | — | — | Putative amidase domain protein |
| Contig1 | 349920 | 350393 | + | GENE_00351 | Prodigal: 2.6 | CDS | 2.1.1.207 | — | — | — | P44868 | trmL | — | — | tRNA (cytidine(34)-2'-O)-methyltransferase |
| Contig1 | 350530 | 351162 | + | GENE_00352 | Prodigal: 2.6 | CDS | — | — | PF04519.7 | — | — | — | — | — | Polymer-forming cytoskeletal |
| Contig1 | 351153 | 351866 | + | GENE_00353 | Prodigal: 2.6 | CDS | — | — | — | — | — | — | — | — | hypothetical protein |
| Contig1 | 351878 | 352588 | + | GENE_00354 | Prodigal: 2.6 | CDS | — | — | — | — | — | — | — | — | hypothetical protein |
| Contig1 | 352645 | 352734 | − | GENE_00355 | Prodigal: 2.6 | CDS | — | — | PF08298.5 | — | — | — | — | — | PrkA AAA domain protein |
| Contig1 | 352947 | 354842 | + | GENE_00356 | Prodigal: 2.6 | CDS | — | — | — | — | — | — | — | — | hypothetical protein |
| Contig1 | 355033 | 356211 | + | GENE_00357 | Prodigal: 2.6 | CDS | — | — | — | — | P45742 | — | — | Stress response UPF0229 protein YhbH | hypothetical protein |
| Contig1 | 356397 | 356861 | + | GENE_00358 | Prodigal: 2.6 | CDS | — | — | — | — | O32181 | yusO_1 | — | — | putative HTH-type transcriptional regulator YusO |
| Contig1 | 356931 | 357563 | + | GENE_00359 | Prodigal: 2.6 | CDS | — | — | — | — | P52599 | emrK | — | — | putative multidrug resistance protein EmrK |
| Contig1 | 357604 | 359199 | + | GENE_00360 | Prodigal: 2.6 | CDS | — | — | — | — | P0AEJ0 | emrB_1 | — | — | Multidrug export protein EmrB |
| Contig1 | 359224 | 359757 | + | GENE_00361 | Prodigal: 2.6 | CDS | 1.6.5.2 | — | — | — | C1I202 | pmpB | — | — | p-benzoquinone reductase |
| Contig1 | 359770 | 360141 | + | GENE_00362 | Prodigal: 2.6 | CDS | — | — | — | — | — | — | — | — | hypothetical protein |
| Contig1 | 360261 | 361028 | + | GENE_00363 | Prodigal: 2.6 | CDS | — | — | — | — | — | — | — | — | hypothetical protein |
| Contig1 | 361031 | 361408 | + | GENE_00364 | Prodigal: 2.6 | CDS | — | — | — | — | O34712 | ytrA_1 | — | — | HTH-type transcriptional repressor YtrA |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 361398 | 362114 | + | GENE_00365 | Prodigal: 2.6 | CDS | 3.6.3.- | — | — | — | P94374 | yxlF_1 | — | — | putative ABC transporter ATP-binding protein YxlF |
| Contig1 | 362115 | 363032 | + | GENE_00366 | Prodigal: 2.6 | CDS | 3.6.3.- | — | — | — | P94374 | yxlF_2 | — | — | putative ABC transporter ATP-binding protein YxlF |
| Contig1 | 363025 | 363972 | + | GENE_00367 | Prodigal: 2.6 | CDS | — | — | — | — | — | — | — | — | ABC-2 family transporter protein |
| Contig1 | 364064 | 364264 | − | GENE_00368 | Prodigal: 2.6 | CDS | — | — | PF12730.1 | — | P32081 | cspB | — | — | Cold shock protein CspB |
| Contig1 | 364647 | 365477 | + | GENE_00369 | Prodigal: 2.6 | CDS | — | — | — | — | O32167 | metQ_1 | — | — | Methionine-binding lipoprotein MetQ precursor |
| Contig1 | 365494 | 366573 | − | GENE_00370 | Prodigal: 2.6 | CDS | 2.7.7.65 | — | — | — | P76330 | yedQ_1 | — | — | putative diguanylate cyclase YedQ |
| Contig1 | 366725 | 368116 | + | GENE_00371 | Prodigal: 2.6 | CDS | — | — | — | — | P54596 | tcyP | — | — | L-cystine uptake protein TcyP |
| Contig1 | 368184 | 368756 | − | GENE_00372 | Prodigal: 2.6 | CDS | — | — | — | — | — | — | — | — | hypothetical protein |
| Contig1 | 368901 | 369440 | + | GENE_00373 | Prodigal: 2.6 | CDS | — | — | — | — | P54598 | yhcN | — | — | Lipoprotein YhcN precursor |
| Contig1 | 369561 | 370505 | − | GENE_00374 | Prodigal: 2.6 | CDS | — | — | — | — | — | — | — | — | hypothetical protein |
| Contig1 | 370465 | 371130 | − | GENE_00375 | Prodigal: 2.6 | CDS | — | — | PF07875.6 | — | — | — | — | — | Coat F domain protein |
| Contig1 | 371323 | 373377 | + | GENE_00376 | Prodigal: 2.6 | CDS | 3.1.31.- | — | — | — | P54602 | yhcR_1 | — | — | Endonuclease YhcR precursor |
| Contig1 | 373374 | 373970 | + | GENE_00377 | Prodigal: 2.6 | CDS | — | — | PF04203.7 | — | — | — | — | — | Sortase family protein |
| Contig1 | 373967 | 374875 | − | GENE_00378 | Prodigal: 2.6 | CDS | 5.4.99.23 | — | — | — | P33643 | rluD_1 | — | — | Ribosomal large subunit pseudouridine synthase D |
| Contig1 | 374985 | 375380 | + | GENE_00379 | Prodigal: 2.6 | CDS | — | — | — | — | — | — | — | — | hypothetical protein |
| Contig1 | 375511 | 375933 | + | GENE_00380 | Prodigal: 2.6 | CDS | — | — | — | — | O06186 | hrp1_1 | — | — | Hypoxic response protein 1 |
| Contig1 | 376061 | 376750 | + | GENE_00381 | Prodigal: 2.6 | CDS | 3.1.3.68 | — | — | — | P77247 | yniC | — | — | 2-deoxyglucose-6-phosphate phosphatase |
| Contig1 | 376743 | 378281 | + | GENE_00382 | Prodigal: 2.6 | CDS | 3.5.1.100 | — | — | — | Q75SP7 | ramA | — | — | (R)-stereoselective amidase |
| Contig1 | 378464 | 379876 | + | GENE_00383 | Prodigal: 2.6 | CDS | 2.6.1.77 | — | — | — | Q9APM5 | tpa_1 | — | — | Taurine-pyruvate aminotransferase |
| Contig1 | 379893 | 380468 | + | GENE_00384 | Prodigal: 2.6 | CDS | — | — | PF04309.6 | — | — | — | — | — | Glycerol-3-phosphate responsive antiterminator |
| Contig1 | 380641 | 381468 | + | GENE_00385 | Prodigal: 2.6 | CDS | — | — | — | — | P18156 | glpF | — | — | Glycerol uptake facilitator protein |
| Contig1 | 381485 | 382975 | + | GENE_00386 | Prodigal: 2.6 | CDS | 2.7.1.30 | — | — | — | P18157 | glpK | — | — | Glycerol kinase |
| Contig1 | 383117 | 384781 | + | GENE_00387 | Prodigal: 2.6 | CDS | 1.1.5.3 | — | — | — | P18158 | glpD | — | — | Aerobic glycerol-3-phosphate dehydrogenase |
| Contig1 | 384921 | 386663 | + | GENE_00388 | Prodigal: 2.6 | CDS | 5.4.2.2 | — | — | — | P18159 | pgcA | — | — | Phosphoglucomutase |
| Contig1 | 386809 | 387945 | + | GENE_00389 | Prodigal: 2.6 | CDS | 2.7.13.3 | — | — | — | Q99SZ7 | vraS | — | — | Sensor protein VraS |

TABLE 5-continued

| #ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 387945 | 388592 | + | GENE_00390 | Prodigal: 2.6 | CDS | — | — | — | — | O32197 | liaR_1 | — | — | Transcriptional regulatory protein LiaR |
| Contig1 | 388589 | 389113 | + | GENE_00391 | Prodigal: 2.6 | CDS | 1.7.-.- | — | — | — | O07529 | azr_1 | — | — | FMN-dependent NADPH-azoreductase |
| Contig1 | 389127 | 389369 | − | GENE_00392 | Prodigal: 2.6 | CDS | — | — | — | — | — | — | — | — | hypothetical protein |
| Contig1 | 389561 | 389884 | + | GENE_00393 | Prodigal: 2.6 | CDS | — | — | — | — | — | — | — | — | hypothetical protein |
| Contig1 | 389927 | 391372 | − | GENE_00394 | Prodigal: 2.6 | CDS | 3.4.-.- | — | — | — | O07532 | lytF | — | — | Peptidoglycan endopeptidase LytF precursor |
| Contig1 | 391552 | 391986 | − | GENE_00395 | Prodigal: 2.6 | CDS | — | — | — | — | Q9L132 | nsrR | — | — | HTH-type transcriptional repressor NsrR |
| Contig1 | 392121 | 393635 | − | GENE_00396 | Prodigal: 2.6 | CDS | — | — | PF05552.6 | — | — | — | — | Conserved TM helix | hypothetical protein |
| Contig1 | 393805 | 395211 | + | GENE_00397 | Prodigal: 2.6 | CDS | — | PRK11767 | — | — | — | — | — | — | SpoVR family protein |
| Contig1 | 395249 | 396628 | − | GENE_00398 | Prodigal: 2.6 | CDS | 3.1.3.1 | — | — | — | P19406 | phoA | — | — | Alkaline phosphatase 4 precursor |
| Contig1 | 397087 | 397911 | + | GENE_00399 | Prodigal: 2.6 | CDS | 3.4.-.- | — | — | — | P54421 | lytE | — | — | putative peptidoglycan endopeptidase LytE precursor |
| Contig1 | 397979 | 398854 | − | GENE_00400 | Prodigal: 2.6 | CDS | — | — | — | — | P39647 | cysL_1 | — | — | HTH-type transcriptional regulator CysL |
| Contig1 | 398958 | 400067 | + | GENE_00401 | Prodigal: 2.6 | CDS | 2.3.3.1 | — | — | — | P39119 | citA | — | — | Citrate synthase 1 |
| Contig1 | 400147 | 401016 | + | GENE_00402 | Prodigal: 2.6 | CDS | 1.-.-.- | — | — | — | P80873 | ydaD_1 | — | — | General stress protein 39 |
| Contig1 | 401346 | 402749 | + | GENE_00403 | Prodigal: 2.6 | CDS | — | — | — | — | O07576 | yhdG_2 | — | — | putative amino acid permease YhdG |
| Contig1 | 402912 | 404219 | + | GENE_00404 | Prodigal: 2.6 | CDS | — | — | PF00209.12 | — | — | — | — | — | Sodium:neurotransmitter symporter family protein |
| Contig1 | 404256 | 404546 | − | GENE_00405 | Prodigal: 2.6 | CDS | — | — | — | — | O07580 | yhdK | — | — | putative anti-sigma-M factor YhdK |
| Contig1 | 404534 | 405607 | − | GENE_00406 | Prodigal: 2.6 | CDS | — | — | — | — | O07581 | yhdL | — | — | putative anti-sigma-M factor YhdL |
| Contig1 | 405600 | 406091 | − | GENE_00407 | Prodigal: 2.6 | CDS | — | — | — | — | O07582 | sigM | — | — | RNA polymerase sigma factor SigM |
| Contig1 | 406330 | 406929 | + | GENE_00408 | Prodigal: 2.6 | CDS | 2.3.1.- | — | — | — | O07584 | plsC | — | — | 1-acyl-sn-glycerol-3-phosphate acyltransferase |
| Contig1 | 406975 | 408309 | − | GENE_00409 | Prodigal: 2.6 | CDS | — | — | — | — | O05961 | tlyC | — | — | Hemolysin C |
| Contig1 | 408371 | 408796 | − | GENE_00410 | Prodigal: 2.6 | CDS | — | — | — | — | P22853 | merR1 | — | — | Mercuric resistance operon regulatory protein |
| Contig1 | 408976 | 410160 | + | GENE_00411 | Prodigal: 2.6 | CDS | 2.6.1.1 | — | — | — | Q9X0Y2 | aspC | — | — | Aspartate aminotransferase |
| Contig1 | 410193 | 411413 | + | GENE_00412 | Prodigal: 2.6 | CDS | 4.1.1.87 | — | — | — | P40804 | pksF | — | — | Polyketide biosynthesis malonyl-ACP decarboxylase PksF |
| Contig1 | 411666 | 413054 | + | GENE_00413 | Prodigal: 2.6 | CDS | — | — | — | — | P0AE78 | corC_1 | — | — | Magnesium and cobalt efflux protein CorC |
| Contig1 | 413068 | 413427 | − | GENE_00414 | Prodigal: 2.6 | CDS | — | — | — | — | P37002 | crcB_1 | — | — | Putative fluoride ion transporter CrcB |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 413424 | 413819 | − | GENE_00415 | Prodigal: 2.6 | CDS | — | — | — | — | P37002 | crcB_2 | — | — | Putative fluoride ion transporter CrcB |
| Contig1 | 413821 | 414537 | − | GENE_00416 | Prodigal: 2.6 | CDS | 3.1.4.46 | — | — | — | P10908 | ugpQ_1 | — | — | Glycerophosphoryl diester phosphodiesterase |
| Contig1 | 414707 | 414811 | + | GENE_00417 | Prodigal: 2.6 | CDS | — | — | — | — | — | — | — | — | hypothetical protein |
| Contig1 | 414974 | 416089 | + | GENE_00418 | Prodigal: 2.6 | CDS | — | — | — | — | P0AEB5 | ynaI | — | — | Low conductance mechanosensitive channel YnaI |
| Contig1 | 416141 | 416884 | + | GENE_00419 | Prodigal: 2.6 | CDS | 3.5.1.- | — | — | — | Q9WYW0 | cobB | — | — | NAD-dependent protein deacetylase |
| Contig1 | 416918 | 417766 | − | GENE_00420 | Prodigal: 2.6 | CDS | 3.5.1.104 | — | — | — | Q8DP63 | pgdA_1 | — | — | Peptidoglycan-N-acetylglucosamine deacetylase |
| Contig1 | 418023 | 418874 | + | GENE_00421 | Prodigal: 2.6 | CDS | 2.6.1.21 | — | — | — | P19938 | dat_1 | — | — | D-alanine aminotransferase |
| Contig1 | 418917 | 419423 | − | GENE_00422 | Prodigal: 2.6 | CDS | — | — | — | — | P17446 | betI | — | — | HTH-type transcriptional regulator BetI |
| Contig1 | 419610 | 420161 | + | GENE_00423 | Prodigal: 2.6 | CDS | — | — | — | — | — | — | — | — | hypothetical protein |
| Contig1 | 420201 | 420701 | − | GENE_00424 | Prodigal: 2.6 | CDS | — | — | — | — | O07552 | nhaX_1 | — | — | Stress response protein NhaX |
| Contig1 | 420995 | 421099 | + | GENE_00425 | Prodigal: 2.6 | CDS | — | — | — | — | — | — | — | — | hypothetical protein |
| Contig1 | 421123 | 422919 | + | GENE_00426 | Prodigal: 2.6 | CDS | 3.6.3.- | — | — | — | O07550 | yheI | — | — | putative multidrug resistance ABC transporter ATP-binding/permease protein YheI |
| Contig1 | 422876 | 424897 | + | GENE_00427 | Prodigal: 2.6 | CDS | 3.6.3.- | — | — | — | O07549 | yheH | — | — | putative multidrug resistance ABC transporter ATP-binding/permease protein YheH |
| Contig1 | 424938 | 425558 | − | GENE_00428 | Prodigal: 2.6 | CDS | 1.2.1.11 | — | — | MF_02121 | — | asd_1 | — | — | Aspartate-semialdehyde dehydrogenase |
| Contig1 | 425587 | 425712 | − | GENE_00429 | Prodigal: 2.6 | CDS | — | — | — | — | — | — | — | — | hypothetical protein |
| Contig1 | 425814 | 426020 | − | GENE_00430 | Prodigal: 2.6 | CDS | — | — | — | — | P84584 | — | — | — | Small, acid-soluble spore protein 2 |
| Contig1 | 426245 | 426451 | − | GENE_00431 | Prodigal: 2.6 | CDS | — | — | — | — | — | — | — | — | hypothetical protein |
| Contig1 | 426543 | 427901 | − | GENE_00432 | Prodigal: 2.6 | CDS | — | — | — | — | O07545 | yheD_1 | — | — | Endospore coat-associated protein YheD |
| Contig1 | 427891 | 428982 | − | GENE_00433 | Prodigal: 2.6 | CDS | — | — | — | — | O07545 | yheD_2 | — | — | Endospore coat-associated protein YheD |
| Contig1 | 429220 | 430353 | + | GENE_00434 | Prodigal: 2.6 | CDS | — | — | — | — | — | — | — | — | hypothetical protein |
| Contig1 | 430439 | 430789 | + | GENE_00435 | Prodigal: 2.6 | CDS | — | — | — | — | — | — | — | — | hypothetical protein |
| Contig1 | 430828 | 431967 | − | GENE_00436 | Prodigal: 2.6 | CDS | — | — | — | — | — | — | — | — | hypothetical protein |
| Contig1 | 432351 | 433217 | + | GENE_00437 | Prodigal: 2.6 | CDS | — | — | — | — | O07539 | yhaX | — | — | Stress response protein YhaX |
| Contig1 | 433330 | 434832 | + | GENE_00438 | Prodigal: 2.6 | CDS | 1.3.99.22 | — | — | — | Q796V8 | hemZ | — | — | Oxygen-independent coproporphyrinogen-III oxidase 2 |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 434934 | 436223 | + | GENE_00439 | Prodigal: 2.6 | CDS | 1.14.13.59 | — | — | — | P11295 | iucD | — | — | L-lysine N6-monooxygenase |
| Contig1 | 436249 | 437463 | — | GENE_00440 | Prodigal: 2.6 | CDS | — | — | — | — | O07536 | yhaU | — | — | K(+)/H(+) antiporter YhaU |
| Contig1 | 437471 | 437968 | — | GENE_00441 | Prodigal: 2.6 | CDS | — | — | — | — | O07535 | khtT_1 | — | — | K(+)/H(+) antiporter subunit KhtT |
| Contig1 | 437996 | 438349 | — | GENE_00442 | Prodigal: 2.6 | CDS | — | — | — | — | — | — | — | — | hypothetical protein |
| Contig1 | 438534 | 439301 | + | GENE_00443 | Prodigal: 2.6 | CDS | 4.2.1.17 | — | — | — | P76082 | paaF | — | — | 2,3-dehydroadipyl-CoA hydratase |
| Contig1 | 439326 | 439511 | — | GENE_00444 | Prodigal: 2.6 | CDS | — | — | — | — | — | — | — | — | hypothetical protein |
| Contig1 | 439617 | 440513 | + | GENE_00445 | Prodigal: 2.6 | CDS | 3.6.3.- | — | — | — | P45073 | lptB | — | — | Lipopolysaccharide export system ATP-binding protein LptB |
| Contig1 | 440506 | 441765 | + | GENE_00446 | Prodigal: 2.6 | CDS | — | — | PF12698.1 | — | — | — | — | — | ABC-2 family transporter protein |
| Contig1 | 441876 | 443099 | + | GENE_00447 | Prodigal: 2.6 | CDS | — | — | — | — | O07522 | yhaO | — | — | putative metallophoesterase YhaO |
| Contig1 | 443096 | 445978 | + | GENE_00448 | Prodigal: 2.6 | CDS | — | — | — | — | — | — | — | — | hypothetical protein |
| Contig1 | 446052 | 446996 | + | GENE_00449 | Prodigal: 2.6 | CDS | 3.1.-.- | — | — | — | O07521 | yhaM | — | — | 3'-5' exoribonuclease YhaM |
| Contig1 | 447111 | 447338 | + | GENE_00450 | Prodigal: 2.6 | CDS | — | — | — | — | O07520 | yhaL | — | — | Sporulation protein YhaL |
| Contig1 | 447377 | 448228 | — | GENE_00451 | Prodigal: 2.6 | CDS | 5.2.1.8 | — | — | — | P24327 | prsA | — | — | Foldase protein PrsA precursor |
| Contig1 | 449020 | 449550 | + | GENE_00452 | Prodigal: 2.6 | CDS | — | — | — | — | — | — | — | — | hypothetical protein |
| Contig1 | 449771 | 450103 | + | GENE_00453 | Prodigal: 2.6 | CDS | — | — | — | — | — | — | — | — | hypothetical protein |
| Contig1 | 450100 | 450711 | — | GENE_00454 | Prodigal: 2.6 | CDS | — | — | — | — | P11065 | hpr | — | — | HTH-type transcriptional regulator Hpr |
| Contig1 | 450891 | 451247 | + | GENE_00455 | Prodigal: 2.6 | CDS | — | — | PF12732.1 | — | — | — | — | — | YtxH-like protein |
| Contig1 | 451377 | 451556 | + | GENE_00456 | Prodigal: 2.6 | CDS | — | — | — | — | — | — | — | — | hypothetical protein |
| Contig1 | 451614 | 452132 | — | GENE_00457 | Prodigal: 2.6 | CDS | — | — | — | — | O07515 | trpP | — | — | putative tryptophan transport protein |
| Contig1 | 452253 | 453332 | — | GENE_00458 | Prodigal: 2.6 | CDS | 2.6.1.52 | — | — | — | P80862 | serC | — | — | Phosphoserine aminotransferase |
| Contig1 | 453469 | 453906 | — | GENE_00459 | Prodigal: 2.6 | CDS | 3.-.-.- | — | — | — | P44956 | — | — | — | HIT-like protein |
| Contig1 | 454396 | 455139 | + | GENE_00460 | Prodigal: 2.6 | CDS | — | — | — | — | P55339 | ecsA_1 | — | — | ABC-type transporter ATP-binding protein EcsA |
| Contig1 | 455132 | 456358 | + | GENE_00461 | Prodigal: 2.6 | CDS | — | — | PF05975.6 | — | — | — | — | — | Bacterial ABC transporter protein EcsB |
| Contig1 | 456401 | 457105 | + | GENE_00462 | Prodigal: 2.6 | CDS | — | — | PF12787.1 | — | — | — | — | — | EcsC protein family protein |
| Contig1 | 457126 | 458313 | — | GENE_00463 | Prodigal: 2.6 | CDS | 3.5.1.14 | — | — | — | P37112 | amaA | — | — | N-acyl-L-amino acid amidohydrolase |
| Contig1 | 458382 | 459107 | — | GENE_00464 | Prodigal: 2.6 | CDS | — | — | — | — | — | — | — | — | hypothetical protein |
| Contig1 | 459050 | 459766 | — | GENE_00465 | Prodigal: 2.6 | CDS | — | — | — | — | — | — | — | — | hypothetical protein |
| Contig1 | 459884 | 460384 | — | GENE_00466 | Prodigal: 2.6 | CDS | 1.14.99.3 | — | — | — | P38049 | hmoB | — | — | Heme-degrading monooxygenase HmoB |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 460507 | 462648 | + | GENE_00467 | Prodigal: 2.6 | CDS | — | — | — | — | P38050 | pbpF | — | — | Penicillin-binding protein 1F |
| Contig1 | 462721 | 463833 | + | GENE_00468 | Prodigal: 2.6 | CDS | 4.1.1.37 | — | — | — | P32395 | hemE | — | — | Uroporphyrinogen decarboxylase |
| Contig1 | 463909 | 464844 | + | GENE_00469 | Prodigal: 2.6 | CDS | 4.99.1.1 | — | — | — | P32396 | hemH | — | — | Ferrochelatase |
| Contig1 | 464872 | 466305 | + | GENE_00470 | Prodigal: 2.6 | CDS | 1.3.3.4 | — | — | — | P32397 | hemY | — | — | Protoporphyrinogen oxidase |
| Contig1 | 466453 | 467025 | + | GENE_00471 | Prodigal: 2.6 | CDS | — | — | — | — | P43506 | bm3R1_2 | — | — | HTH-type transcriptional repressor Bm3R1 |
| Contig1 | 467100 | 469433 | + | GENE_00472 | Prodigal: 2.6 | CDS | — | — | — | MF_01894 | — | smc_1 | — | — | Chromosome partition protein Smc |
| Contig1 | 469484 | 470461 | − | GENE_00473 | Prodigal: 2.6 | CDS | 2.3.1.180 | — | — | — | O07600 | fabHB | — | — | 3-oxoacyl-[acyl-carrier-protein] synthase 3 protein 2 |
| Contig1 | 470599 | 470820 | − | GENE_00474 | Prodigal: 2.6 | CDS | — | — | — | — | — | — | — | — | Putative hypothetical protein |
| Contig1 | 470943 | 471983 | + | GENE_00475 | Prodigal: 2.6 | CDS | 3.4.11.- | — | — | — | P94521 | ysdC_1 | — | — | Putative aminopeptidase YsdC |
| Contig1 | 472024 | 473313 | − | GENE_00476 | Prodigal: 2.6 | CDS | — | — | — | — | P24943 | gltT_1 | — | — | Proton/sodium-glutamate symport protein |
| Contig1 | 473840 | 474574 | + | GENE_00477 | Prodigal: 2.6 | CDS | 3.1.26.11 | — | — | MF_01818 | — | rbn | — | — | Ribonuclease BN |
| Contig1 | 474587 | 475582 | + | GENE_00478 | Prodigal: 2.6 | CDS | 2.7.7.63 | — | — | — | O07608 | lplJ | — | — | Lipoate-protein ligase LplJ |
| Contig1 | 475663 | 476307 | + | GENE_00479 | Prodigal: 2.6 | CDS | 4.-.-.- | — | — | — | O07609 | yhfK | — | — | putative sugar epimerase YhfK |
| Contig1 | 476439 | 477980 | + | GENE_00480 | Prodigal: 2.6 | CDS | 6.2.1.3 | — | — | — | O07610 | lcfB_1 | — | — | Long-chain-fatty-acid-CoA ligase |
| Contig1 | 478028 | 478423 | − | GENE_00481 | Prodigal: 2.6 | CDS | — | — | — | — | — | — | — | — | hypothetical protein |
| Contig1 | 478578 | 479828 | + | GENE_00482 | Prodigal: 2.6 | CDS | — | — | — | — | — | htpX_1 | — | — | Protease HtpX |
| Contig1 | 479873 | 481021 | + | GENE_00483 | Prodigal: 2.6 | CDS | 3.4.21.62 | — | — | MF_00188 | P00782 | apr | — | — | Subtilisin BPN' precursor |
| Contig1 | 481509 | 481769 | − | GENE_00484 | Prodigal: 2.6 | CDS | — | — | — | — | C0SP94 | yhfQ_1 | — | — | Putative ABC transporter substrate-binding lipoprotein YhfQ precursor |
| Contig1 | 481766 | 482386 | + | GENE_00485 | Prodigal: 2.6 | CDS | — | — | — | — | C0SP94 | yhfQ2 | — | — | Putative ABC transporter substrate-binding lipoprotein YhfQ precursor |
| Contig1 | 482401 | 482976 | − | GENE_00486 | Prodigal: 2.6 | CDS | 3.1.3.3 | — | — | — | D3DFP8 | pspB | — | — | Putative phosphoserine phosphatase 2 |
| Contig1 | 483027 | 484118 | − | GENE_00487 | Prodigal: 2.6 | CDS | 2.3.1.- | — | — | — | O07618 | yhfS | — | — | Putative acetyl-CoA C-acetyltransferase YhfS |
| Contig1 | 484106 | 485542 | − | GENE_00488 | Prodigal: 2.6 | CDS | 6.2.1.- | — | — | — | O07619 | yhfT | — | — | putative acyl-CoA ligase YhfT |
| Contig1 | 485554 | 486111 | − | GENE_00489 | Prodigal: 2.6 | CDS | — | — | — | — | O07620 | bioY_1 | — | — | putative biotin transporter BioY |
| Contig1 | 486242 | 487534 | − | GENE_00490 | Prodigal: 2.6 | CDS | — | — | — | — | O07621 | hemAT | — | — | Heme-based aerotactic transducer HemAT |

TABLE 5-continued

| #ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 487657 | 489180 | − | GENE_00491 | Prodigal: 2.6 | CDS | 1.4.3.- | — | — | — | P37906 | puuB | — | — | Gamma-glutamylputrescine oxidoreductase |
| Contig1 | 489305 | 490162 | + | GENE_00492 | Prodigal: 2.6 | CDS | 1.-.-.- | PRK03057 | — | — | P80873 | ydaD_2 | — | — | General stress protein 39 |
| Contig1 | 490193 | 490426 | − | GENE_00493 | Prodigal: 2.6 | CDS | — | — | — | — | — | — | — | — | hypothetical protein |
| Contig1 | 490742 | 491320 | + | GENE_00494 | Prodigal: 2.6 | CDS | — | — | — | — | P40396 | comK | — | — | Competence transcription factor |
| Contig1 | 491466 | 491834 | + | GENE_00495 | Prodigal: 2.6 | CDS | — | — | — | — | — | — | — | — | hypothetical protein |
| Contig1 | 491861 | 492232 | + | GENE_00496 | Prodigal: 2.6 | CDS | — | — | — | — | — | — | — | — | hypothetical protein |
| Contig1 | 492232 | 492372 | + | GENE_00497 | Prodigal: 2.6 | CDS | — | — | — | — | — | — | — | — | hypothetical protein |
| Contig1 | 492365 | 493075 | + | GENE_00498 | Prodigal: 2.6 | CDS | — | — | — | — | — | — | — | — | hypothetical protein |
| Contig1 | 493271 | 493540 | + | GENE_00499 | Prodigal: 2.6 | CDS | — | — | PF05901.5 | — | — | — | — | — | Excalibur calcium-binding domain protein |
| Contig1 | 493573 | 493890 | − | GENE_00500 | Prodigal: 2.6 | CDS | — | — | — | — | — | — | — | — | hypothetical protein |
| Contig1 | 493931 | 495400 | − | GENE_00501 | Prodigal: 2.6 | CDS | — | PRK00967 | — | — | O34745 | yodF_1 | — | — | putative symporter YodF |
| Contig1 | 495397 | 495597 | − | GENE_00502 | Prodigal: 2.6 | CDS | — | — | — | — | — | — | — | — | hypothetical protein |
| Contig1 | 495718 | 496077 | − | GENE_00503 | Prodigal: 2.6 | CDS | — | — | — | — | — | — | — | — | hypothetical protein |
| Contig1 | 496229 | 496855 | + | GENE_00504 | Prodigal: 2.6 | CDS | — | — | — | — | P76221 | ydjZ_1 | — | — | TVP38/TMEM64 family inner membrane protein YdjZ |
| Contig1 | 496852 | 497367 | + | GENE_00505 | Prodigal: 2.6 | CDS | 3.4.21.89 | — | — | — | O07560 | sipV | — | — | Signal peptidase I V |
| Contig1 | 497512 | 498993 | + | GENE_00506 | Prodigal: 2.6 | CDS | 1.14.13.50 | — | — | — | P42535 | pcpB | — | — | Pentachlorophenol 4-monooxygenase |
| Contig1 | 499083 | 499604 | + | GENE_00507 | Prodigal: 2.6 | CDS | — | — | PF01047.16 | — | — | — | — | — | MarR family protein |
| Contig1 | 499641 | 500798 | − | GENE_00508 | Prodigal: 2.6 | CDS | — | — | PF05145.6 | — | — | — | — | — | Putative ammonia monooxygenase |
| Contig1 | 500966 | 502162 | − | GENE_00509 | Prodigal: 2.6 | CDS | — | — | — | — | P02980 | tetA_1 | — | — | Tetracycline resistance protein, class B |
| Contig1 | 502178 | 502798 | − | GENE_00510 | Prodigal: 2.6 | CDS | — | — | — | — | P0A0N5 | qacR | — | — | HTH-type transcriptional regulator QacR |
| Contig1 | 503049 | 503567 | − | GENE_00511 | Prodigal: 2.6 | CDS | — | — | PF02915.11 | — | — | — | — | — | Rubrerythrin |
| Contig1 | 503636 | 504349 | − | GENE_00512 | Prodigal: 2.6 | CDS | — | — | — | — | — | — | — | — | hypothetical protein |
| Contig1 | 504491 | 507991 | + | GENE_00513 | Prodigal: 2.6 | CDS | 3.1.-.- | — | — | — | P23477 | addB | — | — | ATP-dependent helicase/deoxyribonuclease subunit B |
| Contig1 | 507978 | 511682 | + | GENE_00514 | Prodigal: 2.6 | CDS | 3.1.-.- | — | — | — | P23478 | addA_1 | — | — | ATP-dependent helicase/nuclease subunit A |
| Contig1 | 511747 | 512919 | + | GENE_00515 | Prodigal: 2.6 | CDS | — | — | — | — | A6QGP7 | sbcD | — | — | Nuclease SbcCD subunit D |
| Contig1 | 512916 | 516308 | + | GENE_00516 | Prodigal: 2.6 | CDS | — | — | — | — | Q7A5S6 | sbcC | — | — | Nuclease SbcCD subunit C |
| Contig1 | 516324 | 516617 | + | GENE_00517 | Prodigal: 2.6 | CDS | — | — | — | — | — | — | — | — | hypothetical protein |
| Contig1 | 516661 | 516879 | − | GENE_00518 | Prodigal: 2.6 | CDS | — | — | — | — | O06716 | gerPF_1 | — | — | putative spore germination protein GerPF |
| Contig1 | 516919 | 517314 | − | GENE_00519 | Prodigal: 2.6 | CDS | — | — | — | — | O06717 | gerPE | — | — | putative spore germination protein GerPE |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 517314 | 517490 | – | GENE_00520 | Prodigal: 2.6 | CDS | — | — | — | — | O06718 | gerPD | — | — | putative spore germination protein GerPD |
| Contig1 | 517487 | 518104 | – | GENE_00521 | Prodigal: 2.6 | CDS | — | — | — | — | O06719 | gerPC | — | — | putative spore germination protein GerPC |
| Contig1 | 518140 | 518376 | – | GENE_00522 | Prodigal: 2.6 | CDS | — | — | — | — | O06720 | gerPB | — | — | putative spore germination protein GerPB |
| Contig1 | 518389 | 518610 | – | GENE_00523 | Prodigal: 2.6 | CDS | — | — | — | — | O06721 | gerPA | — | — | putative spore germination protein GerPA |
| Contig1 | 518801 | 519010 | – | GENE_00524 | Prodigal: 2.6 | CDS | 3.1.3.- | — | — | — | O06722 | yisI | — | — | Aspartyl-phosphate phosphatase YisI |
| Contig1 | 519226 | 520131 | + | GENE_00525 | Prodigal: 2.6 | CDS | 4.3.2.3 | — | — | — | Q39BA7 | — | — | — | Ureidoglycolate lyase |
| Contig1 | 520225 | 520581 | + | GENE_00526 | Prodigal: 2.6 | CDS | — | — | — | — | — | — | — | — | hypothetical protein |
| Contig1 | 520834 | 521376 | – | GENE_00527 | Prodigal: 2.6 | CDS | — | — | — | — | — | — | — | — | hypothetical protein |
| Contig1 | 521552 | 523393 | + | GENE_00528 | Prodigal: 2.6 | CDS | 6.3.5.4 | — | — | — | O05272 | asnO | — | — | Asparagine synthetase [glutamine-hydrolyzing] 3 |
| Contig1 | 523479 | 524219 | + | GENE_00529 | Prodigal: 2.6 | CDS | 2.5.1.99 | — | — | — | P37294 | crtB | — | — | All-trans-phytoene synthase |
| Contig1 | 524255 | 525652 | – | GENE_00530 | Prodigal: 2.6 | CDS | — | — | — | — | O82855 | norM_1 | — | — | Multidrug resistance protein NorM |
| Contig1 | 525745 | 526608 | + | GENE_00531 | Prodigal: 2.6 | CDS | — | — | — | — | P0A9E0 | araC | — | — | Arabinose operon regulatory protein |
| Contig1 | 526644 | 527669 | + | GENE_00532 | Prodigal: 2.6 | CDS | — | — | — | — | P37947 | degA_1 | — | — | HTH-type transcriptional regulator DegA |
| Contig1 | 527893 | 528924 | + | GENE_00533 | Prodigal: 2.6 | CDS | 1.1.1.18 | — | — | — | O68965 | idhA | — | — | Inositol 2-dehydrogenase |
| Contig1 | 528970 | 529464 | – | GENE_00534 | Prodigal: 2.6 | CDS | — | — | PF05163.6 | — | — | — | — | — | DinB family protein |
| Contig1 | 529519 | 530127 | – | GENE_00535 | Prodigal: 2.6 | CDS | — | — | — | — | P11667 | argO | — | — | Arginine exporter protein ArgO |
| Contig1 | 530253 | 531695 | + | GENE_00536 | Prodigal: 2.6 | CDS | — | — | — | — | Q2G1P1 | norG_1 | — | — | HTH-type transcriptional regulator NorG |
| Contig1 | 531703 | 532329 | – | GENE_00537 | Prodigal: 2.6 | CDS | — | — | PF00805.16 | — | — | — | — | — | Pentapeptide repeats (8 copies) |
| Contig1 | 532528 | 532968 | – | GENE_00538 | Prodigal: 2.6 | CDS | — | — | PF00583.18 | — | — | — | — | — | Acetyltransferase (GNAT) family protein |
| Contig1 | 533051 | 534892 | – | GENE_00539 | Prodigal: 2.6 | CDS | — | — | — | — | O06745 | yitJ | — | — | Bifunctional homocysteine S-methyltransferase/5,10-methylenetetra-hydrofolate reductase |
| Contig1 | 535205 | 535696 | – | GENE_00540 | Prodigal: 2.6 | CDS | — | PRK05412 | — | — | — | — | — | — | putative nucleotide-binding protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 535844 | 536692 | + | GENE_00541 | Prodigal: 2.6 | CDS | — | — | — | — | Q7A5Q1 | — | — | Conserved virulence factor B | hypothetical protein |
| Contig1 | 536864 | 537841 | + | GENE_00542 | Prodigal: 2.6 | CDS | — | — | — | — | P29724 | tmpC_1 | — | — | Membrane lipoprotein TmpC precursor |
| Contig1 | 537838 | 539487 | + | GENE_00543 | Prodigal: 2.6 | CDS | — | — | — | — | P39214 | mcpA_1 | — | — | Methyl-accepting chemotaxis protein McpA |
| Contig1 | 539548 | 539670 | − | GENE_00544 | Prodigal: 2.6 | CDS | — | — | — | — | — | — | — | — | hypothetical protein |
| Contig1 | 539719 | 540570 | − | GENE_00545 | Prodigal: 2.6 | CDS | — | — | — | — | Q9X1H9 | — | — | — | Fatty acid-binding protein |
| Contig1 | 540695 | 541537 | + | GENE_00546 | Prodigal: 2.6 | CDS | — | — | — | — | — | — | — | — | hypothetical protein |
| Contig1 | 541552 | 542013 | + | GENE_00547 | Prodigal: 2.6 | CDS | — | — | — | — | P39804 | ipi | — | — | Intracellular proteinase inhibitor |
| Contig1 | 542051 | 542248 | − | GENE_00548 | Prodigal: 2.6 | CDS | — | — | — | — | — | — | — | — | hypothetical protein |
| Contig1 | 542248 | 542397 | − | GENE_00549 | Prodigal: 2.6 | CDS | — | — | — | — | — | — | — | — | hypothetical protein |
| Contig1 | 542483 | 543295 | − | GENE_00550 | Prodigal: 2.6 | CDS | 3.1.3.23 | — | — | — | P0A8Y5 | yidA_1 | — | — | Sugar phosphatase YidA |
| Contig1 | 543416 | 544183 | + | GENE_00551 | Prodigal: 2.6 | CDS | — | — | — | — | — | — | — | — | esterase |
| Contig1 | 544246 | 544554 | + | GENE_00552 | Prodigal: 2.6 | CDS | 2.5.1.- | — | — | — | O31817 | fosB | — | — | hypothetical protein Metallothiol transferase FosB |
| Contig1 | 544664 | 545086 | − | GENE_00553 | Prodigal: 2.6 | CDS | — | — | — | — | — | — | — | — | |
| Contig1 | 545428 | 546864 | + | GENE_00554 | Prodigal: 2.6 | CDS | 1.-.-.- | PRK10566 | — | — | P72056 | dprE1 | — | — | putative decaprenylphosphoryl-beta-D-ribose oxidase |
| Contig1 | 546861 | 547403 | + | GENE_00555 | Prodigal: 2.6 | CDS | — | — | — | MF_01528 | — | mdtG | — | — | Multidrug resistance protein MdtG |
| Contig1 | 547570 | 548607 | + | GENE_00556 | Prodigal: 2.6 | CDS | 1.2.1.38 | — | — | — | Q07906 | argC | — | — | N-acetyl-gamma-glutamyl-phosphate reductase |
| Contig1 | 548630 | 549847 | + | GENE_00557 | Prodigal: 2.6 | CDS | — | — | — | — | Q07908 | arg J | — | — | Arginine biosynthesis bifunctional protein ArgJ |
| Contig1 | 549862 | 550638 | + | GENE_00558 | Prodigal: 2.6 | CDS | 2.7.2.8 | — | — | — | Q9X2A4 | argB | — | — | Acetylglutamate kinase |
| Contig1 | 550635 | 551792 | + | GENE_00559 | Prodigal: 2.6 | CDS | 2.6.1.11 | — | — | — | O66442 | argD_1 | — | — | Acetylornithine aminotransferase |
| Contig1 | 551861 | 552919 | + | GENE_00560 | Prodigal: 2.6 | CDS | 6.3.5.5 | — | — | — | P54324 | carA_1 | — | — | Carbamoyl-phosphate synthase arginine-specific small chain |
| Contig1 | 552912 | 556007 | + | GENE_00561 | Prodigal: 2.6 | CDS | 6.3.5.5 | — | — | — | Q9ZB63 | carB_1 | — | — | Carbamoyl-phosphate synthase arginine-specific large chain |
| Contig1 | 555995 | 556966 | + | GENE_00562 | Prodigal: 2.6 | CDS | 2.1.3.3 | — | — | — | P18186 | argF | — | — | Ornithine carbamoyltransferase |
| Contig1 | 557042 | 557221 | + | GENE_00563 | Prodigal: 2.6 | CDS | — | — | — | — | — | — | — | — | hypothetical protein |
| Contig1 | 557258 | 557443 | − | GENE_00564 | Prodigal: 2.6 | CDS | — | — | — | — | — | — | — | — | hypothetical protein |
| Contig1 | 557704 | 558438 | + | GENE_00565 | Prodigal: 2.6 | CDS | — | — | — | — | — | — | — | — | hypothetical protein |
| Contig1 | 558521 | 559087 | + | GENE_00566 | Prodigal: 2.6 | CDS | — | — | — | — | — | — | — | — | hypothetical protein |
| Contig1 | 559270 | 560130 | + | GENE_00567 | Prodigal: 2.6 | CDS | — | — | — | — | Q2YKI6 | — | — | — | Purine-binding protein precursor |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 560143 | 560334 | + | GENE_00568 | Prodigal: 2.6 | CDS | — | — | PF10815.2 | — | — | — | — | — | ComZ |
| Contig1 | 560364 | 560582 | − | GENE_00569 | Prodigal: 2.6 | CDS | — | — | — | — | — | — | — | — | hypothetical protein |
| Contig1 | 560750 | 561688 | + | GENE_00570 | Prodigal: 2.6 | CDS | 2.3.1.180 | — | — | — | O34746 | fabHA | — | — | 3-oxoacyl-[acyl-carrier-protein] synthase 3 protein 1 |
| Contig1 | 561711 | 562949 | + | GENE_00571 | Prodigal: 2.6 | CDS | 2.3.1.179 | — | — | — | Q7A6F8 | fabF_2 | — | — | 3-oxoacyl-[acyl-carrier-protein] synthase 2 |
| Contig1 | 563033 | 563818 | + | GENE_00572 | Prodigal: 2.6 | CDS | — | — | — | — | — | — | — | — | hypothetical protein |
| Contig1 | 563992 | 564978 | + | GENE_00573 | Prodigal: 2.6 | CDS | — | — | — | — | P24136 | oppD_2 | — | — | Oligopeptide transport ATP-binding protein OppD |
| Contig1 | 564975 | 565964 | + | GENE_00574 | Prodigal: 2.6 | CDS | — | — | — | — | P24137 | oppF_3 | — | — | Oligopeptide transport ATP-binding protein OppF |
| Contig1 | 566042 | 567670 | + | GENE_00575 | Prodigal: 2.6 | CDS | — | — | — | — | P42061 | appA_2 | — | — | Oligopeptide-binding protein AppA precursor |
| Contig1 | 567737 | 568687 | + | GENE_00576 | Prodigal: 2.6 | CDS | — | — | — | — | P0AEF8 | dppB_2 | — | — | Dipeptide transport system permease protein DppB |
| Contig1 | 568709 | 569623 | + | GENE_00577 | Prodigal: 2.6 | CDS | — | — | — | — | P24139 | oppC_1 | — | — | Oligopeptide transport system permease protein OppC |
| Contig1 | 569771 | 570523 | + | GENE_00578 | Prodigal: 2.6 | CDS | — | — | — | — | — | — | — | — | hypothetical protein |
| Contig1 | 570557 | 571549 | − | GENE_00579 | Prodigal: 2.6 | CDS | 6.1.1.2 | — | — | — | P21656 | trpS | — | — | Tryptophan-tRNA ligase |
| Contig1 | 572293 | 573927 | + | GENE_00580 | Prodigal: 2.6 | CDS | — | — | — | — | P24141 | oppA | — | — | Oligopeptide-binding protein OppA precursor |
| Contig1 | 574034 | 574969 | + | GENE_00581 | Prodigal: 2.6 | CDS | — | — | — | — | P24138 | oppB | — | — | Oligopeptide transport system permease protein OppB |
| Contig1 | 574973 | 575890 | + | GENE_00582 | Prodigal: 2.6 | CDS | — | — | — | — | P24139 | oppC_2 | — | — | Oligopeptide transport system permease protein OppC |
| Contig1 | 575903 | 576979 | + | GENE_00583 | Prodigal: 2.6 | CDS | — | — | — | — | P24136 | oppD_3 | — | — | Oligopeptide transport ATP-binding protein OppD |
| Contig1 | 576972 | 577889 | + | GENE_00584 | Prodigal: 2.6 | CDS | — | — | — | — | P24137 | oppF_4 | — | — | Oligopeptide transport ATP-binding protein OppF |
| Contig1 | 577996 | 579183 | + | GENE_00585 | Prodigal: 2.6 | CDS | 2.3.1.- | — | — | — | — | — | — | — | hypothetical protein |
| Contig1 | 579301 | 579879 | + | GENE_00586 | Prodigal: 2.6 | CDS | — | — | — | — | O31601 | yjbC | — | — | Putative acetyltransferase YjbC |
| Contig1 | 580058 | 580453 | + | GENE_00587 | Prodigal: 2.6 | CDS | — | — | — | — | O31602 | spxA | — | — | Regulatory protein Spx |
| Contig1 | 580511 | 581167 | − | GENE_00588 | Prodigal: 2.6 | CDS | — | — | PF03741.10 | — | — | — | — | — | Integral membrane protein TerC family protein |
| Contig1 | 581350 | 582099 | + | GENE_00589 | Prodigal: 2.6 | CDS | — | — | — | — | P37958 | mecA | — | — | Adapter protein MecA 1 |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 582250 | 583410 | + | GENE_00590 | Prodigal: 2.6 | CDS | — | — | PF06054.5 | — | — | — | — | — | Competence protein CoiA-like family protein |
| Contig1 | 583407 | 585467 | + | GENE_00591 | Prodigal: 2.6 | CDS | 3.4.24.- | — | — | — | P54124 | pepF1_1 | — | — | Oligoendopeptidase F, plasmid |
| Contig1 | 585505 | 585672 | — | GENE_00592 | Prodigal: 2.6 | CDS | — | — | — | — | — | — | — | — | hypothetical protein |
| Contig1 | 585958 | 586860 | — | GENE_00593 | Prodigal: 2.6 | CDS | — | — | PF01323.14 | — | — | — | — | — | DSBA-like thioredoxin domain protein |
| Contig1 | 586857 | 587255 | — | GENE_00594 | Prodigal: 2.6 | CDS | — | — | — | — | O31607 | yjbI | — | — | Group 2 truncated hemoglobin YjbI |
| Contig1 | 587484 | 588158 | — | GENE_00595 | Prodigal: 2.6 | CDS | 4.2.2.- | — | — | — | P0AGC3 | slt | — | — | Soluble lytic murein transglycosylase precursor |
| Contig1 | 588163 | 588738 | + | GENE_00596 | Prodigal: 2.6 | CDS | — | — | PF01928.15 | — | — | — | — | — | CYTH domain protein |
| Contig1 | 588865 | 589230 | + | GENE_00597 | Prodigal: 2.6 | CDS | — | — | — | — | — | — | — | — | hypothetical protein |
| Contig1 | 589258 | 589893 | + | GENE_00598 | Prodigal: 2.6 | CDS | 27.6.5 | — | — | — | O31611 | yjbM | — | — | GTP pyrophosphokinase YjbM |
| Contig1 | 589911 | 590711 | + | GENE_00599 | Prodigal: 2.6 | CDS | 2.7.1.23 | — | — | — | P65777 | ppnK | — | — | putative inorganic polyphosphate/ATP-NAD kinase |
| Contig1 | 590726 | 591619 | + | GENE_00600 | Prodigal: 2.6 | CDS | 5.4.99.23 | — | — | — | P33643 | rluD_2 | — | — | Ribosomal large subunit pseudouridine synthase D |
| Contig1 | 591652 | 592401 | — | GENE_00601 | Prodigal: 2.6 | CDS | 3.6.1.17 | — | — | — | O31614 | prpE | — | — | Bis(5'-nucleosyl)-tetraphosphatase PrpE [asymmetrical] |
| Contig1 | 592629 | 594473 | + | GENE_00602 | Prodigal: 2.6 | CDS | — | — | — | — | P03819 | kefC | — | — | Glutathione-regulated potassium-efflux system protein KefC |
| Contig1 | 594720 | 595430 | + | GENE_00603 | Prodigal: 2.6 | CDS | 3.5.99.2 | — | — | — | P25052 | tenA | — | — | Thiaminase-2 |
| Contig1 | 595408 | 596025 | + | GENE_00604 | Prodigal: 2.6 | CDS | — | — | — | — | P25053 | tenI | — | — | Regulatory protein TenI |
| Contig1 | 596009 | 597118 | + | GENE_00605 | Prodigal: 2.6 | CDS | 1.4.3.19 | — | — | — | O31616 | thiO | — | — | Glycine oxidase |
| Contig1 | 597115 | 597318 | + | GENE_00606 | Prodigal: 2.6 | CDS | — | — | — | — | O31617 | thiS | — | — | Sulfur carrier protein ThiS |
| Contig1 | 597321 | 598085 | + | GENE_00607 | Prodigal: 2.6 | CDS | 2.8.1.10 | — | — | — | O31618 | thiG | — | — | Thiazole synthase |
| Contig1 | 598082 | 599092 | + | GENE_00608 | Prodigal: 2.6 | CDS | 2.7.7.73 | — | — | — | P30138 | thiF_1 | — | — | Sulfur carrier protein ThiS adenylyltransferase |
| Contig1 | 599115 | 599927 | + | GENE_00609 | Prodigal: 2.6 | CDS | 2.7.1.49 | — | — | — | O31620 | thiD_1 | — | — | Hydroxymethyl pyrimidine/phospho-methylpyrimidine kinase |
| Contig1 | 600058 | 600834 | + | GENE_00610 | Prodigal: 2.6 | CDS | 1.3.1.9 | — | — | — | P54616 | fabI | — | — | Enoyl-[acyl-carrier-protein] reductase [NADH] FabI |
| Contig1 | 600932 | 601540 | + | GENE_00611 | Prodigal: 2.6 | CDS | — | — | — | — | — | — | — | — | hypothetical protein |
| Contig1 | 601599 | 602042 | — | GENE_00612 | Prodigal: 2.6 | CDS | — | — | — | — | Q08312 | cotZ | — | — | Spore coat protein Z |
| Contig1 | 602190 | 602672 | — | GENE_00613 | Prodigal: 2.6 | CDS | — | — | — | — | Q08311 | cotY | — | — | Spore coat protein Y |
| Contig1 | 602823 | 603323 | — | GENE_00614 | Prodigal: 2.6 | CDS | — | — | — | — | Q08313 | cotX | — | — | Spore coat protein X |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 603416 | 603730 | - | GENE_00615 | Prodigal: 2.6 | CDS | — | — | — | — | Q08310 | cotW | — | — | Spore coat protein W |
| Contig1 | 603768 | 604154 | - | GENE_00616 | Prodigal: 2.6 | CDS | — | — | — | — | Q08309 | cotV | — | — | Spore coat protein V |
| Contig1 | 604325 | 604681 | + | GENE_00617 | Prodigal: 2.6 | CDS | — | — | — | — | O31623 | yjcA_1 | — | — | Sporulation protein YjcA |
| Contig1 | 604757 | 604876 | + | GENE_00618 | Prodigal: 2.6 | CDS | — | — | — | — | — | — | — | — | hypothetical protein |
| Contig1 | 604967 | 605164 | + | GENE_00619 | Prodigal: 2.6 | CDS | — | — | — | — | — | — | — | — | hypothetical protein |
| Contig1 | 605256 | 605414 | + | GENE_00620 | Prodigal: 2.6 | CDS | — | — | PF09680.4 | — | — | — | — | — | Protein of unknown function (Tiny_TM_bacill) |
| Contig1 | 605581 | 605835 | + | GENE_00621 | Prodigal: 2.6 | CDS | — | — | — | — | — | — | — | — | hypothetical protein |
| Contig1 | 605904 | 608189 | - | GENE_00622 | Prodigal: 2.6 | CDS | 3.6.4.12 | — | — | — | O31626 | yjcD | — | — | Putative ATP-dependent DNA helicase YjcD |
| Contig1 | 608310 | 608564 | + | GENE_00623 | Prodigal: 2.6 | CDS | — | — | — | — | — | — | — | — | hypothetical protein |
| Contig1 | 608633 | 609382 | + | GENE_00624 | Prodigal: 2.6 | CDS | 3.5.2.6 | — | — | — | — | — | — | — | Beta-lactamase 2 precursor |
| Contig1 | 609424 | 610146 | - | GENE_00625 | Prodigal: 2.6 | CDS | — | — | PF01061.18 | — | P04190 | blm | — | — | ABC-2 type transporter |
| Contig1 | 610139 | 610876 | - | GENE_00626 | Prodigal: 2.6 | CDS | 3.6.3.- | — | — | — | P32010 | drrA_2 | — | — | Daunorubicin/doxorubicin resistance ATP-binding protein DrrA |
| Contig1 | 610877 | 611110 | - | GENE_00627 | Prodigal: 2.6 | CDS | — | — | PF04014.12 | — | — | — | — | — | SpoVT/AbrB like domain protein |
| Contig1 | 611133 | 611228 | - | GENE_00628 | Prodigal: 2.6 | CDS | — | — | — | — | — | — | — | — | hypothetical protein |
| Contig1 | 611271 | 611702 | - | GENE_00629 | Prodigal: 2.6 | CDS | 2.3.1.- | — | — | — | — | — | — | — | putative N-acetyltransferase YjcF |
| Contig1 | 611707 | 612222 | - | GENE_00630 | Prodigal: 2.6 | CDS | — | — | PF02834.10 | — | O31628 | yjcF1 | — | — | 2',5' RNA ligase family |
| Contig1 | 612248 | 612784 | - | GENE_00631 | Prodigal: 2.6 | CDS | — | PRK10439 | — | — | — | — | — | — | enterobactin/ferric enterobactin esterase |
| Contig1 | 613339 | 614460 | + | GENE_00632 | Prodigal: 2.6 | CDS | 2.5.1.- | — | — | — | O31631 | metI | — | — | Cystathionine gamma-synthase/O-acetylhomoserine (thiol)-lyase |
| Contig1 | 614453 | 615628 | + | GENE_00633 | Prodigal: 2.6 | CDS | 4.4.1.8 | — | — | — | O31632 | metC | — | — | Cystathionine beta-lyase MetC |
| Contig1 | 615766 | 615840 | + | GENE_00634 | Aragorn: 1.2 | tRNA | — | — | — | — | — | — | — | — | tRNA-Val(gac) |
| Contig1 | 616129 | 616419 | - | GENE_00635 | Prodigal: 2.6 | CDS | — | — | — | — | — | — | — | — | hypothetical protein |
| Contig1 | 616436 | 617101 | - | GENE_00636 | Prodigal: 2.6 | CDS | — | — | — | — | — | — | — | — | hypothetical protein |
| Contig1 | 618368 | 618670 | - | GENE_00637 | Prodigal: 2.6 | CDS | — | — | — | — | — | — | — | — | hypothetical protein |
| Contig1 | 618677 | 620545 | - | GENE_00638 | Prodigal: 2.6 | CDS | 3.1.-.- | — | — | — | O31998 | yokI_2 | — | — | putative ribonuclease YokI |
| Contig1 | 621064 | 621426 | + | GENE_00639 | Prodigal: 2.6 | CDS | — | — | — | — | — | — | — | — | hypothetical protein |
| Contig1 | 621739 | 622653 | + | GENE_00640 | Prodigal: 2.6 | CDS | 3.5.2.6 | — | PF03992.10 | — | P39824 | penP | — | — | Beta-lactamase precursor |
| Contig1 | 622764 | 623045 | + | GENE_00641 | Prodigal: 2.6 | CDS | — | — | — | — | — | — | — | — | Antibiotic biosynthesis monooxygenase |
| Contig1 | 623145 | 624557 | - | GENE_00642 | Prodigal: 2.6 | CDS | — | — | — | — | P0AEJ0 | emrB_2 | — | — | Multidrug export protein EmrB |
| Contig1 | 624700 | 625173 | - | GENE_00643 | Prodigal: 2.6 | CDS | — | — | PF01047.16 | — | — | — | — | — | MarR family protein |

TABLE 5-continued

| # ContigID | Start | End | Strand | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|
| Contig1 | 625443 | 626555 | − | GENE_00644 Prodigal: 2.6 | CDS | 3.2.1.89 | — | — | — | Q65CX5 | ganB | — | — | Arabinogalactan endo-1,4-beta-galactosidase precursor |
| Contig1 | 626607 | 628106 | − | GENE_00645 Prodigal: 2.6 | CDS | 2.7.7.12 | — | — | — | E8MF11 | galT_1 | — | — | Galactose-1-phosphate uridylyltransferase |
| Contig1 | 628108 | 629100 | − | GENE_00646 Prodigal: 2.6 | CDS | 5.1.3.2 | — | — | — | Q7WTB1 | galE | — | — | UDP-glucose 4-epimerase |
| Contig1 | 629104 | 630273 | − | GENE_00647 Prodigal: 2.6 | CDS | 2.7.1.6 | — | — | — | Q9R7D7 | galK | — | — | Galactokinase |
| Contig1 | 630289 | 631986 | − | GENE_00648 Prodigal: 2.6 | CDS | — | — | — | — | Q99S77 | lacE | — | — | PTS system lactose-specific EIICB component |
| Contig1 | 631998 | 632312 | − | GENE_00649 Prodigal: 2.6 | CDS | 2.7.1.- | — | — | — | P23532 | lacF_1 | — | — | Lactose-specific phosphotransferase enzyme IIA component |
| Contig1 | 632375 | 633775 | − | GENE_00650 Prodigal: 2.6 | CDS | 3.2.1.85 | — | — | — | C7N8L9 | lacG | — | — | 6-phospho-beta-galactosidase |
| Contig1 | 634022 | 634789 | + | GENE_00651 Prodigal: 2.6 | CDS | — | — | — | — | P67744 | lacR_1 | — | — | Lactose phosphotransferase system repressor |
| Contig1 | 634807 | 635490 | + | GENE_00652 Prodigal: 2.6 | CDS | 3.1.3.- | — | — | — | P77475 | yqaB | — | — | Fructose-1-phosphate phosphatase YqaB |
| Contig1 | 635680 | 636027 | − | GENE_00653 Prodigal: 2.6 | CDS | — | PRK09272 | — | — | — | — | — | — | hypothetical protein |
| Contig1 | 636011 | 636436 | − | GENE_00654 Prodigal: 2.6 | CDS | — | — | PF01047.16 | — | — | — | — | — | MarR family protein |
| Contig1 | 636799 | 637434 | + | GENE_00655 Prodigal: 2.6 | CDS | — | PRK09977 | — | — | — | — | — | — | putative Mg(2+) transport ATPase |
| Contig1 | 637562 | 637795 | + | GENE_00656 Prodigal: 2.6 | CDS | — | — | — | — | — | — | — | — | hypothetical protein |
| Contig1 | 637775 | 637948 | − | GENE_00657 Prodigal: 2.6 | CDS | — | — | — | — | — | — | — | — | hypothetical protein |
| Contig1 | 637992 | 638393 | − | GENE_00658 Prodigal: 2.6 | CDS | — | — | — | — | — | — | — | — | hypothetical protein |
| Contig1 | 638493 | 639062 | − | GENE_00659 Prodigal: 2.6 | CDS | — | — | — | — | — | — | — | — | hypothetical protein |
| Contig1 | 639152 | 642142 | + | GENE_00660 Prodigal: 2.6 | CDS | 1.2.1.2 | — | — | — | Q99RW4 | — | — | — | Putative formate dehydrogenase |
| Contig1 | 642135 | 642677 | + | GENE_00661 Prodigal: 2.6 | CDS | — | — | — | — | — | — | — | — | hypothetical protein |
| Contig1 | 642885 | 644105 | + | GENE_00662 Prodigal: 2.6 | CDS | 1.14.14.- | — | — | — | P14762 | — | — | — | Cytochrome P450(BM-1) |
| Contig1 | 644102 | 645286 | + | GENE_00663 Prodigal: 2.6 | CDS | 2.4.1.- | — | — | — | Q35685 | oleD_2 | — | — | Oleandomycin glycosyltransferase |
| Contig1 | 645325 | 645510 | + | GENE_00664 Prodigal: 2.6 | CDS | — | — | — | — | — | — | — | — | hypothetical protein |
| Contig1 | 645686 | 646504 | + | GENE_00665 Prodigal: 2.6 | CDS | — | PRK05928 | — | — | — | — | — | — | uroporphyrinogen-III synthase |
| Contig1 | 646529 | 647290 | − | GENE_00666 Prodigal: 2.6 | CDS | — | — | — | — | — | — | — | — | hypothetical protein |
| Contig1 | 647292 | 648029 | − | GENE_00667 Prodigal: 2.6 | CDS | 3.6.3.27 | — | — | — | P0A2V9 | pstB3_1 | — | — | Phosphate import ATP-binding protein PstB 3 |
| Contig1 | 648055 | 649038 | + | GENE_00668 Prodigal: 2.6 | CDS | — | — | — | — | — | — | — | — | hypothetical protein |
| Contig1 | 649168 | 649665 | + | GENE_00669 Prodigal: 2.6 | CDS | — | — | PF07883.5 | — | — | — | — | — | Cupin domain protein |
| Contig1 | 650052 | 650468 | + | GENE_00670 Prodigal: 2.6 | CDS | — | — | — | — | — | — | — | — | hypothetical protein |
| Contig1 | 650508 | 651686 | + | GENE_00671 Prodigal: 2.6 | CDS | 1.6.99.- | — | — | — | P80861 | yjiD | — | — | NADH dehydrogenase-like protein YjlD |
| Contig1 | 651873 | 653270 | + | GENE_00672 Prodigal: 2.6 | CDS | 5.3.1.12 | — | — | — | O34808 | uxaC | — | — | Uronate isomerase |
| Contig1 | 653295 | 654686 | + | GENE_00673 Prodigal: 2.6 | CDS | — | — | — | — | O34961 | yjmB | — | — | putative symporter YjmB |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 654757 | 655755 | + | GENE_00674 | Prodigal: 2.6 | CDS | — | — | — | — | Q9JMQ1 | exuR | — | — | putative HTH-type transcriptional repressor ExuR |
| Contig1 | 655831 | 657264 | + | GENE_00675 | Prodigal: 2.6 | CDS | 1.1.1.58 | — | — | — | O34354 | uxaB | — | — | Altronate oxidoreductase |
| Contig1 | 657277 | 658770 | + | GENE_00676 | Prodigal: 2.6 | CDS | 4.2.1.7 | — | PF01925.13 | — | O34673 | uxaA | — | — | Altronate dehydratase |
| Contig1 | 658804 | 659568 | − | GENE_00677 | Prodigal: 2.6 | CDS | — | — | — | — | — | — | — | — | Sulfite exporter TauE/SafE |
| Contig1 | 659717 | 660184 | − | GENE_00678 | Prodigal: 2.6 | CDS | 3.1.-.- | — | PF05163.6 | — | — | — | — | — | DinB family protein |
| Contig1 | 660394 | 661524 | + | GENE_00679 | Prodigal: 2.6 | CDS | — | — | — | — | Q00828 | rapA_1 | — | — | Response regulator aspartate phosphatase A |
| Contig1 | 661514 | 661648 | + | GENE_00680 | Prodigal: 2.6 | CDS | — | — | — | — | — | — | — | — | hypothetical protein |
| Contig1 | 661790 | 662743 | + | GENE_00681 | Prodigal: 2.6 | CDS | 3.5.1.28 | — | — | — | P24808 | cwlA | — | — | N-acetylmuramoyl-L-alanine amidase CwlA precursor |
| Contig1 | 662782 | 663159 | − | GENE_00682 | Prodigal: 2.6 | CDS | — | — | — | — | — | — | — | — | hypothetical protein |
| Contig1 | 663268 | 663873 | + | GENE_00683 | Prodigal: 2.6 | CDS | — | — | — | — | — | — | — | — | hypothetical protein |
| Contig1 | 663863 | 664012 | − | GENE_00684 | Prodigal: 2.6 | CDS | — | — | — | — | — | — | — | — | hypothetical protein |
| Contig1 | 664028 | 664618 | − | GENE_00685 | Prodigal: 2.6 | CDS | — | — | — | — | — | — | — | — | hypothetical protein |
| Contig1 | 664767 | 665105 | − | GENE_00686 | Prodigal: 2.6 | CDS | — | — | — | — | P23789 | xre_1 | — | — | HTH-type transcriptional regulator Xre |
| Contig1 | 665297 | 665476 | + | GENE_00687 | Prodigal: 2.6 | CDS | — | — | — | — | — | — | — | — | hypothetical protein |
| Contig1 | 666193 | 666993 | + | GENE_00688 | Prodigal: 2.6 | CDS | — | — | — | MF_00377 | — | dnaA_1 | — | — | Chromosomal replication initiator protein DnaA |
| Contig1 | 666993 | 667160 | + | GENE_00689 | Prodigal: 2.6 | CDS | — | — | — | — | — | — | — | — | hypothetical protein |
| Contig1 | 667258 | 667599 | + | GENE_00690 | Prodigal: 2.6 | CDS | — | — | — | — | — | — | — | — | hypothetical protein |
| Contig1 | 667589 | 667792 | + | GENE_00691 | Prodigal: 2.6 | CDS | — | — | — | — | — | — | — | — | hypothetical protein |
| Contig1 | 667906 | 668418 | + | GENE_00692 | Prodigal: 2.6 | CDS | — | PRK06930 | — | — | — | — | — | — | positive control sigma-like factor |
| Contig1 | 668531 | 669328 | + | GENE_00693 | Prodigal: 2.6 | CDS | — | — | PF03592.10 | — | — | — | — | — | Terminase small subunit |
| Contig1 | 669325 | 670623 | + | GENE_00694 | Prodigal: 2.6 | CDS | — | — | PF04466.7 | — | — | — | — | — | Phage terminase large subunit |
| Contig1 | 670627 | 672051 | + | GENE_00695 | Prodigal: 2.6 | CDS | — | — | PF04860.6 | — | — | — | — | — | Phage portal protein |
| Contig1 | 672083 | 672928 | + | GENE_00696 | Prodigal: 2.6 | CDS | — | — | — | — | — | — | — | — | hypothetical protein |
| Contig1 | 672955 | 673890 | + | GENE_00697 | Prodigal: 2.6 | CDS | — | — | — | — | — | — | — | — | Phage-like element PBSX protein XkdG |
| Contig1 | 673907 | 674290 | + | GENE_00698 | Prodigal: 2.6 | CDS | — | — | — | — | — | — | — | — | XkdG protein |
| Contig1 | 674287 | 674643 | + | GENE_00699 | Prodigal: 2.6 | CDS | — | — | — | — | — | — | — | — | hypothetical protein |
| Contig1 | 674640 | 675143 | + | GENE_00700 | Prodigal: 2.6 | CDS | — | — | — | — | P54327 | xkdG | — | — | Phage-like element PBSX protein XkdH |
| Contig1 | 675140 | 675586 | + | GENE_00701 | Prodigal: 2.6 | CDS | — | — | — | — | P54328 | xkdH | — | — | hypothetical protein |
| Contig1 | 675583 | 675792 | + | GENE_00702 | Prodigal: 2.6 | CDS | — | — | — | — | — | — | — | — | hypothetical protein |
| Contig1 | 675792 | 677189 | + | GENE_00703 | Prodigal: 2.6 | CDS | — | — | PF04984.8 | — | — | — | — | — | Phage tail sheath protein |
| Contig1 | 677191 | 677634 | + | GENE_00704 | Prodigal: 2.6 | CDS | — | — | — | — | — | — | — | — | Phage-like element PBSX protein XkdM |
| Contig1 | 677710 | 678156 | + | GENE_00705 | Prodigal: 2.6 | CDS | — | — | PF08890.5 | — | P54332 | xkdM | — | — | Phage XkdN-like protein |
| Contig1 | 678180 | 678350 | + | GENE_00706 | Prodigal: 2.6 | CDS | — | — | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 678338 | 683377 | + | GENE_00707 | Prodigal: 2.6 | CDS | — | — | PF01464.14 | — | — | — | — | — | Transglycosylase SLT domain protein |
| Contig1 | 683370 | 684029 | + | GENE_00708 | Prodigal: 2.6 | CDS | — | PRK11198 | — | — | — | — | — | — | LysM domain/BON superfamily protein |
| Contig1 | 684043 | 685020 | + | GENE_00709 | Prodigal: 2.6 | CDS | — | — | PF05954.5 | — | — | — | — | — | Phage late control gene D protein (GPD) |
| Contig1 | 685020 | 685286 | + | GENE_00710 | Prodigal: 2.6 | CDS | — | — | — | — | — | — | — | — | hypothetical protein |
| Contig1 | 685390 | 685815 | + | GENE_00711 | Prodigal: 2.6 | CDS | — | — | — | — | — | — | — | — | hypothetical protein |
| Contig1 | 685808 | 686854 | + | GENE_00712 | Prodigal: 2.6 | CDS | — | — | PF04865.8 | — | — | — | — | — | Baseplate J-like protein |
| Contig1 | 686838 | 687416 | + | GENE_00713 | Prodigal: 2.6 | CDS | — | — | — | — | — | — | — | — | hypothetical protein |
| Contig1 | 687413 | 687685 | + | GENE_00714 | Prodigal: 2.6 | CDS | — | — | — | — | — | — | — | — | hypothetical protein |
| Contig1 | 687688 | 689277 | + | GENE_00715 | Prodigal: 2.6 | CDS | — | — | — | — | — | — | — | — | hypothetical protein |
| Contig1 | 689290 | 689715 | + | GENE_00716 | Prodigal: 2.6 | CDS | — | — | PF09636.4 | — | — | — | — | — | XkdW protein |
| Contig1 | 689720 | 689917 | + | GENE_00717 | Prodigal: 2.6 | CDS | — | — | — | — | — | — | — | — | hypothetical protein |
| Contig1 | 689974 | 690735 | + | GENE_00718 | Prodigal: 2.6 | CDS | — | — | — | — | — | — | — | — | hypothetical protein |
| Contig1 | 690787 | 691050 | + | GENE_00719 | Prodigal: 2.6 | CDS | — | — | PF10779.3 | — | — | — | — | — | Haemolysin XhlA |
| Contig1 | 691064 | 691327 | + | GENE_00720 | Prodigal: 2.6 | CDS | — | — | PF04688.7 | — | — | — | — | — | Phage lysis protein, holin |
| Contig1 | 691341 | 692219 | + | GENE_00721 | Prodigal: 2.6 | CDS | 3.5.1.28 | — | — | — | P39800 | xlyA | — | — | N-acetylmuramoyl-L-alanine amidase XlyA precursor |
| Contig1 | 692476 | 692646 | − | GENE_00722 | Prodigal: 2.6 | CDS | — | — | — | — | O34800 | spoIISB | — | — | Stage II sporulation protein SB |
| Contig1 | 692647 | 693393 | − | GENE_00723 | Prodigal: 2.6 | CDS | — | — | — | — | O34853 | spoIISA | — | — | Stage II sporulation protein SA |
| Contig1 | 693498 | 694496 | − | GENE_00724 | Prodigal: 2.6 | CDS | — | — | — | — | P0AFJ7 | pitA | — | — | Low-affinity inorganic phosphate transporter 1 |
| Contig1 | 694509 | 695126 | − | GENE_00725 | Prodigal: 2.6 | CDS | — | — | — | — | O30498 | — | — | — | Putative pit accessory protein |
| Contig1 | 695412 | 696728 | − | GENE_00726 | Prodigal: 2.6 | CDS | — | — | — | — | O34739 | steT | — | — | Serine/threonine exchanger SteT |
| Contig1 | 697052 | 698002 | + | GENE_00727 | Prodigal: 2.6 | CDS | 1.13.11.- | — | — | — | O34689 | mhqA | — | — | Putative ring-cleaving dioxygenase MhqA |
| Contig1 | 698186 | 700324 | + | GENE_00728 | Prodigal: 2.6 | CDS | 2.4.2.43 | — | — | MF_01165 | — | arnT | — | — | Undecaprenyl phosphate-alpha-4-amino-4-deoxy-L-arabinose arabinosyl transferase |
| Contig1 | 700336 | 701307 | + | GENE_00729 | Prodigal: 2.6 | CDS | — | — | — | — | P77293 | — | — | Bactoprenol glucosyl transferase homolog from prophage CPS-53 | hypothetical protein |
| Contig1 | 701394 | 701570 | − | GENE_00730 | Prodigal: 2.6 | CDS | — | — | — | — | — | — | — | — | hypothetical protein |
| Contig1 | 701671 | 703023 | − | GENE_00731 | Prodigal: 2.6 | CDS | 3.4.21.10 | — | — | — | O34358 | htrA_1 | — | — | Serine protease Do-like HtrA |
| Contig1 | 703308 | 704867 | + | GENE_00732 | Prodigal: 2.6 | CDS | — | — | — | — | P31474 | hsrA_1 | — | — | putative transport protein HsrA |
| Contig1 | 705023 | 705847 | + | GENE_00733 | Prodigal: 2.6 | CDS | 3.4.11.- | — | — | — | P26902 | dppA | — | — | D-aminopeptidase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 705862 | 706788 | + | GENE_00734 | Prodigal: 2.6 | CDS | — | — | — | — | P26903 | dppB_3 | — | — | Dipeptide transport system permease protein DppB |
| Contig1 | 706794 | 707741 | + | GENE_00735 | Prodigal: 2.6 | CDS | — | — | — | — | P26904 | dppC | — | — | Dipeptide transport system permease protein DppC |
| Contig1 | 707747 | 708775 | + | GENE_00736 | Prodigal: 2.6 | CDS | — | — | — | — | P24136 | oppD_4 | — | — | Oligopeptide transport ATP-binding protein OppD |
| Contig1 | 708772 | 710391 | + | GENE_00737 | Prodigal: 2.6 | CDS | — | — | — | — | P26906 | dppE | — | — | Dipeptide-binding protein DppE precursor |
| Contig1 | 710479 | 711414 | + | GENE_00738 | Prodigal: 2.6 | CDS | 3.4.16.- | — | — | — | O34851 | ykfA_1 | — | — | putative murein peptide carboxypeptidase |
| Contig1 | 711421 | 712518 | + | GENE_00739 | Prodigal: 2.6 | CDS | 5.1.1.- | — | — | — | O34508 | ykfB | — | — | L-Ala-D/L-Glu epimerase |
| Contig1 | 712515 | 713414 | + | GENE_00740 | Prodigal: 2.6 | CDS | 3.4.-.- | — | — | — | O35010 | ykfC | — | — | Gamma-D-glutamyl-L-lysine endopeptidase |
| Contig1 | 713418 | 714389 | + | GENE_00741 | Prodigal: 2.6 | CDS | — | — | — | — | P24137 | oppF_5 | — | — | Oligopeptide transport ATP-binding protein OppF |
| Contig1 | 714416 | 715465 | − | GENE_00742 | Prodigal: 2.6 | CDS | 3.1.1.31 | — | — | — | O34499 | pgl | — | — | 6-phosphogluconolactonase |
| Contig1 | 715536 | 716396 | − | GENE_00743 | Prodigal: 2.6 | CDS | 3.5.3.18 | — | — | — | Q9I4E3 | — | — | — | N(G),N(G)-dimethylarginine dimethylaminohydrolase |
| Contig1 | 716585 | 717103 | + | GENE_00744 | Prodigal: 2.6 | CDS | 3.1.2.- | — | — | — | P44886 | — | — | — | putative acyl-CoA thioester hydrolase |
| Contig1 | 717203 | 717748 | + | GENE_00745 | Prodigal: 2.6 | CDS | — | PRK09585 | — | — | — | — | — | — | anhydro-N-acetyl-muramic acid kinase |
| Contig1 | 717936 | 718274 | + | GENE_00746 | Prodigal: 2.6 | CDS | — | — | — | — | P49856 | ykkC | — | — | Multidrug resistance protein YkkC |
| Contig1 | 718274 | 718588 | + | GENE_00747 | Prodigal: 2.6 | CDS | — | — | — | — | P49857 | ykkD | — | — | Multidrug resistance protein YkkD |
| Contig1 | 718662 | 719564 | + | GENE_00748 | Prodigal: 2.6 | CDS | 3.5.1.10 | — | — | — | P37051 | purU | — | — | Formyltetrahydrofolate deformylase |
| Contig1 | 719934 | 721046 | + | GENE_00749 | Prodigal: 2.6 | CDS | 2.7.2.11 | — | — | — | P39820 | proB_1 | — | — | Glutamate 5-kinase 1 |
| Contig1 | 721043 | 722290 | + | GENE_00750 | Prodigal: 2.6 | CDS | 1.2.1.41 | — | — | — | Q9WYC9 | proA | — | — | Gamma-glutamyl phosphate reductase |
| Contig1 | 722404 | 722829 | + | GENE_00751 | Prodigal: 2.6 | CDS | — | — | — | — | O34762 | ohrA | — | — | Organic hydroperoxide resistance protein OhrA |
| Contig1 | 722857 | 723381 | − | GENE_00752 | Prodigal: 2.6 | CDS | — | — | — | — | O34777 | ohrR_2 | — | — | Organic hydroperoxide resistance transcriptional regulator |
| Contig1 | 723441 | 723851 | + | GENE_00753 | Prodigal: 2.6 | CDS | — | — | — | — | P80242 | ohrB_1 | — | — | Organic hydroperoxide resistance protein OhrB |

TABLE 5-continued

| #ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 723992 | 724576 | + | GENE_00754 | Prodigal: 2.6 | CDS | — | — | — | — | P27951 | bag | — | — | IgA FC receptor precursor |
| Contig1 | 724596 | 725060 | + | GENE_00755 | Prodigal: 2.6 | CDS | — | — | — | — | — | — | — | — | hypothetical protein |
| Contig1 | 725065 | 726192 | + | GENE_00756 | Prodigal: 2.6 | CDS | 2.4.1.- | — | — | — | O31986 | sunS_2 | — | — | SPBc2 prophage-derived glycosyltransferase SunS |
| Contig1 | 726214 | 727329 | − | GENE_00757 | Prodigal: 2.6 | CDS | — | — | PF01391.12 | — | — | — | — | — | Collagen triple helix repeat (20 copies) |
| Contig1 | 727570 | 728169 | − | GENE_00758 | Prodigal: 2.6 | CDS | — | — | — | — | Q47142 | hcaT_1 | — | — | putative 3-phenylpropionic acid transporter |
| Contig1 | 728147 | 728767 | − | GENE_00759 | Prodigal: 2.6 | CDS | — | — | — | — | Q47142 | hcaT_2 | — | — | putative 3-phenylpropionic acid transporter |
| Contig1 | 728819 | 729520 | + | GENE_00760 | Prodigal: 2.6 | CDS | — | — | — | — | P0A9E9 | yeiL | — | — | Regulatory protein YeiL |
| Contig1 | 729567 | 731855 | − | GENE_00761 | Prodigal: 2.6 | CDS | 2.1.1.14 | — | — | — | P80877 | metE_1 | — | — | 5-methyltetra-hydropteroyl-triglutamate-homocysteine methyltransferase |
| Contig1 | 732233 | 733192 | − | GENE_00762 | Prodigal: 2.6 | CDS | 3.4.21.- | — | — | — | P11018 | isp | — | — | Major intracellular serine protease precursor |
| Contig1 | 733412 | 734245 | + | GENE_00763 | Prodigal: 2.6 | CDS | — | — | — | — | O34860 | rsbRB | — | — | RsbT co-antagonist protein RsbRB |
| Contig1 | 734291 | 735052 | − | GENE_00764 | Prodigal: 2.6 | CDS | — | — | — | — | O34572 | ykoC | — | — | Putative HMP/thiamine permease protein YkoC |
| Contig1 | 735027 | 736664 | − | GENE_00765 | Prodigal: 2.6 | CDS | 3.6.3.- | — | — | — | O34362 | ykoD | — | — | Putative HMP/thiamine import ATP-binding protein YkoD |
| Contig1 | 736651 | 737250 | − | GENE_00766 | Prodigal: 2.6 | CDS | — | — | — | — | O34738 | ykoE | — | — | Putative HMP/thiamine permease protein YkoE |
| Contig1 | 737695 | 738957 | + | GENE_00767 | Prodigal: 2.6 | CDS | 3.2.-.- | — | — | — | O05495 | ydhD | — | — | Putative sporulation-specific glycosylase YdhD |
| Contig1 | 739048 | 739185 | + | GENE_00768 | Prodigal: 2.6 | CDS | — | — | PF11132.2 | — | — | — | — | — | Transcriptional regulator protein (SplA) |
| Contig1 | 739692 | 741047 | + | GENE_00769 | Prodigal: 2.6 | CDS | — | — | — | — | Q830V1 | mgtE | — | — | Magnesium transporter MgtE |
| Contig1 | 741083 | 741415 | − | GENE_00770 | Prodigal: 2.6 | CDS | — | — | — | — | Q45666 | tnrA | — | — | HTH-type transcriptional regulator TnrA |
| Contig1 | 741610 | 741765 | + | GENE_00771 | Prodigal: 2.6 | CDS | — | — | — | — | — | — | — | — | hypothetical protein |
| Contig1 | 741854 | 742036 | + | GENE_00772 | Prodigal: 2.6 | CDS | — | — | — | — | O34763 | ykoL | — | — | Stress response protein YkoL |
| Contig1 | 742179 | 742643 | + | GENE_00773 | Prodigal: 2.6 | CDS | — | — | — | — | O31672 | mhqR_1 | — | — | HTH-type transcriptional regulator MhqR |
| Contig1 | 742822 | 743376 | + | GENE_00774 | Prodigal: 2.6 | CDS | — | — | — | — | — | — | — | — | hypothetical protein |
| Contig1 | 743386 | 745221 | − | GENE_00775 | Prodigal: 2.6 | CDS | 6.5.1.1 | — | — | — | O34398 | ykoU | — | — | putative ATP-dependent DNA ligase YkoU |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 745224 | 746105 | − | GENE_00776 | Prodigal: 2.6 | CDS | — | — | — | — | O34859 | ykoV | — | — | putative DNA repair protein YkoV |
| Contig1 | 746771 | 747340 | + | GENE_00777 | Prodigal: 2.6 | CDS | — | PRK10847 | — | — | — | — | — | — | hypothetical protein |
| Contig1 | 747587 | 748369 | + | GENE_00778 | Prodigal: 2.6 | CDS | — | — | PF03741.10 | — | — | — | — | — | Integral membrane protein TerC family protein |
| Contig1 | 748646 | 749401 | + | GENE_00779 | Prodigal: 2.6 | CDS | — | — | — | — | O31654 | sigI | — | — | RNA polymerase sigma factor SigI |
| Contig1 | 749398 | 750576 | + | GENE_00780 | Prodigal: 2.6 | CDS | — | — | — | — | O31655 | rsgI | — | — | Anti-sigma-I factor RsgI |
| Contig1 | 750583 | 750777 | − | GENE_00781 | Prodigal: 2.6 | CDS | — | — | — | — | P04833 | sspD | — | — | Small, acid-soluble spore protein D |
| Contig1 | 750913 | 751614 | − | GENE_00782 | Prodigal: 2.6 | CDS | 3.4.24.- | — | — | — | — | — | — | — | hypothetical protein |
| Contig1 | 751763 | 752656 | + | GENE_00783 | Prodigal: 2.6 | CDS | — | — | — | — | P23894 | htpX2 | — | — | Protease HtpX |
| Contig1 | 752816 | 754168 | + | GENE_00784 | Prodigal: 2.6 | CDS | — | — | — | — | O32081 | ktrB | — | — | Ktr system potassium uptake protein B |
| Contig1 | 754264 | 754938 | − | GENE_00785 | Prodigal: 2.6 | CDS | — | — | — | — | — | — | — | — | hypothetical protein |
| Contig1 | 754940 | 755110 | + | GENE_00786 | Prodigal: 2.6 | CDS | — | — | — | — | — | — | — | — | hypothetical protein |
| Contig1 | 755150 | 756172 | + | GENE_00787 | Prodigal: 2.6 | CDS | — | — | — | — | — | — | — | — | Acyltransferase family protein |
| Contig1 | 756428 | 758647 | + | GENE_00788 | Prodigal: 2.6 | CDS | 2.7.13.3 | — | — | — | O31661 | kinE | — | — | Sporulation kinase E |
| Contig1 | 758644 | 759141 | + | GENE_00789 | Prodigal: 2.6 | CDS | 2.1.1.63 | — | PF01757.16 | — | P11742 | ogt_1 | — | — | Methylated-DNA--protein-cysteine methyltransferase, constitutive |
| Contig1 | 759232 | 759351 | + | GENE_00790 | Prodigal: 2.6 | CDS | — | — | — | — | — | — | — | — | hypothetical protein |
| Contig1 | 759383 | 760444 | − | GENE_00791 | Prodigal: 2.6 | CDS | 5.3.1.23 | — | — | — | O31662 | mtnA | — | — | Methylthioribose-1-phosphate isomerase |
| Contig1 | 760451 | 761635 | − | GENE_00792 | Prodigal: 2.6 | CDS | 2.7.1.100 | — | — | — | O31663 | mtnK | — | — | Methylthioribose kinase |
| Contig1 | 761993 | 762772 | − | GENE_00793 | Prodigal: 2.6 | CDS | 3.5.1.111 | — | — | — | Q93NG1 | — | — | — | 2-oxoglutaramate amidase |
| Contig1 | 762865 | 764037 | + | GENE_00794 | Prodigal: 2.6 | CDS | 2.6.1.83 | — | — | — | A0LEA5 | dapL_1 | — | — | LL-diaminopimelate aminotransferase |
| Contig1 | 764279 | 765493 | + | GENE_00795 | Prodigal: 2.6 | CDS | 5.3.2.5 | — | — | — | O31666 | mtnW | — | — | 2,3-diketo-5-methylthiopentyl-1-phosphate enolase |
| Contig1 | 765490 | 766194 | + | GENE_00796 | Prodigal: 2.6 | CDS | 3.1.3.87 | — | — | — | O31667 | mtnX | — | — | 2-hydroxy-3-keto-5-methylthiopentenyl-1-phosphate phosphatase |
| Contig1 | 766152 | 766781 | + | GENE_00797 | Prodigal: 2.6 | CDS | 4.2.1.109 | — | — | — | O31668 | mtnB | — | — | Methylthioribulose-1-phosphate dehydratase |
| Contig1 | 766797 | 767333 | + | GENE_00798 | Prodigal: 2.6 | CDS | 1.13.11.54 | — | — | — | Q9ZFE7 | mtnD | — | — | Acireductone dioxygenase |
| Contig1 | 767614 | 767874 | + | GENE_00799 | Prodigal: 2.6 | CDS | 3.1.3.- | — | — | — | P05043 | spo0E | — | — | Aspartyl-phosphate phosphatase Spo0E |
| Contig1 | 768085 | 769446 | − | GENE_00800 | Prodigal: 2.6 | CDS | 2.7.13.3 | — | — | — | O31671 | kinD | — | — | Sporulation kinase D |
| Contig1 | 769800 | 770246 | + | GENE_00801 | Prodigal: 2.6 | CDS | — | — | — | — | O31672 | mhqR_2 | — | — | HTH-type transcriptional regulator MhqR |
| Contig1 | 770282 | 771073 | − | GENE_00802 | Prodigal: 2.6 | CDS | — | — | — | — | P56427 | motB_1 | — | — | Motility protein B |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 771045 | 771869 | − | GENE_00803 | Prodigal: 2.6 | CDS | — | — | — | — | O06873 | pomA_1 | — | — | Chemotaxis protein PomA |
| Contig1 | 772029 | 774125 | − | GENE_00804 | Prodigal: 2.6 | CDS | — | — | — | — | O31673 | clpE | — | — | ATP-dependent Clp protease ATP-binding subunit ClpE |
| Contig1 | 774527 | 775564 | + | GENE_00805 | Prodigal: 2.6 | CDS | — | — | — | — | — | — | — | — | hypothetical protein |
| Contig1 | 775662 | 776783 | + | GENE_00806 | Prodigal: 2.6 | CDS | — | — | — | — | — | — | — | — | hypothetical protein |
| Contig1 | 777033 | 777692 | + | GENE_00807 | Prodigal: 2.6 | CDS | 6.3.4.20 | — | — | — | O31675 | queC | — | — | 7-cyano-7-deazaguanine synthase |
| Contig1 | 777693 | 778133 | + | GENE_00808 | Prodigal: 2.6 | CDS | 4.1.2.50 | — | — | — | O31676 | queD | — | — | 6-carboxy-5,6,7,8-tetrahydropterin synthase |
| Contig1 | 778126 | 778857 | + | GENE_00809 | Prodigal: 2.6 | CDS | 4.3.99.3 | — | — | — | O31677 | queE_2 | — | — | 7-carboxy-7-deazaguanine synthase |
| Contig1 | 778875 | 779369 | + | GENE_00810 | Prodigal: 2.6 | CDS | 1.7.1.13 | — | — | — | O31678 | queF | — | — | NADPH-dependent 7-cyano-7-deazaguanine reductase |
| Contig1 | 780085 | 780564 | + | GENE_00811 | Prodigal: 2.6 | CDS | — | — | PF00583.18 | — | — | — | — | — | Acetyltransferase (GNAT) family protein |
| Contig1 | 781116 | 781391 | + | GENE_00812 | Prodigal: 2.6 | CDS | — | — | — | — | — | — | — | — | hypothetical protein |
| Contig1 | 781464 | 781649 | − | GENE_00813 | Prodigal: 2.6 | CDS | — | — | — | — | — | — | — | — | hypothetical protein |
| Contig1 | 781813 | 782007 | + | GENE_00814 | Prodigal: 2.6 | CDS | — | — | — | — | — | — | — | — | hypothetical protein |
| Contig1 | 782281 | 782904 | + | GENE_00815 | Prodigal: 2.6 | CDS | — | — | — | — | P0A3V0 | sleB_1 | — | — | Spore cortex-lytic enzyme precursor |
| Contig1 | 783020 | 784360 | + | GENE_00816 | Prodigal: 2.6 | CDS | — | — | — | — | O31686 | ykvU | — | — | Sporulation protein YkvU |
| Contig1 | 784423 | 784917 | + | GENE_00817 | Prodigal: 2.6 | CDS | — | — | — | — | O31687 | stoA | — | — | Sporulation thiol-disulfide oxidoreductase A precursor |
| Contig1 | 785161 | 787074 | + | GENE_00818 | Prodigal: 2.6 | CDS | 3.6.3.- | — | — | — | O31688 | zosA | — | — | Zinc-transporting ATPase |
| Contig1 | 787187 | 788281 | + | GENE_00819 | Prodigal: 2.6 | CDS | 3.4.-.- | — | — | — | Q7A552 | — | — | — | putative peptidase |
| Contig1 | 788339 | 788464 | − | GENE_00820 | Prodigal: 2.6 | CDS | — | — | — | — | — | — | — | — | hypothetical protein |
| Contig1 | 788564 | 789529 | + | GENE_00821 | Prodigal: 2.6 | CDS | — | — | — | — | P37517 | ccpB_1 | — | — | Catabolite control protein B |
| Contig1 | 789601 | 790446 | + | GENE_00822 | Prodigal: 2.6 | CDS | — | — | — | — | O31691 | glcT | — | — | PtsGHI operon antiterminator |
| Contig1 | 790677 | 792773 | + | GENE_00823 | Prodigal: 2.6 | CDS | — | — | — | — | P20166 | ptsG_2 | — | — | PTS system glucose-specific EIICBA component |
| Contig1 | 792870 | 793136 | + | GENE_00824 | Prodigal: 2.6 | CDS | 2.7.11.- | — | — | — | P08877 | ptsH | — | — | Phosphocarrier protein HPr |
| Contig1 | 793136 | 794851 | + | GENE_00825 | Prodigal: 2.6 | CDS | 27.3.9 | — | — | — | P08838 | ptsI | — | — | Phosphoenolpyruvate-protein phosphotransferase |
| Contig1 | 794939 | 795178 | + | GENE_00826 | Prodigal: 2.6 | CDS | — | — | PF11132.2 | — | — | — | — | — | Transcriptional regulator protein (SplA) |
| Contig1 | 795265 | 796293 | + | GENE_00827 | Prodigal: 2.6 | CDS | 4.1.99.14 | — | — | — | P37956 | splB | — | — | Spore photoproduct lyase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 796421 | 798388 | + | GENE_00828 | Prodigal: 2.6 | CDS | — | — | — | — | P54576 | mcpC | — | — | Methyl-accepting chemotaxis protein McpC |
| Contig1 | 798469 | 799335 | + | GENE_00829 | Prodigal: 2.6 | CDS | 1.1.1.60 | — | — | — | P0ABQ2 | garR_2 | — | — | 2-hydroxy-3-oxopropionate reductase |
| Contig1 | 799373 | 800149 | − | GENE_00830 | Prodigal: 2.6 | CDS | — | — | PF00188.20 | — | — | — | — | — | Cysteine-rich secretory protein family protein |
| Contig1 | 800486 | 802618 | + | GENE_00831 | Prodigal: 2.6 | CDS | — | — | — | — | Q796K8 | pbpH_1 | — | — | Penicillin-binding protein H |
| Contig1 | 802796 | 804616 | + | GENE_00832 | Prodigal: 2.6 | CDS | 2.7.13.3 | — | — | — | P16497 | kinA_1 | — | — | Sporulation kinase A |
| Contig1 | 804642 | 805811 | − | GENE_00833 | Prodigal: 2.6 | CDS | 2.6.1.- | — | — | — | P16524 | patA_1 | — | — | Putative N-acetyl-LL-diaminopimelate aminotransferase |
| Contig1 | 806012 | 806173 | − | GENE_00834 | Prodigal: 2.6 | CDS | — | — | — | — | — | — | — | — | hypothetical protein |
| Contig1 | 806362 | 807273 | + | GENE_00835 | Prodigal: 2.6 | CDS | — | — | — | — | P37599 | cheV | — | — | Chemotaxis protein CheV |
| Contig1 | 807316 | 807780 | − | GENE_00836 | Prodigal: 2.6 | CDS | — | — | — | — | — | — | — | — | hypothetical protein |
| Contig1 | 807903 | 809195 | − | GENE_00837 | Prodigal: 2.6 | CDS | — | PRK08633 | — | — | — | — | — | — | 2-acyl-glycerophosphoethanolamine acyltransferase |
| Contig1 | 809271 | 809771 | − | GENE_00838 | Prodigal: 2.6 | CDS | 2.-.-.- | — | — | — | O34816 | ykuD_1 | — | — | Putative L,D-transpeptidase YkuD |
| Contig1 | 809840 | 810703 | − | GENE_00839 | Prodigal: 2.6 | CDS | 3.1.-.- | — | — | — | Q9PP77 | — | — | — | putative metallophosphoesterase |
| Contig1 | 810844 | 811608 | + | GENE_00840 | Prodigal: 2.6 | CDS | 1.3.1.34 | — | — | — | O34717 | fadH | — | — | putative 2,4-dienoyl-CoA reductase |
| Contig1 | 811719 | 811958 | + | GENE_00841 | Prodigal: 2.6 | CDS | — | — | — | — | — | — | — | — | hypothetical protein |
| Contig1 | 812411 | 813631 | + | GENE_00842 | Prodigal: 2.6 | CDS | — | — | — | — | O35014 | ykuI | — | — | putative EAL-domain containing protein YkuI |
| Contig1 | 814076 | 814315 | + | GENE_00843 | Prodigal: 2.6 | CDS | — | — | — | — | — | — | — | — | hypothetical protein |
| Contig1 | 814438 | 814956 | + | GENE_00844 | Prodigal: 2.6 | CDS | — | — | — | — | — | — | — | — | hypothetical protein |
| Contig1 | 815097 | 815288 | + | GENE_00845 | Prodigal: 2.6 | CDS | — | — | — | — | — | — | — | — | hypothetical protein |
| Contig1 | 815432 | 815875 | + | GENE_00846 | Prodigal: 2.6 | CDS | — | — | — | — | O31698 | ykuL | — | — | CBS domain-containing protein YkuL |
| Contig1 | 816016 | 816897 | + | GENE_00847 | Prodigal: 2.6 | CDS | — | — | — | — | P06614 | cysB_1 | — | — | HTH-type transcriptional regulator CysB |
| Contig1 | 817009 | 817482 | + | GENE_00848 | Prodigal: 2.6 | CDS | — | — | — | — | Q01095 | — | — | — | Flavodoxin |
| Contig1 | 817472 | 818365 | + | GENE_00849 | Prodigal: 2.6 | CDS | — | — | — | — | — | — | — | — | hypothetical protein |
| Contig1 | 818392 | 818847 | + | GENE_00850 | Prodigal: 2.6 | CDS | — | — | — | — | P00323 | — | — | — | Flavodoxin |
| Contig1 | 818929 | 819639 | + | GENE_00851 | Prodigal: 2.6 | CDS | 2.3.1.89 | — | — | — | O34981 | dapH_1 | — | — | 2,3,4,5-tetrahydropyridine-2,6-dicarboxylate N-acetyltransferase |
| Contig1 | 819710 | 820834 | + | GENE_00852 | Prodigal: 2.6 | CDS | 3.5.1.47 | — | — | — | O34916 | ykuR | — | — | N-acetyldiaminopimelate deacetylase |
| Contig1 | 820895 | 821140 | + | GENE_00853 | Prodigal: 2.6 | CDS | — | — | — | — | — | — | — | — | hypothetical protein |
| Contig1 | 821174 | 821980 | − | GENE_00854 | Prodigal: 2.6 | CDS | — | PRK03094 | — | — | O34897 | ykuT | — | — | putative MscS family protein YkuT |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 822268 | 822726 | + | GENE_00855 | Prodigal: 2.6 | CDS | 1.8.-.- | — | — | — | O31699 | ykuV | — | — | Thiol-disulfide oxidoreductase YkuV |
| Contig1 | 823178 | 823774 | + | GENE_00856 | Prodigal: 2.6 | CDS | — | — | — | — | O34857 | rok | — | — | Repressor rok |
| Contig1 | 823795 | 824787 | − | GENE_00857 | Prodigal: 2.6 | CDS | — | — | — | — | O31700 | — | — | — | Sporulation protein cse15 |
| Contig1 | 824933 | 825535 | + | GENE_00858 | Prodigal: 2.6 | CDS | 2.7.7.77 | — | — | — | P65405 | mobA | — | — | putative molybdenum cofactor guanylyltransferase |
| Contig1 | 825587 | 826606 | + | GENE_00859 | Prodigal: 2.6 | CDS | 2.7.7.73 | — | — | — | P30138 | thiF_2 | — | — | Sulfur carrier protein ThiS adenylyltransferase |
| Contig1 | 826624 | 827916 | + | GENE_00860 | Prodigal: 2.6 | CDS | 2.10.1.1 | — | — | — | P99139 | moeA | — | — | Molybdopterin molybdenumtransferase |
| Contig1 | 827877 | 828398 | + | GENE_00861 | Prodigal: 2.6 | CDS | — | — | — | — | P44902 | mobB | — | — | Molybdopterin-guanine dinucleotide biosynthesis adapter protein |
| Contig1 | 828399 | 828869 | + | GENE_00862 | Prodigal: 2.6 | CDS | 2.8.1.12 | — | — | — | P65401 | moaE | — | — | Molybdopterin synthase catalytic subunit |
| Contig1 | 828866 | 829099 | + | GENE_00863 | Prodigal: 2.6 | CDS | — | — | — | — | P30748 | moaD | — | — | Molybdopterin synthase sulfur carrier subunit |
| Contig1 | 829423 | 830121 | + | GENE_00864 | Prodigal: 2.6 | CDS | — | — | PF04893.11 | — | — | — | — | — | YipI domain protein |
| Contig1 | 830123 | 831259 | + | GENE_00865 | Prodigal: 2.6 | CDS | — | — | — | — | O31710 | yknX | — | — | Putative efflux system component YknX |
| Contig1 | 831260 | 831952 | + | GENE_00866 | Prodigal: 2.6 | CDS | 3.6.3.- | — | — | — | P75831 | macB_1 | — | — | Macrolide export ATP-binding/permease protein MacB |
| Contig1 | 831949 | 833142 | + | GENE_00867 | Prodigal: 2.6 | CDS | — | — | — | — | O31712 | yknZ | — | — | putative ABC transporter permease YknZ |
| Contig1 | 833424 | 834179 | + | GENE_00868 | Prodigal: 2.6 | CDS | — | — | — | — | P67744 | lacR_2 | — | — | Lactose phosphotransferase system repressor |
| Contig1 | 834176 | 835087 | + | GENE_00869 | Prodigal: 2.6 | CDS | 2.7.1.144 | — | — | — | Q833W9 | lacC | — | — | Tagatose-6-phosphate kinase |
| Contig1 | 835102 | 837006 | + | GENE_00870 | Prodigal: 2.6 | CDS | — | — | — | — | P71012 | fruA | — | — | PTS system fructose-specific EIIABC component |
| Contig1 | 837137 | 837718 | + | GENE_00871 | Prodigal: 2.6 | CDS | 3.4.21.89 | — | — | — | P71013 | sipT | — | — | Signal peptidase I T |
| Contig1 | 837756 | 838025 | − | GENE_00872 | Prodigal: 2.6 | CDS | — | — | — | — | — | — | — | — | hypothetical protein |
| Contig1 | 838188 | 839807 | + | GENE_00873 | Prodigal: 2.6 | CDS | — | — | — | — | P63389 | yheS_4 | — | — | putative ABC transporter ATP-binding protein YheS |
| Contig1 | 839920 | 840828 | + | GENE_00874 | Prodigal: 2.6 | CDS | 1.1.1.169 | — | — | — | P37402 | panE_1 | — | — | 2-dehydropantoate 2-reductase |
| Contig1 | 840858 | 842090 | − | GENE_00875 | Prodigal: 2.6 | CDS | 3.4.11.- | — | — | — | P24828 | — | — | — | Aminopeptidase 2 |
| Contig1 | 842191 | 842325 | − | GENE_00876 | Prodigal: 2.6 | CDS | — | — | — | — | — | — | — | — | hypothetical protein |
| Contig1 | 842397 | 843416 | − | GENE_00877 | Prodigal: 2.6 | CDS | — | — | — | — | P0A9X4 | mreB_1 | — | — | Rod shape-determining protein MreB |
| Contig1 | 843673 | 843957 | + | GENE_00878 | Prodigal: 2.6 | CDS | — | — | — | — | P39758 | abh | — | — | Putative transition state regulator Abh |
| Contig1 | 844615 | 845433 | + | GENE_00879 | Prodigal: 2.6 | CDS | 2.7.13.3 | — | — | — | P16497 | kinA_2 | — | — | Sporulation kinase A |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 845435 | 846262 | + | GENE_00880 | Prodigal: 2.6 | CDS | 2.3.2.- | — | — | — | P39759 | ykqA | — | — | Putative gamma-glutamylcyclotransferase YkqA |
| Contig1 | 846303 | 846968 | + | GENE_00881 | Prodigal: 2.6 | CDS | — | — | — | — | O32080 | ktrA_1 | — | — | Ktr system potassium uptake protein A |
| Contig1 | 847117 | 848850 | – | GENE_00882 | Prodigal: 2.6 | CDS | 3.5.4.2 | — | — | — | P39761 | adeC | — | — | Adenine deaminase |
| Contig1 | 848882 | 850549 | – | GENE_00883 | Prodigal: 2.6 | CDS | 3.1.-.- | — | — | — | Q45493 | rnjA | — | — | Ribonuclease J 1 |
| Contig1 | 850555 | 850767 | – | GENE_00884 | Prodigal: 2.6 | CDS | — | — | — | — | — | — | — | — | hypothetical protein |
| Contig1 | 851119 | 851892 | + | GENE_00885 | Prodigal: 2.6 | CDS | — | — | — | — | Q5XAQ1 | — | — | — | Putative bifunctional phosphatase/peptidyl-prolyl cis-trans isomerase |
| Contig1 | 851928 | 852482 | – | GENE_00886 | Prodigal: 2.6 | CDS | 3.5.1.88 | — | — | — | Q45495 | defB | — | — | Peptide deformylase 2 |
| Contig1 | 852595 | 852771 | – | GENE_00887 | Prodigal: 2.6 | CDS | — | — | PF09680.4 | — | — | — | — | — | Protein of unknown function (Tiny TM bacil1) |
| Contig1 | 853012 | 853656 | + | GENE_00888 | Prodigal: 2.6 | CDS | — | — | PF10368.3 | — | — | — | — | — | Putative cell-wall binding lipoprotein |
| Contig1 | 854104 | 856410 | + | GENE_00889 | Prodigal: 2.6 | CDS | — | — | — | — | A7A4Y0 | baeE_1 | — | — | Polyketide biosynthesis protein BaeE |
| Contig1 | 856432 | 868686 | + | GENE_00890 | Prodigal: 2.6 | CDS | — | — | — | — | P40806 | pksJ_1 | — | — | Polyketide synthase PksJ |
| Contig1 | 868686 | 873455 | + | GENE_00891 | Prodigal: 2.6 | CDS | — | — | — | — | Q05470 | pksL_1 | — | — | Polyketide synthase PksL |
| Contig1 | 873503 | 875746 | + | GENE_00892 | Prodigal: 2.6 | CDS | — | — | — | — | Q05470 | pksL_2 | — | — | Polyketide synthase PksL |
| Contig1 | 875692 | 882210 | + | GENE_00893 | Prodigal: 2.6 | CDS | 2.3.1.- | — | — | — | O31782 | pksN_1 | — | — | Polyketide synthase PksN |
| Contig1 | 882203 | 889204 | + | GENE_00894 | Prodigal: 2.6 | CDS | — | — | — | — | P40806 | pksJ_2 | — | — | Polyketide synthase PksJ |
| Contig1 | 889228 | 894939 | + | GENE_00895 | Prodigal: 2.6 | CDS | — | — | — | — | Q05470 | pksL_3 | — | — | Polyketide synthase PksL |
| Contig1 | 894939 | 902318 | + | GENE_00896 | Prodigal: 2.6 | CDS | — | — | — | — | Q05470 | pksL_4 | — | — | Polyketide synthase PksL |
| Contig1 | 902369 | 906223 | + | GENE_00897 | Prodigal: 2.6 | CDS | — | — | — | — | P40806 | pksJ_3 | — | — | Polyketide synthase PksJ |
| Contig1 | 906256 | 907347 | + | GENE_00898 | Prodigal: 2.6 | CDS | — | — | — | — | O31773 | pbpX_1 | — | — | Putative penicillin-binding protein PbpX |
| Contig1 | 907819 | 908934 | + | GENE_00899 | Prodigal: 2.6 | CDS | 1.2.4.1 | — | — | — | P21881 | pdhA | — | — | Pyruvate dehydrogenase E1 component subunit alpha |
| Contig1 | 908938 | 909915 | + | GENE_00900 | Prodigal: 2.6 | CDS | 1.2.4.1 | — | — | — | P21874 | pdhB | — | — | Pyruvate dehydrogenase E1 component subunit beta |
| Contig1 | 910040 | 911368 | + | GENE_00901 | Prodigal: 2.6 | CDS | 2.3.1.12 | — | — | — | P21883 | pdhC_2 | — | — | Dihydrolipoyllysine-residue acetyltransferase component of pyruvate dehydrogenase complex |
| Contig1 | 911373 | 912785 | + | GENE_00902 | Prodigal: 2.6 | CDS | 1.8.1.4 | — | — | — | P11959 | pdhD_2 | — | — | Dihydrolipoyl dehydrogenase |
| Contig1 | 912833 | 913207 | – | GENE_00903 | Prodigal: 2.6 | CDS | — | — | — | — | — | — | — | — | hypothetical protein |
| Contig1 | 913456 | 914247 | + | GENE_00904 | Prodigal: 2.6 | CDS | — | — | — | — | P83513 | — | — | — | Bifunctional xylanase/deacetylase precursor |
| Contig1 | 914528 | 916000 | – | GENE_00905 | Prodigal: 2.6 | CDS | 4.1.1.19 | — | — | — | P21885 | speA_1 | — | — | Arginine decarboxylase |
| Contig1 | 916180 | 916446 | + | GENE_00906 | Prodigal: 2.6 | CDS | — | — | — | — | — | — | — | — | hypothetical protein |
| Contig1 | 916482 | 917114 | – | GENE_00907 | Prodigal: 2.6 | CDS | — | PRK04387 | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 917363 | 917539 | + | GENE_00908 | Prodigal: 2.6 | CDS | — | — | — | — | — | — | — | — | hypothetical protein |
| Contig1 | 917673 | 918470 | + | GENE_00909 | Prodigal: 2.6 | CDS | 3.1.3.25 | — | — | — | P0ADG4 | suhB | — | — | Inositol-1-monophosphatase |
| Contig1 | 918457 | 918909 | — | GENE_00910 | Prodigal: 2.6 | CDS | — | — | — | — | — | — | — | — | hypothetical protein |
| Contig1 | 918961 | 920526 | — | GENE_00911 | Prodigal: 2.6 | CDS | 3.4.24.28 | — | — | — | P06832 | npr | — | — | Bacillolysin precursor |
| Contig1 | 921024 | 921317 | — | GENE_00912 | Prodigal: 2.6 | CDS | — | — | — | — | — | — | — | — | hypothetical protein |
| Contig1 | 921355 | 921972 | — | GENE_00913 | Prodigal: 2.6 | CDS | — | — | — | — | — | — | — | — | hypothetical protein |
| Contig1 | 922284 | 922472 | — | GENE_00914 | Prodigal: 2.6 | CDS | — | — | — | — | — | — | — | — | hypothetical protein |
| Contig1 | 922584 | 924422 | + | GENE_00915 | Prodigal: 2.6 | CDS | — | — | — | — | P32132 | typA | — | — | GTP-binding protein TypA/BipA |
| Contig1 | 924479 | 924799 | — | GENE_00916 | Prodigal: 2.6 | CDS | — | — | — | — | — | — | — | — | hypothetical protein |
| Contig1 | 924840 | 925049 | — | GENE_00917 | Prodigal: 2.6 | CDS | — | — | — | — | — | — | — | — | hypothetical protein |
| Contig1 | 925151 | 925774 | — | GENE_00918 | Prodigal: 2.6 | CDS | — | — | PF09580.4 | — | — | — | — | — | Sporulation lipoprotein YhcN/YlaJ (Spore_YhcN_YlaJ) |
| Contig1 | 925929 | 927257 | + | GENE_00919 | Prodigal: 2.6 | CDS | — | — | — | — | P0A9K3 | ybeZ_1 | — | — | PhoH-like protein |
| Contig1 | 927252 | 927728 | — | GENE_00920 | Prodigal: 2.6 | CDS | — | — | — | — | — | — | — | — | hypothetical protein |
| Contig1 | 927833 | 928762 | + | GENE_00921 | Prodigal: 2.6 | CDS | 3.5.1.2 | — | — | — | O07637 | glsA2 | — | — | Glutaminase 2 |
| Contig1 | 928870 | 929151 | + | GENE_00922 | Prodigal: 2.6 | CDS | — | — | — | — | — | — | — | — | hypothetical protein |
| Contig1 | 929357 | 930568 | + | GENE_00923 | Prodigal: 2.6 | CDS | — | — | — | — | O07639 | ftsW_1 | — | — | Lipid II flippase FtsW |
| Contig1 | 930644 | 934090 | + | GENE_00924 | Prodigal: 2.6 | CDS | 6.4.1.7 | — | — | — | D3DJ42 | cflB_1 | — | — | 2-oxoglutarate carboxylase small subunit |
| Contig1 | 934187 | 935113 | — | GENE_00925 | Prodigal: 2.6 | CDS | 1.3.-.- | — | — | — | P12946 | ctaA | — | — | Heme A synthase |
| Contig1 | 935457 | 936374 | + | GENE_00926 | Prodigal: 2.6 | CDS | 2.5.1.- | — | — | — | P24009 | ctaB2 | — | — | Protoheme IX farnesyltransferase 2 |
| Contig1 | 936592 | 937662 | + | GENE_00927 | Prodigal: 2.6 | CDS | 1.9.3.1 | — | — | — | Q03438 | ctaC | — | — | Cytochrome c oxidase subunit 2 precursor |
| Contig1 | 937694 | 939562 | + | GENE_00928 | Prodigal: 2.6 | CDS | 1.9.3.1 | — | — | — | P16262 | ctaD | — | — | Cytochrome c oxidase subunit 1 |
| Contig1 | 939562 | 940185 | + | GENE_00929 | Prodigal: 2.6 | CDS | 1.9.3.1 | — | — | — | Q03439 | ctaE | — | — | Cytochrome c oxidase subunit 3 |
| Contig1 | 940188 | 940520 | + | GENE_00930 | Prodigal: 2.6 | CDS | 1.9.3.1 | — | — | — | Q03440 | caaD | — | — | Cytochrome c oxidase subunit 4B |
| Contig1 | 940545 | 941429 | + | GENE_00931 | Prodigal: 2.6 | CDS | — | — | PF09678.4 | — | — | — | — | — | Cytochrome c oxidase caa3 assembly factor (Caa3_CtaG) |
| Contig1 | 941464 | 941823 | — | GENE_00932 | Prodigal: 2.6 | CDS | — | — | PF08868.4 | — | O06186 | hrp1_2 | — | — | YugN-like family protein |
| Contig1 | 941964 | 942407 | + | GENE_00933 | Prodigal: 2.6 | CDS | — | — | PF00188.20 | — | — | — | — | — | Hypoxic response protein 1 |
| Contig1 | 942492 | 943532 | + | GENE_00934 | Prodigal: 2.6 | CDS | — | — | — | — | — | — | — | — | Cysteine-rich secretory protein family protein |
| Contig1 | 943697 | 944107 | + | GENE_00935 | Prodigal: 2.6 | CDS | — | — | — | — | — | — | — | — | hypothetical protein |
| Contig1 | 944123 | 944362 | + | GENE_00936 | Prodigal: 2.6 | CDS | — | — | — | — | — | — | — | — | hypothetical protein |
| Contig1 | 944433 | 944882 | + | GENE_00937 | Prodigal: 2.6 | CDS | — | PRK02886 | — | — | — | — | — | — | hypothetical protein |
| Contig1 | 944938 | 945213 | + | GENE_00938 | Prodigal: 2.6 | CDS | — | — | — | — | — | — | — | — | hypothetical protein |
| Contig1 | 945213 | 945513 | + | GENE_00939 | Prodigal: 2.6 | CDS | — | — | — | — | — | — | — | — | hypothetical protein |
| Contig1 | 945513 | 946067 | + | GENE_00940 | Prodigal: 2.6 | CDS | 2.1.1.171 | — | — | — | P44869 | rsmD | — | — | Ribosomal RNA small subunit methyltransferase D |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 946072 | 946554 | + | GENE_00941 | Prodigal: 2.6 | CDS | 2.7.7.3 | — | — | — | O34797 | coaD | — | — | Phosphopantetheine adenylyltransferase |
| Contig1 | 946573 | 947799 | − | GENE_00942 | Prodigal: 2.6 | CDS | | — | — | — | O34765 | ylbJ | — | — | Sporulation integral membrane protein YlbJ |
| Contig1 | 947979 | 948758 | + | GENE_00943 | Prodigal: 2.6 | CDS | | — | — | — | P0AFR0 | rssA | — | — | NTE family protein RssA |
| Contig1 | 948764 | 949786 | + | GENE_00944 | Prodigal: 2.6 | CDS | 3.4.21.53 | — | — | — | O69300 | lon | — | — | Lon protease |
| Contig1 | 949805 | 951052 | − | GENE_00945 | Prodigal: 2.6 | CDS | | — | — | — | — | — | — | — | hypothetical protein |
| Contig1 | 951261 | 951779 | + | GENE_00946 | Prodigal: 2.6 | CDS | | — | — | — | — | — | — | — | hypothetical protein |
| Contig1 | 951801 | 951980 | + | GENE_00947 | Prodigal: 2.6 | CDS | | — | — | — | O34687 | rpmF | — | — | 50S ribosomal protein L32 |
| Contig1 | 952140 | 952715 | + | GENE_00948 | Prodigal: 2.6 | CDS | | — | — | — | P39650 | rsfA_1 | — | — | Prespore-specific transcriptional regulator RsfA |
| Contig1 | 952756 | 953238 | − | GENE_00949 | Prodigal: 2.6 | CDS | 2.3.1.- | — | — | — | O34468 | ylbP | — | — | putative N-acetyltransferase YlbP |
| Contig1 | 953362 | 954282 | + | GENE_00950 | Prodigal: 2.6 | CDS | 1.1.1.169 | — | — | — | O34661 | panE_2 | — | — | putative 2-dehydropantoate 2-reductase |
| Contig1 | 954312 | 955988 | + | GENE_00951 | Prodigal: 2.6 | CDS | | — | — | — | — | — | — | — | hypothetical protein |
| Contig1 | 956081 | 956545 | + | GENE_00952 | Prodigal: 2.6 | CDS | | — | — | MF_01008 | — | mraZ | — | — | Protein MraZ |
| Contig1 | 956615 | 957550 | + | GENE_00953 | Prodigal: 2.6 | CDS | 2.1.1.199 | — | — | — | P60392 | rsmH_1 | — | — | Ribosomal RNA small subunit methyltransferase H |
| Contig1 | 957590 | 957943 | + | GENE_00954 | Prodigal: 2.6 | CDS | | — | — | — | Q07867 | ftsL | — | — | Cell division protein FtsL |
| Contig1 | 957950 | 960094 | + | GENE_00955 | Prodigal: 2.6 | CDS | | — | — | — | Q07868 | pbpB | — | — | Penicillin-binding protein 2B |
| Contig1 | 960208 | 962127 | + | GENE_00956 | Prodigal: 2.6 | CDS | | — | — | — | Q03524 | spoVD | — | — | Stage V sporulation protein D |
| Contig1 | 962323 | 963795 | + | GENE_00957 | Prodigal: 2.6 | CDS | 6.3.2.7 | — | — | — | Q2FZP6 | murE | — | — | UDP-N-acetylmuramoyl-L-alanyl-D-glutamate--L-lysine ligase |
| Contig1 | 963903 | 964877 | + | GENE_00958 | Prodigal: 2.6 | CDS | 2.7.8.13 | — | — | — | Q2FZ93 | mraY | — | — | Phospho-N-acetylmuramoyl-pentapeptide-transferase |
| Contig1 | 964878 | 966233 | + | GENE_00959 | Prodigal: 2.6 | CDS | 6.3.2.9 | — | — | — | P0A090 | murD | — | — | UDP-N-acetylmuramoylalanine-D-glutamate ligase |
| Contig1 | 966367 | 967392 | + | GENE_00960 | Prodigal: 2.6 | CDS | | — | — | — | P0ABG4 | ftsW_2 | — | — | Lipid II flippase FtsW |
| Contig1 | 967509 | 968600 | + | GENE_00961 | Prodigal: 2.6 | CDS | 2.4.1.227 | — | — | — | Q9HW01 | murG_1 | — | — | UDP-N-acetylglucosamine--N-acetylmuramyl-(penta peptide) pyrophosphoryl-undecaprenol N-acetylglucosamine transferase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 968626 | 969537 | + | GENE_00962 | Prodigal: 2.6 | CDS | 1.3.1.98 | — | — | — | Q8Y776 | murB | — | — | UDP-N-acetylenolpyruvoyl-glucosamine reductase |
| Contig1 | 969667 | 970455 | + | GENE_00963 | Prodigal: 2.6 | CDS | — | — | — | — | P16655 | divIB | — | — | Cell division protein DivIB |
| Contig1 | 971004 | 972317 | + | GENE_00964 | Prodigal: 2.6 | CDS | — | — | — | — | P28264 | ftsA | — | — | Cell division protein FtsA |
| Contig1 | 972353 | 973501 | + | GENE_00965 | Prodigal: 2.6 | CDS | — | — | — | — | P17865 | ftsZ | — | — | Cell division protein FtsZ |
| Contig1 | 973776 | 978071 | + | GENE_00966 | Prodigal: 2.6 | CDS | 3.4.21.- | — | PF03419.7 | — | P16397 | bpr | — | — | Bacillopeptidase F precursor |
| Contig1 | 978287 | 979216 | + | GENE_00967 | Prodigal: 2.6 | CDS | — | — | — | — | — | — | — | — | Sporulation factor SpoIIGA |
| Contig1 | 979274 | 979993 | + | GENE_00968 | Prodigal: 2.6 | CDS | — | — | — | — | P06222 | sigE | — | — | RNA polymerase sigma-E factor precursor |
| Contig1 | 980134 | 980916 | + | GENE_00969 | Prodigal: 2.6 | CDS | — | — | — | — | P07860 | sigF_1 | — | — | RNA polymerase sigma-F factor |
| Contig1 | 981045 | 981842 | + | GENE_00970 | Prodigal: 2.6 | CDS | 3.6.3.- | — | — | — | O31723 | ylmA | — | — | putative ABC transporter ATP-binding protein YlmA |
| Contig1 | 981872 | 983308 | + | GENE_00971 | Prodigal: 2.6 | CDS | 3.5.1.- | — | — | — | Q9K9G9 | — | — | — | N-formyl-4-amino-5-aminomethyl-2-methylpyrimidine deformylase |
| Contig1 | 983369 | 983620 | + | GENE_00972 | Prodigal: 2.6 | CDS | — | — | PF05239.10 | — | — | — | — | — | PRC-barrel domain protein |
| Contig1 | 983775 | 984611 | + | GENE_00973 | Prodigal: 2.6 | CDS | — | — | — | — | — | — | — | Alanine racemase, N-terminal domain | Laccase domain protein |
| Contig1 | 984616 | 985308 | + | GENE_00974 | Prodigal: 2.6 | CDS | — | — | PF01168.14 | — | Q99US8 | — | — | — | hypothetical protein |
| Contig1 | 985305 | 985763 | + | GENE_00975 | Prodigal: 2.6 | CDS | — | — | — | — | O31728 | sepF | — | — | Cell division protein SepF |
| Contig1 | 985770 | 986048 | + | GENE_00976 | Prodigal: 2.6 | CDS | — | — | PF02325.11 | — | — | — | — | — | YGGT family protein |
| Contig1 | 986110 | 986880 | + | GENE_00977 | Prodigal: 2.6 | CDS | — | — | PF01479.19 | — | — | — | — | — | S4 domain protein |
| Contig1 | 986975 | 987469 | + | GENE_00978 | Prodigal: 2.6 | CDS | — | — | — | — | P71021 | divIVA | — | — | Septum site-determining protein DivIVA |
| Contig1 | 987811 | 990576 | + | GENE_00979 | Prodigal: 2.6 | CDS | 6.1.1.5 | — | — | — | P41972 | ileS | — | — | Isoleucine-tRNA ligase |
| Contig1 | 990726 | 991097 | + | GENE_00980 | Prodigal: 2.6 | CDS | — | — | — | — | P80872 | yocK_1 | — | — | General stress protein 160 |
| Contig1 | 991199 | 991660 | + | GENE_00981 | Prodigal: 2.6 | CDS | 3.4.23.36 | — | — | — | P00804 | lspA | — | — | Lipoprotein signal peptidase |
| Contig1 | 991662 | 992576 | + | GENE_00982 | Prodigal: 2.6 | CDS | 5.4.99.23 | — | — | — | P33643 | rluD_3 | — | — | Ribosomal large subunit pseudouridine synthase D |
| Contig1 | 992765 | 993310 | + | GENE_00983 | Prodigal: 2.6 | CDS | — | — | — | — | P39765 | pyrR | — | — | Bifunctional protein PyrR |
| Contig1 | 993465 | 994775 | + | GENE_00984 | Prodigal: 2.6 | CDS | — | — | — | — | P39766 | pyrP | — | — | Uracil permease |

TABLE 5-continued

| #ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 994917 | 995831 | + | GENE_00985 | Prodigal: 2.6 | CDS | 2.1.3.2 | — | — | — | P05654 | pyrB | — | — | Aspartate carbamoyltransferase |
| Contig1 | 995815 | 997101 | + | GENE_00986 | Prodigal: 2.6 | CDS | 3.5.2.3 | — | — | — | Q81WF0 | pyrC | — | — | Dihydroorotase |
| Contig1 | 997098 | 998192 | + | GENE_00987 | Prodigal: 2.6 | CDS | 6.3.5.5 | — | — | — | P99147 | carA_2 | — | — | Carbamoyl-phosphate synthase small chain |
| Contig1 | 998177 | 1001392 | + | GENE_00988 | Prodigal: 2.6 | CDS | 6.3.5.5 | — | — | — | P63740 | carB_2 | — | — | Carbamoyl-phosphate synthase large chain |
| Contig1 | 1001389 | 1002159 | + | GENE_00989 | Prodigal: 2.6 | CDS | — | — | — | — | P25983 | pyrK | — | — | Dihydroorotate dehydrogenase B (NAD(+)), electron transfer subunit |
| Contig1 | 1002159 | 1003094 | + | GENE_00990 | Prodigal: 2.6 | CDS | 1.3.1.14 | — | — | — | P25996 | pyrD | — | — | Dihydroorotate dehydrogenase B (NAD(+)), catalytic subunit |
| Contig1 | 1003063 | 1003782 | + | GENE_00991 | Prodigal: 2.6 | CDS | 4.1.1.23 | — | — | — | P25971 | pyrF | — | — | Orotidine 5'-phosphate decarboxylase |
| Contig1 | 1003779 | 1004411 | + | GENE_00992 | Prodigal: 2.6 | CDS | 2.4.2.10 | — | — | — | Q81WF6 | pyrE | — | — | Orotate phosphoribosyltransferase |
| Contig1 | 1004745 | 1005446 | + | GENE_00993 | Prodigal: 2.6 | CDS | 1.8.4.8 | — | — | — | P94498 | cysH | — | — | Phosphoadenosine phosphosulfate reductase |
| Contig1 | 1005459 | 1006523 | + | GENE_00994 | Prodigal: 2.6 | CDS | — | — | — | — | O34734 | cysP | — | — | Sulfate permease CysP |
| Contig1 | 1006572 | 1007720 | + | GENE_00995 | Prodigal: 2.6 | CDS | 2.7.7.4 | — | — | — | O34764 | sat | — | — | Sulfate adenylyltransferase |
| Contig1 | 1007734 | 1008327 | + | GENE_00996 | Prodigal: 2.6 | CDS | 2.7.1.25 | — | — | — | O34577 | cysC | — | — | putative adenylyl-sulfate kinase |
| Contig1 | 1008452 | 1009225 | + | GENE_00997 | Prodigal: 2.6 | CDS | 2.1.1.107 | — | — | — | O34744 | sumT | — | — | Uroporphyrinogen-III C-methyltransferase |
| Contig1 | 1009226 | 1010011 | + | GENE_00998 | Prodigal: 2.6 | CDS | 4.99.1.4 | — | — | — | O34632 | sirB | — | — | Sirohydrochlorin ferrochelatase |
| Contig1 | 1009992 | 1010480 | + | GENE_00999 | Prodigal: 2.6 | CDS | 1.3.1.76 | — | — | — | O34813 | sirC | — | — | Precorrin-2 dehydrogenase |
| Contig1 | 1010458 | 1010766 | + | GENE_01000 | Prodigal: 2.6 | CDS | — | — | PF05833.5 | — | — | — | — | Fibronectin-binding protein A N-terminus (FbpA) | hypothetical protein |
| Contig1 | 1010873 | 1012588 | − | GENE_01001 | Prodigal: 2.6 | CDS | — | — | — | — | — | — | — | — | hypothetical protein |
| Contig1 | 1012699 | 1015371 | + | GENE_01002 | Prodigal: 2.6 | CDS | 3.6.3.8 | — | — | — | O34431 | yloB | — | — | Calcium-transporting ATPase |
| Contig1 | 1015444 | 1016328 | + | GENE_01003 | Prodigal: 2.6 | CDS | — | PRK11820 | — | — | — | — | — | — | hypothetical protein |
| Contig1 | 1016405 | 1016674 | + | GENE_01004 | Prodigal: 2.6 | CDS | — | PRK04323 | — | — | — | — | — | — | hypothetical protein |
| Contig1 | 1016682 | 1017296 | + | GENE_01005 | Prodigal: 2.6 | CDS | 2.7.4.8 | — | — | — | Q8Y672 | gmk | — | — | Guanylate kinase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1017300 | 1017503 | + | GENE_01006 | Prodigal: 2.6 | CDS | 2.7.7.6 | — | — | — | Q5XAP2 | rpoZ | — | — | DNA-directed RNA polymerase subunit omega |
| Contig1 | 1017594 | 1018814 | + | GENE_01007 | Prodigal: 2.6 | CDS | — | — | — | — | P0ABQ0 | coaBC | — | — | Coenzyme A biosynthesis bifunctional protein CoaBC |
| Contig1 | 1018811 | 1021222 | + | GENE_01008 | Prodigal: 2.6 | CDS | 3.6.4.- | — | — | — | P17888 | priA | — | — | Primosomal protein N' |
| Contig1 | 1021247 | 1021729 | + | GENE_01009 | Prodigal: 2.6 | CDS | 3.5.1.88 | — | — | — | Q819U0 | deff | — | — | Peptide deformylase 1 |
| Contig1 | 1021752 | 1022687 | + | GENE_01010 | Prodigal: 2.6 | CDS | 2.1.2.9 | — | — | — | Q81WH2 | fmt | — | — | Methionyl-tRNA formyltransferase |
| Contig1 | 1022674 | 1024017 | + | GENE_01011 | Prodigal: 2.6 | CDS | 2.1.1.176 | — | — | — | P36929 | rsmB | — | — | Ribosomal RNA small subunit methyltransferase B |
| Contig1 | 1024021 | 1025112 | + | GENE_01012 | Prodigal: 2.6 | CDS | 2.1.1 | — | — | — | Q7A600 | rlmN | — | — | putative dual-specificity RNA methyltransferase RlmN |
| Contig1 | 1025118 | 1025879 | + | GENE_01013 | Prodigal: 2.6 | CDS | 3.1.3.16 | — | — | — | Q8Y678 | stp_1 | — | — | Serine/threonine phosphatase stp |
| Contig1 | 1025873 | 1027816 | + | GENE_01014 | Prodigal: 2.6 | CDS | 2.7.11.1 | — | — | — | O34507 | prkC_1 | — | — | Serine/threonine-protein kinase PrkC |
| Contig1 | 1027831 | 1028721 | + | GENE_01015 | Prodigal: 2.6 | CDS | 3.6.1.- | — | — | — | O34530 | rsgA | — | — | Putative ribosome biogenesis GTPase RsgA |
| Contig1 | 1028723 | 1029376 | + | GENE_01016 | Prodigal: 2.6 | CDS | 5.1.3.1 | — | — | — | P74061 | rpe | — | — | Ribulose-phosphate 3-epimerase |
| Contig1 | 1029442 | 1030086 | + | GENE_01017 | Prodigal: 2.6 | CDS | 2.7.6.2 | — | — | — | O34664 | thiN | — | — | Thiamine pyrophosphokinase |
| Contig1 | 1030331 | 1030519 | − | GENE_01018 | Prodigal: 2.6 | CDS | — | — | — | — | P23374 | rpmB | — | — | 50S ribosomal protein L28 |
| Contig1 | 1030778 | 1031140 | + | GENE_01019 | Prodigal: 2.6 | CDS | — | — | PF02734.11 | — | — | — | — | — | hypothetical protein DAK2 domain protein |
| Contig1 | 1031156 | 1032823 | + | GENE_01020 | Prodigal: 2.6 | CDS | — | — | — | — | — | — | — | — | |
| Contig1 | 1032966 | 1033628 | + | GENE_01021 | Prodigal: 2.6 | CDS | 4.3.1.17 | — | — | — | P33074 | sdhB | — | — | L-serine dehydratase, beta chain |
| Contig1 | 1033649 | 1034551 | + | GENE_01022 | Prodigal: 2.6 | CDS | 4.3.1.17 | — | — | — | P33073 | sdhA | — | — | L-serine dehydratase, alpha chain |
| Contig1 | 1034529 | 1036677 | + | GENE_01023 | Prodigal: 2.6 | CDS | 3.6.4.12 | — | — | — | P64325 | recG | — | — | ATP-dependent DNA helicase RecG |
| Contig1 | 1036684 | 1037250 | + | GENE_01024 | Prodigal: 2.6 | CDS | — | — | — | — | O34835 | fapR | — | — | Transcription factor FapR |
| Contig1 | 1037264 | 1038262 | + | GENE_01025 | Prodigal: 2.6 | CDS | 2.3.1.- | — | — | — | P71018 | plsX | — | — | Phosphate acyltransferase |
| Contig1 | 1038281 | 1039234 | + | GENE_01026 | Prodigal: 2.6 | CDS | 2.3.1.39 | — | — | — | Q7A5Z3 | fabD | — | — | Malonyl CoA-acyl carrier protein transacylase |
| Contig1 | 1039227 | 1039967 | + | GENE_01027 | Prodigal: 2.6 | CDS | 1.1.1.100 | — | — | — | P99093 | fabG_1 | — | — | 3-oxoacyl-[acyl-carrier-protein] reductase FabG |
| Contig1 | 1040052 | 1040285 | + | GENE_01028 | Prodigal: 2.6 | CDS | — | — | — | — | P80643 | acpA | — | — | Acyl carrier protein |
| Contig1 | 1040424 | 1041173 | + | GENE_01029 | Prodigal: 2.6 | CDS | 3.1.26.3 | — | — | — | P51833 | rnc | — | — | Ribonuclease 3 |
| Contig1 | 1041275 | 1044835 | + | GENE_01030 | Prodigal: 2.6 | CDS | — | — | — | — | P51834 | smc_2 | — | — | Chromosome partition protein Smc |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1044855 | 1045844 | + | GENE_01031 | Prodigal: 2.6 | CDS | — | — | — | — | P51835 | ftsY | — | — | Signal recognition particle receptor FtsY |
| Contig1 | 1045928 | 1046698 | + | GENE_01032 | Prodigal: 2.6 | CDS | — | — | PF01636.17 | — | — | — | — | — | Phosphotransferase enzyme family protein |
| Contig1 | 1046818 | 1047150 | + | GENE_01033 | Prodigal: 2.6 | CDS | — | PRK00118 | — | — | — | — | — | — | putative DNA-binding protein |
| Contig1 | 1047164 | 1048504 | + | GENE_01034 | Prodigal: 2.6 | CDS | — | — | — | — | P37105 | ffh | — | — | Signal recognition particle protein |
| Contig1 | 1048610 | 1048882 | + | GENE_01035 | Prodigal: 2.6 | CDS | — | — | — | — | P21474 | rpsP | — | — | 30S ribosomal protein S16 |
| Contig1 | 1048882 | 1049127 | + | GENE_01036 | Prodigal: 2.6 | CDS | — | PRK00468 | — | — | — | — | — | — | hypothetical protein |
| Contig1 | 1049218 | 1049604 | + | GENE_01037 | Prodigal: 2.6 | CDS | — | — | — | — | — | — | — | — | hypothetical protein |
| Contig1 | 1049609 | 1050133 | + | GENE_01038 | Prodigal: 2.6 | CDS | — | — | — | — | P66656 | rimM | — | — | Ribosome maturation factor RimM |
| Contig1 | 1050130 | 1050861 | + | GENE_01039 | Prodigal: 2.6 | CDS | 2.1.1.228 | — | — | — | Q6GHJ5 | trmD | — | — | tRNA (guanine-N(1))-methyltransferase |
| Contig1 | 1051002 | 1051349 | + | GENE_01040 | Prodigal: 2.6 | CDS | — | — | — | — | O31742 | rplS | — | — | 50S ribosomal protein L19 |
| Contig1 | 1051492 | 1052340 | + | GENE_01041 | Prodigal: 2.6 | CDS | — | — | — | — | O31743 | rbgA | — | — | Ribosome biogenesis GTPase A |
| Contig1 | 1052413 | 1053180 | + | GENE_01042 | Prodigal: 2.6 | CDS | 3.1.26.4 | — | — | — | O31744 | rnhB | — | — | Ribonuclease HH |
| Contig1 | 1053197 | 1054900 | + | GENE_01043 | Prodigal: 2.6 | CDS | — | — | — | — | — | — | — | — | hypothetical protein |
| Contig1 | 1054897 | 1055178 | + | GENE_01044 | Prodigal: 2.6 | CDS | — | — | — | — | P76299 | flhB_1 | — | — | Flagellar biosynthetic protein FlhB |
| Contig1 | 1055353 | 1056510 | + | GENE_01045 | Prodigal: 2.6 | CDS | 6.2.1.5 | — | — | — | P80886 | sucC | — | — | Succinyl-CoA ligase [ADP-forming] subunit beta |
| Contig1 | 1056539 | 1057441 | + | GENE_01046 | Prodigal: 2.6 | CDS | 6.2.1.5 | — | — | — | P80865 | sucD | — | — | Succinyl-CoA ligase [ADP-forming] subunit alpha |
| Contig1 | 1057506 | 1058405 | + | GENE_01047 | Prodigal: 2.6 | CDS | — | — | — | — | — | — | — | — | hypothetical protein |
| Contig1 | 1058587 | 1060662 | + | GENE_01048 | Prodigal: 2.6 | CDS | 5.99.1.2 | PRK10736 | — | — | Q7A5Y5 | topA | — | — | DNA topoisomerase 1 |
| Contig1 | 1060727 | 1062034 | + | GENE_01049 | Prodigal: 2.6 | CDS | 2.1.1.74 | — | — | — | P39815 | trmFO | — | — | Methylenetetrahydrofolate tRNA-(uracil-5-)-methyltransferase TrmFO |
| Contig1 | 1062104 | 1063021 | + | GENE_01050 | Prodigal: 2.6 | CDS | — | — | — | — | P39776 | xerC_1 | — | — | Tyrosine recombinase XerC |
| Contig1 | 1063037 | 1063582 | + | GENE_01051 | Prodigal: 2.6 | CDS | 3.4.21.- | — | — | — | P39070 | clpQ | — | — | ATP-dependent protease subunit ClpQ |
| Contig1 | 1063599 | 1065002 | + | GENE_01052 | Prodigal: 2.6 | CDS | — | — | — | — | P39778 | clpY | — | — | ATP-dependent protease ATPase subunit ClpY |
| Contig1 | 1065040 | 1065819 | + | GENE_01053 | Prodigal: 2.6 | CDS | — | — | — | — | P39779 | codY | — | — | GTP-sensing transcriptional pleiotropic repressor CodY |
| Contig1 | 1066171 | 1066560 | + | GENE_01054 | Prodigal: 2.6 | CDS | — | — | — | — | P24500 | flgB | — | — | Flagellar basal body rod protein FlgB |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1066560 | 1067012 | + | GENE_01055 | Prodigal: 2.6 | CDS | — | — | — | — | P0A1I7 | flgC | — | — | Flagellar basal-body rod protein FlgC |
| Contig1 | 1067023 | 1067343 | + | GENE_01056 | Prodigal: 2.6 | CDS | — | — | — | — | P26462 | fliE | — | — | Flagellar hook-basal body complex protein FliE |
| Contig1 | 1067386 | 1068996 | + | GENE_01057 | Prodigal: 2.6 | CDS | — | — | — | — | P15928 | fliF | — | — | Flagellar M-ring protein |
| Contig1 | 1069009 | 1070025 | + | GENE_01058 | Prodigal: 2.6 | CDS | — | — | — | — | Q9WY63 | fliG | — | — | Flagellar motor switch protein FliG |
| Contig1 | 1070018 | 1070773 | + | GENE_01059 | Prodigal: 2.6 | CDS | — | PRK06669 | — | — | — | — | — | — | flagellar assembly protein H |
| Contig1 | 1070770 | 1072086 | + | GENE_01060 | Prodigal: 2.6 | CDS | 3.6.3.14 | — | — | — | P40291 | yscN | — | — | putative ATP synthase YscN |
| Contig1 | 1072092 | 1072535 | + | GENE_01061 | Prodigal: 2.6 | CDS | — | — | — | — | P20487 | fliJ | — | — | Flagellar FliJ protein |
| Contig1 | 1072547 | 1073161 | + | GENE_01062 | Prodigal: 2.6 | CDS | — | — | PF03448.11 | — | — | — | — | — | MgtE intracellular N domain protein |
| Contig1 | 1073168 | 1074511 | + | GENE_01063 | Prodigal: 2.6 | CDS | — | — | PF02120.10 | — | — | — | — | — | Flagellar hook-length control protein FliK |
| Contig1 | 1074512 | 1074952 | + | GENE_01064 | Prodigal: 2.6 | CDS | — | — | — | — | P0A1J9 | flgD | — | — | Basal-body rod modification protein FlgD |
| Contig1 | 1074977 | 1075753 | + | GENE_01065 | Prodigal: 2.6 | CDS | — | — | — | — | P0A1J3 | flgG_1 | — | — | Flagellar basal-body rod protein FlgG |
| Contig1 | 1076005 | 1076424 | + | GENE_01066 | Prodigal: 2.6 | CDS | — | PRK07718 | — | — | — | — | — | — | flagellar basal body-associated protein FliL |
| Contig1 | 1076458 | 1077456 | + | GENE_01067 | Prodigal: 2.6 | CDS | — | — | — | — | P23453 | fliM | — | — | Flagellar motor switch protein FliM |
| Contig1 | 1077446 | 1078564 | + | GENE_01068 | Prodigal: 2.6 | CDS | — | — | — | — | P15070 | fliN | — | — | Flagellar motor switch protein FliN |
| Contig1 | 1078591 | 1078953 | + | GENE_01069 | Prodigal: 2.6 | CDS | — | — | — | — | P24072 | cheY_1 | — | — | Chemotaxis protein CheY |
| Contig1 | 1078968 | 1079621 | + | GENE_01070 | Prodigal: 2.6 | CDS | — | — | PF04347.7 | — | — | — | — | — | Flagellar biosynthesis protein, FliO |
| Contig1 | 1079614 | 1080279 | + | GENE_01071 | Prodigal: 2.6 | CDS | — | — | — | — | P54700 | fliP | — | — | Flagellar biosynthetic protein FliP precursor |
| Contig1 | 1080294 | 1080563 | + | GENE_01072 | Prodigal: 2.6 | CDS | — | — | — | — | P74931 | fliQ | — | — | Flagellar biosynthetic protein FliQ |
| Contig1 | 1080570 | 1081349 | + | GENE_01073 | Prodigal: 2.6 | CDS | — | — | — | — | P74932 | fliR | — | — | Flagellar biosynthetic protein FliR |
| Contig1 | 1081346 | 1082428 | + | GENE_01074 | Prodigal: 2.6 | CDS | — | — | — | — | P40727 | flhB_2 | — | — | Flagellar biosynthesis protein FlhB |
| Contig1 | 1082462 | 1084495 | + | GENE_01075 | Prodigal: 2.6 | CDS | — | — | — | — | P35620 | flhA | — | — | Flagellar biosynthesis protein FlhA |
| Contig1 | 1084495 | 1085586 | + | GENE_01076 | Prodigal: 2.6 | CDS | — | — | — | — | Q01960 | flhF | — | — | Flagellar biosynthesis protein FlhF |
| Contig1 | 1085583 | 1086476 | + | GENE_01077 | Prodigal: 2.6 | CDS | — | — | — | — | P40742 | ylxH | — | — | Flagellum site-determining protein YlxH |
| Contig1 | 1086473 | 1087540 | + | GENE_01078 | Prodigal: 2.6 | CDS | 3.1.1.61 | — | — | — | Q9WYN9 | cheB | — | — | Chemotaxis response regulator protein-glutamate methylesterase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1087546 | 1089564 | + | GENE_01079 | Prodigal: 2.6 | CDS | 2.7.13.3 | — | — | — | P29072 | cheA | — | — | Chemotaxis protein CheA |
| Contig1 | 1089587 | 1090060 | + | GENE_01080 | Prodigal: 2.6 | CDS | — | — | — | — | P39802 | cheW | — | — | Chemotaxis protein CheW |
| Contig1 | 1090076 | 1090705 | + | GENE_01081 | Prodigal: 2.6 | CDS | 3.-.-.- | — | — | — | P40403 | cheC | — | — | CheY-P phosphatase CheC |
| Contig1 | 1090702 | 1091202 | + | GENE_01082 | Prodigal: 2.6 | CDS | 3.5.1.44 | — | — | — | P40404 | cheD | — | — | Chemoreceptor glutamine deamidase CheD |
| Contig1 | 1091229 | 1091918 | + | GENE_01083 | Prodigal: 2.6 | CDS | — | — | — | — | P10726 | sigD | — | — | RNA polymerase sigma-D factor |
| Contig1 | 1092021 | 1092494 | + | GENE_01084 | Prodigal: 2.6 | CDS | — | — | — | — | — | — | — | — | hypothetical protein |
| Contig1 | 1092638 | 1093378 | + | GENE_01085 | Prodigal: 2.6 | CDS | — | — | — | — | P21464 | rpsB | — | — | 30S ribosomal protein S2 |
| Contig1 | 1093478 | 1094359 | + | GENE_01086 | Prodigal: 2.6 | CDS | — | — | — | — | P80700 | tsf | — | — | Elongation factor Ts |
| Contig1 | 1094505 | 1095227 | + | GENE_01087 | Prodigal: 2.6 | CDS | 2.7.4.22 | — | — | — | O31749 | pyrH | — | — | Uridylate kinase |
| Contig1 | 1095230 | 1095787 | + | GENE_01088 | Prodigal: 2.6 | CDS | — | — | — | — | P81101 | frr | — | — | Ribosome-recycling factor |
| Contig1 | 1095913 | 1096695 | + | GENE_01089 | Prodigal: 2.6 | CDS | 2.5.1.31 | — | — | — | O82827 | uppS | — | — | Ditrans, polycis-undecaprenyl-diphosphate synthase ((2E,6E)-farnesyl-diphosphate specific) |
| Contig1 | 1096708 | 1097496 | + | GENE_01090 | Prodigal: 2.6 | CDS | 2.7.7.41 | — | — | — | P0ABG1 | cdsA | — | — | Phosphatidate cytidylyltransferase |
| Contig1 | 1097552 | 1098703 | + | GENE_01091 | Prodigal: 2.6 | CDS | 1.1.1.267 | — | — | — | Q9RCT1 | dxr | — | — | 1-deoxy-D-xylulose 5-phosphate reductoisomerase |
| Contig1 | 1098716 | 1099978 | + | GENE_01092 | Prodigal: 2.6 | CDS | 3.4.24.- | — | — | — | O31754 | rasP | — | — | Regulator of sigma-W protease RasP |
| Contig1 | 1100010 | 1101704 | + | GENE_01093 | Prodigal: 2.6 | CDS | 6.1.1.15 | — | — | — | Q7A5Y3 | proS | — | — | Proline tRNA ligase |
| Contig1 | 1101816 | 1105079 | + | GENE_01094 | Prodigal: 2.6 | CDS | 2.7.7.7 | — | — | — | P13267 | polC_1 | — | — | DNA polymerase III PolC-type |
| Contig1 | 1105121 | 1106128 | + | GENE_01095 | Prodigal: 2.6 | CDS | 2.7.7.7 | — | — | — | P13267 | polC_2 | — | — | DNA polymerase III PolC-type |
| Contig1 | 1106368 | 1106838 | + | GENE_01096 | Prodigal: 2.6 | CDS | — | — | — | — | P67220 | rimP | — | — | Ribosome maturation factor RimP |
| Contig1 | 1106878 | 1107999 | + | GENE_01097 | Prodigal: 2.6 | CDS | — | PRK09190 | — | — | P0A5M2 | — | — | Transcription termination/antitermination protein NusA | hypothetical protein |
| Contig1 | 1108013 | 1108288 | + | GENE_01098 | Prodigal: 2.6 | CDS | — | — | — | — | — | — | — | — | hypothetical protein |
| Contig1 | 1108290 | 1108592 | + | GENE_01099 | Prodigal: 2.6 | CDS | — | — | — | — | P32729 | rplGA | — | — | putative ribosomal protein YlxQ |
| Contig1 | 1108612 | 1110759 | + | GENE_01100 | Prodigal: 2.6 | CDS | — | — | — | — | P04766 | infB | — | — | Translation initiation factor IF-2 |
| Contig1 | 1110756 | 1111034 | + | GENE_01101 | Prodigal: 2.6 | CDS | — | — | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1111051 | 1111404 | + | GENE_01102 | Prodigal: 2.6 | CDS | — | — | — | — | P65967 | rbfA | — | — | Ribosome-binding factor A |
| Contig1 | 1111488 | 1112417 | + | GENE_01103 | Prodigal: 2.6 | CDS | 5.4.99.25 | — | — | — | P65855 | truB | — | — | tRNA pseudouridine synthase B |
| Contig1 | 1112437 | 1113378 | + | GENE_01104 | Prodigal: 2.6 | CDS | — | — | — | — | P0AG40 | ribF | — | — | Riboflavin biosynthesis protein RibF |
| Contig1 | 1113544 | 1113813 | + | GENE_01105 | Prodigal: 2.6 | CDS | — | — | — | — | P21473 | rpsO | — | — | 30S ribosomal protein S15 |
| Contig1 | 1113988 | 1116111 | + | GENE_01106 | Prodigal: 2.6 | CDS | 27.7.8 | — | — | — | P50849 | pnp | — | — | Polyribonucleotide nucleotidyltransferase |
| Contig1 | 1116224 | 1117183 | + | GENE_01107 | Prodigal: 2.6 | CDS | 3.5.1.- | — | — | — | O34928 | pdaA_2 | — | — | Peptidoglycan-N-acetylmuramic acid deacetylase PdaA precursor |
| Contig1 | 1117223 | 1118458 | + | GENE_01108 | Prodigal: 2.6 | CDS | 3.4.24.55 | — | — | — | P05458 | ptrA | — | — | Protease 3 precursor |
| Contig1 | 1118537 | 1118794 | + | GENE_01109 | Prodigal: 2.6 | CDS | — | — | PF05239.10 | — | — | — | — | — | PRC-barrel domain protein |
| Contig1 | 1118951 | 1119841 | + | GENE_01110 | Prodigal: 2.6 | CDS | 1.3.1.- | — | — | — | Q04809 | dpaA | — | — | Dipicolinate synthase subunit A |
| Contig1 | 1119844 | 1120434 | + | GENE_01111 | Prodigal: 2.6 | CDS | 1.3.1.- | — | — | — | Q04810 | dpaB | — | — | Dipicolinate synthase subunit B |
| Contig1 | 1120569 | 1121609 | + | GENE_01112 | Prodigal: 2.6 | CDS | 1.2.1.11 | — | — | — | Q04797 | asd_2 | — | — | Aspartate-semialdehyde dehydrogenase |
| Contig1 | 1121698 | 1122912 | + | GENE_01113 | Prodigal: 2.6 | CDS | 27.2.4 | — | — | — | P08495 | lysC_1 | — | — | Aspartokinase 2 |
| Contig1 | 1122943 | 1123812 | + | GENE_01114 | Prodigal: 2.6 | CDS | 4.3.3.7 | — | — | — | Q04796 | dapA_1 | — | — | 4-hydroxy-tetrahydrodipicolinate synthase |
| Contig1 | 1123958 | 1125658 | + | GENE_01115 | Prodigal: 2.6 | CDS | 3.1.-.- | — | — | — | O31760 | rnjB | — | — | Ribonuclease J 2 |
| Contig1 | 1125786 | 1126511 | + | GENE_01116 | Prodigal: 2.6 | CDS | — | — | — | — | Q99171 | tepA | — | — | Translocation-enhancing protein TepA |
| Contig1 | 1126508 | 1126717 | + | GENE_01117 | Prodigal: 2.6 | CDS | — | — | — | — | — | — | — | — | hypothetical protein |
| Contig1 | 1126852 | 1129212 | + | GENE_01118 | Prodigal: 2.6 | CDS | — | — | — | — | P21458 | spoIIIE | — | — | DNA translocase SpoIIIE |
| Contig1 | 1129337 | 1130062 | + | GENE_01119 | Prodigal: 2.6 | CDS | — | — | — | — | O34817 | yvoA_1 | — | — | HTH-type transcriptional repressor YvoA |
| Contig1 | 1130253 | 1131404 | + | GENE_01120 | Prodigal: 2.6 | CDS | — | — | — | — | O31762 | ymfD | — | — | Bacillibactin exporter |
| Contig1 | 1131506 | 1131961 | + | GENE_01121 | Prodigal: 2.6 | CDS | — | — | — | — | O32181 | yusO_2 | — | — | putative HTH-type transcriptional regulator YusO |
| Contig1 | 1131961 | 1135080 | + | GENE_01122 | Prodigal: 2.6 | CDS | — | — | — | — | P96706 | ydgH | — | — | Putative membrane protein YdgH |
| Contig1 | 1135232 | 1136512 | + | GENE_01123 | Prodigal: 2.6 | CDS | — | — | — | — | P71007 | albE | — | — | Antilisterial bacteriocin subtilosin biosynthesis protein AlbE |
| Contig1 | 1136509 | 1137795 | + | GENE_01124 | Prodigal: 2.6 | CDS | 3.4.24.- | — | — | — | P71006 | albF | — | — | Putative zinc protease AlbF |
| Contig1 | 1137854 | 1138582 | + | GENE_01125 | Prodigal: 2.6 | CDS | 1.1.1.100 | — | — | — | O67610 | fabG_2 | — | — | 3-oxoacyl-[acyl-carrier-protein] reductase FabG |
| Contig1 | 1138657 | 1138914 | + | GENE_01126 | Prodigal: 2.6 | CDS | — | — | — | — | — | — | — | — | hypothetical protein |
| Contig1 | 1139042 | 1139833 | + | GENE_01127 | Prodigal: 2.6 | CDS | — | — | PF01842.19 | — | — | — | — | — | ACT domain protein |

TABLE 5-continued

| #ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1139852 | 1140778 | + | GENE_01128 | Prodigal: 2.6 | CDS | — | PRK10856 | — | — | — | — | — | — | cytoskeletal protein RodZ |
| Contig1 | 1140825 | 1141406 | + | GENE_01129 | Prodigal: 2.6 | CDS | 27.8.5 | — | — | — | P63756 | pgsA_1 | — | — | CDP-diacylglycerol--glycerol-3-phosphate 3-phosphatidyltransferase |
| Contig1 | 1141424 | 1142674 | + | GENE_01130 | Prodigal: 2.6 | CDS | — | — | — | — | P54184 | cinA | — | — | Putative competence-damage inducible protein |
| Contig1 | 1142845 | 1143888 | + | GENE_01131 | Prodigal: 2.6 | CDS | — | — | — | MF_00268 | — | recA | — | — | Protein RecA |
| Contig1 | 1144056 | 1145237 | + | GENE_01132 | Prodigal: 2.6 | CDS | — | — | — | — | O31773 | pbpX_2 | — | — | Putative penicillin-binding protein PbpX |
| Contig1 | 1145530 | 1147089 | + | GENE_01133 | Prodigal: 2.6 | CDS | 3.1.-.- | — | — | — | — | rny | — | — | Ribonuclease Y |
| Contig1 | 1147150 | 1147944 | + | GENE_01134 | Prodigal: 2.6 | CDS | — | — | PF00149.22 | — | O31774 | — | — | — | Calcineurin-like phosphoesterase |
| Contig1 | 1148144 | 1148404 | + | GENE_01135 | Prodigal: 2.6 | CDS | — | — | — | — | P45693 | spoVS | — | — | Stage V sporulation protein S |
| Contig1 | 1148662 | 1149708 | + | GENE_01136 | Prodigal: 2.6 | CDS | 1.1.1.103 | — | — | — | Q5SKS4 | tdh | — | — | L-threonine 3-dehydrogenase |
| Contig1 | 1149724 | 1150899 | + | GENE_01137 | Prodigal: 2.6 | CDS | 2.3.1.29 | — | — | — | Q5SHZ8 | — | — | — | 8-amino-7-oxononanoate synthase/2-amino-3-ketobutyrate coenzyme A ligase |
| Contig1 | 1151042 | 1152571 | + | GENE_01138 | Prodigal: 2.6 | CDS | 2.-.-.- | — | — | — | O31778 | miaB | — | — | (Dimethylallyl)adenosine tRNA methylthiotransferase MiaB |
| Contig1 | 1152574 | 1153005 | + | GENE_01139 | Prodigal: 2.6 | CDS | — | — | — | — | — | — | — | — | hypothetical protein |
| Contig1 | 1153259 | 1153804 | + | GENE_01140 | Prodigal: 2.6 | CDS | — | — | — | — | P14016 | cotE | — | — | Spore coat protein E |
| Contig1 | 1153920 | 1156508 | + | GENE_01141 | Prodigal: 2.6 | CDS | — | — | — | — | Q93I88 | mutS | — | — | DNA mismatch repair protein MutS |
| Contig1 | 1156524 | 1158401 | + | GENE_01142 | Prodigal: 2.6 | CDS | — | — | — | — | P49850 | mutL | — | — | DNA mismatch repair protein MutL |
| Contig1 | 1158413 | 1158775 | - | GENE_01143 | Prodigal: 2.6 | CDS | — | — | — | — | — | — | — | — | hypothetical protein |
| Contig1 | 1159533 | 1160291 | - | GENE_01144 | Prodigal: 2.6 | CDS | — | — | — | — | — | — | — | — | hypothetical protein |
| Contig1 | 1160592 | 1160909 | + | GENE_01145 | Prodigal: 2.6 | CDS | — | — | — | — | — | — | — | — | hypothetical protein |
| Contig1 | 1160906 | 1161442 | + | GENE_01146 | Prodigal: 2.6 | CDS | — | — | — | — | — | — | — | — | hypothetical protein |
| Contig1 | 1162106 | 1162231 | - | GENE_01147 | Prodigal: 2.6 | CDS | — | — | — | — | — | — | — | — | hypothetical protein |
| Contig1 | 1162577 | 1162786 | - | GENE_01148 | Prodigal: 2.6 | CDS | — | — | — | — | — | — | — | — | hypothetical protein |
| Contig1 | 1163404 | 1164096 | + | GENE_01149 | Prodigal: 2.6 | CDS | 3.-.-.- | — | — | — | A7Z4X7 | baeB | — | — | putative polyketide biosynthesis zinc-dependent hydrolase BaeB |
| Contig1 | 1164411 | 1165280 | + | GENE_01150 | Prodigal: 2.6 | CDS | 2.3.1.39 | — | — | — | A7Z4X8 | baeC | — | — | Polyketide biosynthesis malonyl CoA-acyl carrier protein transacylase BaeC |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1165417 | 1166391 | + | GENE_01151 | Prodigal: 2.6 | CDS | — | — | — | — | A7Z4X9 | — | — | Polyketide biosynthesis acyl-transferase homolog BaeD | hypothetical protein |
| Contig1 | 1166393 | 1168633 | + | GENE_01152 | Prodigal: 2.6 | CDS | — | — | — | — | A7Z4Y0 | baeE_2 | — | — | Polyketide biosynthesis protein BaeE |
| Contig1 | 1168699 | 1168947 | + | GENE_01153 | Prodigal: 2.6 | CDS | — | — | — | — | Q7PC63 | acpK | — | — | Polyketide biosynthesis acyl-carrier-protein AcpK |
| Contig1 | 1168998 | 1170260 | + | GENE_01154 | Prodigal: 2.6 | CDS | 2.3.3.- | — | — | — | P40830 | pksG_1 | — | — | Polyketide biosynthesis 3-hydroxy-3-methylglutaryl-ACP synthase PksG |
| Contig1 | 1170257 | 1171030 | + | GENE_01155 | Prodigal: 2.6 | CDS | 4.2.1.- | — | — | — | P40805 | pksH | — | — | putative polyketide biosynthesis enoyl-CoA hydratase PksH |
| Contig1 | 1171040 | 1171789 | + | GENE_01156 | Prodigal: 2.6 | CDS | 4.-.-.- | — | — | — | P40802 | pksL_1 | — | — | Putative polyketide biosynthesis enoyl-CoA isomerase PksI |
| Contig1 | 1171829 | 1172773 | + | GENE_01157 | Prodigal: 2.6 | CDS | — | — | — | — | P40806 | pksJ_4 | — | — | Polyketide synthase PksJ |
| Contig1 | 1172758 | 1186776 | + | GENE_01158 | Prodigal: 2.6 | CDS | — | — | — | — | P40806 | pksJ_5 | — | — | Polyketide synthase PksJ |
| Contig1 | 1186778 | 1200205 | + | GENE_01159 | Prodigal: 2.6 | CDS | — | — | — | — | Q05470 | pksL_5 | — | — | Polyketide synthase PksL |
| Contig1 | 1200223 | 1210764 | + | GENE_01160 | Prodigal: 2.6 | CDS | — | — | — | — | P40872 | pksM_1 | — | — | Polyketide synthase PksM |
| Contig1 | 1210754 | 1227061 | + | GENE_01161 | Prodigal: 2.6 | CDS | 2.3.1.- | — | — | — | O31782 | pksN_2 | — | — | Polyketide synthase PksN |
| Contig1 | 1227075 | 1234532 | + | GENE_01162 | Prodigal: 2.6 | CDS | 2.3.1.- | — | — | — | O31784 | pksR_1 | — | — | Polyketide synthase PksR |
| Contig1 | 1234667 | 1235878 | - | GENE_01163 | Prodigal: 2.6 | CDS | 1.14.-.- | — | — | — | P33271 | — | — | — | Cytochrome P450 107B1 |
| Contig1 | 1236167 | 1236601 | + | GENE_01164 | Prodigal: 2.6 | CDS | 3.-.-.- | — | — | — | P42983 | nucB_1 | — | — | Sporulation-specific extracellular nuclease precursor |
| Contig1 | 1236721 | 1237416 | + | GENE_01165 | Prodigal: 2.6 | CDS | — | — | — | — | — | — | — | — | hypothetical protein |
| Contig1 | 1237450 | 1237812 | - | GENE_01166 | Prodigal: 2.6 | CDS | — | — | — | — | — | — | — | — | hypothetical protein |
| Contig1 | 1238005 | 1239333 | + | GENE_01167 | Prodigal: 2.6 | CDS | 3.4.21.- | — | — | — | O31788 | aprX | — | — | Serine protease AprX |
| Contig1 | 1239512 | 1239745 | + | GENE_01168 | Prodigal: 2.6 | CDS | — | — | — | — | — | — | — | — | hypothetical protein |
| Contig1 | 1240001 | 1240708 | + | GENE_01169 | Prodigal: 2.6 | CDS | — | — | — | — | — | — | — | — | hypothetical protein |
| Contig1 | 1240769 | 1241221 | + | GENE_01170 | Prodigal: 2.6 | CDS | — | — | PF02566.13 | — | — | — | — | — | OsmC-like protein |
| Contig1 | 1241235 | 1241588 | - | GENE_01171 | Prodigal: 2.6 | CDS | — | — | — | — | P0CW83 | ebrB | — | — | Multidrug resistance protein EbrB |
| Contig1 | 1241605 | 1241937 | - | GENE_01172 | Prodigal: 2.6 | CDS | — | — | — | — | P0CW81 | ebrA | — | — | Multidrug resistance protein EbrA |
| Contig1 | 1242058 | 1242363 | - | GENE_01173 | Prodigal: 2.6 | CDS | — | — | — | — | — | — | — | — | hypothetical protein |
| Contig1 | 1242464 | 1242868 | + | GENE_01174 | Prodigal: 2.6 | CDS | — | — | PF12788.1 | — | — | — | — | — | YmaF family protein |
| Contig1 | 1242967 | 1243911 | + | GENE_01175 | Prodigal: 2.6 | CDS | 2.5.1.75 | — | — | — | Q9KAC3 | miaA | — | — | tRNA dimethylallyltransferase |
| Contig1 | 1243951 | 1244172 | + | GENE_01176 | Prodigal: 2.6 | CDS | — | — | — | — | O31796 | hfq | — | — | RNA-binding protein Hfq |
| Contig1 | 1244269 | 1244544 | + | GENE_01177 | Prodigal: 2.6 | CDS | — | — | — | — | — | — | — | — | hypothetical protein |
| Contig1 | 1244627 | 1244842 | + | GENE_01178 | Prodigal: 2.6 | CDS | — | — | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1245102 | 1245494 | + | GENE_01179 | Prodigal: 2.6 | CDS | 1.17.4.1 | — | — | MF_00128 | P0CH00 | nrdI | — | — | Protein NrdI |
| Contig1 | 1245454 | 1247556 | + | GENE_01180 | Prodigal: 2.6 | CDS | 1.17.4.1 | — | — | — | — | nrdE2 | — | — | Ribonucleoside-diphosphate reductase subunit alpha 2 |
| Contig1 | 1247574 | 1248563 | + | GENE_01181 | Prodigal: 2.6 | CDS | 1.17.4.1 | — | — | — | P50621 | nrdF | — | — | Ribonucleoside-diphosphate reductase subunit beta |
| Contig1 | 1248612 | 1249232 | + | GENE_01182 | Prodigal: 2.6 | CDS | — | — | — | — | — | — | — | — | hypothetical protein |
| Contig1 | 1249282 | 1250040 | − | GENE_01183 | Prodigal: 2.6 | CDS | 3.5.1.28 | — | — | — | Q06320 | cwlC | — | — | Sporulation-specific N-acetylmuramoyl-L-alanine amidase |
| Contig1 | 1250347 | 1251315 | + | GENE_01184 | Prodigal: 2.6 | CDS | — | — | — | — | P27643 | spoVK | — | — | Stage V sporulation protein K |
| Contig1 | 1251445 | 1252707 | + | GENE_01185 | Prodigal: 2.6 | CDS | — | — | — | — | P25519 | hflX | — | — | GTPase HflX |
| Contig1 | 1252724 | 1253989 | + | GENE_01186 | Prodigal: 2.6 | CDS | 4.4.1.11 | — | — | — | P13254 | mdeA | — | — | Methionine gamma-lyase |
| Contig1 | 1254099 | 1254503 | + | GENE_01187 | Prodigal: 2.6 | CDS | — | — | — | — | P37582 | glnR | — | — | HTH-type transcriptional regulator GlnR |
| Contig1 | 1254561 | 1255895 | + | GENE_01188 | Prodigal: 2.6 | CDS | 6.3.1.2 | — | — | — | P12425 | glnA | — | — | Glutamine synthetase |
| Contig1 | 1256122 | 1257216 | − | GENE_01189 | Prodigal: 2.6 | CDS | — | — | PF03022.10 | — | — | — | — | — | Major royal jelly protein |
| Contig1 | 1257763 | 1259154 | + | GENE_01190 | Prodigal: 2.6 | CDS | — | — | — | — | P0CE45 | uidB | — | — | Glucuronide carrier protein |
| Contig1 | 1259197 | 1260798 | + | GENE_01191 | Prodigal: 2.6 | CDS | 3.2.1.37 | — | — | — | P94489 | xynB | — | — | Beta-xylosidase |
| Contig1 | 1260961 | 1262115 | − | GENE_01192 | Prodigal: 2.6 | CDS | — | — | — | — | P0AF20 | nagC | — | — | N-acetylglucosamine repressor |
| Contig1 | 1262379 | 1263716 | + | GENE_01193 | Prodigal: 2.6 | CDS | 5.3.1.5 | — | — | — | P54273 | xylA | — | — | Xylose isomerase |
| Contig1 | 1263850 | 1265349 | + | GENE_01194 | Prodigal: 2.6 | CDS | 2.7.1.17 | — | — | — | P35850 | xylB_1 | — | — | Xylulose kinase |
| Contig1 | 1265812 | 1268133 | + | GENE_01195 | Prodigal: 2.6 | CDS | 2.7.9.2 | — | — | — | Q9K0I2 | ppsA_1 | — | — | Phosphoenolpyruvate synthase |
| Contig1 | 1268962 | 1269060 | − | GENE_01196 | Prodigal: 2.6 | CDS | — | — | PF09680.4 | — | — | — | — | — | Protein of unknown function (Tiny_TM_bacill) |
| Contig1 | 1269874 | 1270059 | − | GENE_01197 | Prodigal: 2.6 | CDS | — | — | — | — | — | — | — | — | hypothetical protein |
| Contig1 | 1270304 | 1271320 | − | GENE_01198 | Prodigal: 2.6 | CDS | 1.1.1.1 | — | — | — | Q7A742 | adh | — | — | Alcohol dehydrogenase |
| Contig1 | 1271921 | 1272385 | + | GENE_01199 | Prodigal: 2.6 | CDS | — | — | — | — | — | — | — | — | hypothetical protein |
| Contig1 | 1272418 | 1273056 | + | GENE_01200 | Prodigal: 2.6 | CDS | — | — | — | — | — | — | — | — | hypothetical protein |
| Contig1 | 1273557 | 1274318 | + | GENE_01201 | Prodigal: 2.6 | CDS | — | PRK10809 | PF00583.18 | — | — | — | — | — | Acetyltransferase (GNAT) family protein |
| Contig1 | 1274536 | 1275078 | + | GENE_01202 | Prodigal: 2.6 | CDS | — | — | — | — | — | — | — | — | ribosomal-protein-S5-alanine N-acetyltransferase |
| Contig1 | 1275729 | 1276361 | + | GENE_01203 | Prodigal: 2.6 | CDS | — | — | — | — | — | — | — | — | hypothetical protein |
| Contig1 | 1276587 | 1277660 | + | GENE_01204 | Prodigal: 2.6 | CDS | 1.14.13.107 | — | — | — | Q9EUT9 | limB_1 | — | — | Limonene 1,2-monooxygenase |
| Contig1 | 1277874 | 1278494 | + | GENE_01205 | Prodigal: 2.6 | CDS | — | — | — | — | Q9KLD5 | gbpA | — | — | GlcNAc-binding protein A precursor |
| Contig1 | 1278659 | 1278757 | − | GENE_01206 | Prodigal: 2.6 | CDS | — | — | PF09680.4 | — | — | — | — | — | Protein of unknown function (Tiny_TM_bacill) |
| Contig1 | 1279030 | 1279533 | − | GENE_01207 | Prodigal: 2.6 | CDS | — | — | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1279546 | 1280082 | − | GENE_01208 | Prodigal: 2.6 | CDS | — | — | — | — | O32211 | yvgO_1 | — | — | Stress response protein YvgO precursor |
| Contig1 | 1280367 | 1280513 | — | GENE_01209 | Prodigal: 2.6 | CDS | — | — | — | — | — | — | — | — | hypothetical protein |
| Contig1 | 1280682 | 1283099 | — | GENE_01210 | Prodigal: 2.6 | CDS | — | — | PF12708.1 | — | — | — | — | — | Pectate lyase superfamily protein |
| Contig1 | 1283477 | 1283911 | + | GENE_01211 | Prodigal: 2.6 | CDS | 3.6.1.23 | — | — | — | O31801 | yncF | — | — | putative deoxyuridine 5′-triphosphate nucleotidohydrolase YncF |
| Contig1 | 1284187 | 1285008 | + | GENE_01212 | Prodigal: 2.6 | CDS | — | — | — | — | — | — | — | — | hypothetical protein |
| Contig1 | 1285117 | 1285266 | + | GENE_01213 | Prodigal: 2.6 | CDS | — | — | — | — | — | — | — | — | hypothetical protein |
| Contig1 | 1285253 | 1286083 | + | GENE_01214 | Prodigal: 2.6 | CDS | — | — | PF01145.19 | — | — | — | — | — | SPFH domain/Band 7 family protein |
| Contig1 | 1286111 | 1286560 | − | GENE_01215 | Prodigal: 2.6 | CDS | — | — | — | — | — | — | — | — | hypothetical protein |
| Contig1 | 1286702 | 1287130 | + | GENE_01216 | Prodigal: 2.6 | CDS | — | — | — | — | — | — | — | — | hypothetical protein |
| Contig1 | 1287469 | 1288089 | + | GENE_01217 | Prodigal: 2.6 | CDS | 3.4.21.88 | — | — | — | P31080 | lexA | — | — | LexA repressor |
| Contig1 | 1288246 | 1288557 | + | GENE_01218 | Prodigal: 2.6 | CDS | — | — | — | — | Q45056 | yneA | — | — | Cell division suppressor protein YneA |
| Contig1 | 1288573 | 1289223 | + | GENE_01219 | Prodigal: 2.6 | CDS | — | — | — | — | Q45057 | — | — | Resolvase homolog YneB | hypothetical protein |
| Contig1 | 1289292 | 1289525 | + | GENE_01220 | Prodigal: 2.6 | CDS | — | — | — | — | — | — | — | — | hypothetical protein |
| Contig1 | 1289692 | 1291695 | + | GENE_01221 | Prodigal: 2.6 | CDS | 2.2.1.1 | PRK02539 | — | — | P99161 | tkt | — | — | Transketolase |
| Contig1 | 1291847 | 1292293 | + | GENE_01222 | Prodigal: 2.6 | CDS | — | — | — | — | P45707 | sirA | — | — | Sporulation inhibitor of replication protein SirA |
| Contig1 | 1292379 | 1292597 | + | GENE_01223 | Prodigal: 2.6 | CDS | — | — | — | — | — | — | — | — | hypothetical protein |
| Contig1 | 1292671 | 1292844 | − | GENE_01224 | Prodigal: 2.6 | CDS | 3.1.3.- | PRK01844 | — | — | O31819 | ynzD | — | — | Aspartyl-phosphate phosphatase YnzD |
| Contig1 | 1293049 | 1293753 | + | GENE_01225 | Prodigal: 2.6 | CDS | — | — | PF02683.9 | — | — | — | — | — | Cytochrome C biogenesis protein transmembrane region |
| Contig1 | 1293838 | 1293987 | + | GENE_01226 | Prodigal: 2.6 | CDS | — | — | — | — | Q56312 | cheY_2 | — | — | Chemotaxis protein CheY |
| Contig1 | 1293984 | 1294199 | + | GENE_01227 | Prodigal: 2.6 | CDS | — | — | — | — | Q56312 | cheY_3 | — | — | Chemotaxis protein CheY |
| Contig1 | 1294288 | 1294770 | − | GENE_01228 | Prodigal: 2.6 | CDS | — | — | — | — | — | — | — | — | hypothetical protein |
| Contig1 | 1294798 | 1295226 | + | GENE_01229 | Prodigal: 2.6 | CDS | — | — | — | — | — | — | — | — | hypothetical protein |
| Contig1 | 1295460 | 1295831 | − | GENE_01230 | Prodigal: 2.6 | CDS | — | — | — | — | Q45058 | cotM | — | — | Spore coat protein M |
| Contig1 | 1295926 | 1296072 | − | GENE_01231 | Prodigal: 2.6 | CDS | — | — | — | — | P71032 | sspP | — | — | Small, acid-soluble spore protein P |
| Contig1 | 1296102 | 1296248 | − | GENE_01233 | Prodigal: 2.6 | CDS | — | — | — | — | P71031 | sspO | — | — | Small, acid-soluble spore protein O |
| Contig1 | 1296480 | 1299206 | + | GENE_01234 | Prodigal: 2.6 | CDS | 4.2.1.3 | — | — | — | P09339 | citB | — | — | Aconitate hydratase |
| Contig1 | 1299268 | 1299777 | + | GENE_01235 | Prodigal: 2.6 | CDS | — | — | — | — | Q81SZ9 | resA_1 | — | — | Thiol-disulfide oxidoreductase ResA |
| Contig1 | 1299856 | 1299981 | + | GENE_01236 | Prodigal: 2.6 | CDS | — | — | — | — | — | — | — | — | hypothetical protein |
| Contig1 | 1300045 | 1300191 | + | GENE_01237 | Prodigal: 2.6 | CDS | — | — | — | — | Q7WY69 | sspN | — | — | Small, acid-soluble spore protein N |
| Contig1 | 1300216 | 1300458 | + | GENE_01237 | Prodigal: 2.6 | CDS | — | — | — | — | Q45060 | tip | — | — | Small, acid-soluble spore protein Tip |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1300545 | 1300961 | + | GENE_01238 | Prodigal: 2.6 | CDS | 3.1.2.- | — | — | — | P0A8Z3 | ybgC | — | — | Acyl-CoA thioester hydrolase YbgC |
| Contig1 | 1300977 | 1301276 | + | GENE_01239 | Prodigal: 2.6 | CDS | — | — | PF01521.14 | — | — | — | — | — | hypothetical protein |
| Contig1 | 1301306 | 1301593 | — | GENE_01240 | Prodigal: 2.6 | CDS | — | — | — | — | — | — | — | — | Iron-sulphur cluster biosynthesis |
| Contig1 | 1301682 | 1302263 | — | GENE_01241 | Prodigal: 2.6 | CDS | 2.3.1.- | — | — | — | Q45064 | plsY | — | — | Glycerol-3-phosphate acyltransferase |
| Contig1 | 1302415 | 1302822 | + | GENE_01242 | Prodigal: 2.6 | CDS | — | — | — | — | — | — | — | — | hypothetical protein |
| Contig1 | 1303247 | 1305214 | + | GENE_01243 | Prodigal: 2.6 | CDS | 5.99.1.3 | — | — | — | P66939 | parE | — | — | DNA topoisomerase 4 subunit B |
| Contig1 | 1305217 | 1307640 | + | GENE_01244 | Prodigal: 2.6 | CDS | 5.99.1.3 | — | — | — | Q93KF4 | parC | — | — | DNA topoisomerase 4 subunit A |
| Contig1 | 1307687 | 1307812 | — | GENE_01245 | Prodigal: 2.6 | CDS | — | — | — | — | — | — | — | — | hypothetical protein |
| Contig1 | 1307837 | 1308190 | — | GENE_01246 | Prodigal: 2.6 | CDS | — | — | — | — | — | — | — | — | hypothetical protein |
| Contig1 | 1308567 | 1309985 | + | GENE_01247 | Prodigal: 2.6 | CDS | — | — | — | — | Q45068 | alsT_1 | — | — | Amino-acid carrier protein AlsT |
| Contig1 | 1310189 | 1311145 | + | GENE_01248 | Prodigal: 2.6 | CDS | 2.7.1.45 | — | — | — | Q53W83 | kdgK | — | — | 2-dehydro-3-deoxygluconokinase |
| Contig1 | 1311175 | 1312194 | + | GENE_01249 | Prodigal: 2.6 | CDS | 1.-.-.- | — | — | — | O35045 | yjmD | — | — | putative zinc-type alcohol dehydrogenase-like protein YjmD |
| Contig1 | 1312208 | 1312693 | + | GENE_01250 | Prodigal: 2.6 | CDS | — | — | — | — | P50846 | kdgA | — | — | KHG/KDPG aldolase |
| Contig1 | 1312699 | 1313469 | + | GENE_01251 | Prodigal: 2.6 | CDS | 4.2.1.8 | — | — | — | O34346 | uxuA_1 | — | — | Mannonate dehydratase |
| Contig1 | 1313584 | 1313919 | + | GENE_01252 | Prodigal: 2.6 | CDS | 4.2.1.8 | — | — | — | O34346 | uxuA_2 | — | — | Mannonate dehydratase |
| Contig1 | 1313916 | 1314752 | + | GENE_01253 | Prodigal: 2.6 | CDS | 1.-.-.- | — | — | — | O34896 | uxuB | — | — | putative oxidoreductase UxuB |
| Contig1 | 1314836 | 1315837 | + | GENE_01254 | Prodigal: 2.6 | CDS | — | — | — | — | P50844 | kdgR | — | — | HTH-type transcriptional regulator KdgR |
| Contig1 | 1315904 | 1316368 | + | GENE_01255 | Prodigal: 2.6 | CDS | — | — | — | — | O34456 | exuT_1 | — | — | Hexuronate transporter |
| Contig1 | 1316365 | 1317177 | + | GENE_01256 | Prodigal: 2.6 | CDS | — | — | — | — | O34456 | exuT_2 | — | — | Hexuronate transporter |
| Contig1 | 1317296 | 1318111 | + | GENE_01257 | Prodigal: 2.6 | CDS | — | — | — | — | — | — | — | — | hypothetical protein |
| Contig1 | 1318108 | 1318716 | + | GENE_01258 | Prodigal: 2.6 | CDS | — | — | — | — | — | — | — | — | hypothetical protein |
| Contig1 | 1318710 | 1320338 | + | GENE_01259 | Prodigal: 2.6 | CDS | — | — | — | — | — | — | — | — | hypothetical protein |
| Contig1 | 1321270 | 1322406 | — | GENE_01260 | Prodigal: 2.6 | CDS | — | — | PF03403.1 | — | — | — | — | — | hypothetical protein isoform II |
| Contig1 | 1322603 | 1324102 | + | GENE_01261 | Prodigal: 2.6 | CDS | 3.2.1.4 | — | — | — | P10475 | eglS | — | — | Endoglucanase precursor |
| Contig1 | 1324566 | 1324877 | + | GENE_01262 | Prodigal: 2.6 | CDS | — | — | — | — | — | — | — | — | hypothetical protein |
| Contig1 | 1324927 | 1326327 | — | GENE_01263 | Prodigal: 2.6 | CDS | 2.7.13.3 | — | — | — | Q45614 | yycG_1 | — | — | Sensor histidine kinase YycG |
| Contig1 | 1326330 | 1327037 | — | GENE_01264 | Prodigal: 2.6 | CDS | — | — | — | — | P39663 | sphR | — | — | Alkaline phosphatase synthesis transcriptional regulatory protein SphR |
| Contig1 | 1327180 | 1328451 | — | GENE_01265 | Prodigal: 2.6 | CDS | 3.2.1.136 | — | — | — | Q45070 | xynC | — | — | Glucuronoxylanase XynC precursor |
| Contig1 | 1328504 | 1329649 | — | GENE_01266 | Prodigal: 2.6 | CDS | 3.2.1.55 | — | — | — | Q45071 | xynD_1 | — | — | Arabinoxylan arabinofuranohydrolase precursor |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1329646 | 1330038 | − | GENE_01267 | Prodigal: 2.6 | CDS | 3.2.1.55 | — | — | — | Q45071 | xynD_2 | — | — | Arabinoxylan arabinofuranohydrolase precursor |
| Contig1 | 1330212 | 1338080 | − | GENE_01268 | Prodigal: 2.6 | CDS | — | — | — | — | Q70LM4 | lgrD_1 | — | — | Linear gramicidin synthase subunit D |
| Contig1 | 1338164 | 1354255 | − | GENE_01269 | Prodigal: 2.6 | CDS | — | — | — | — | P0C064 | grsB | — | — | Gramicidin S synthase 2 |
| Contig1 | 1354300 | 1366248 | − | GENE_01270 | Prodigal: 2.6 | CDS | — | — | — | — | O30409 | tycC | — | — | Tyrocidine synthase 3 |
| Contig1 | 1366268 | 1367470 | − | GENE_01271 | Prodigal: 2.6 | CDS | 2.3.1.39 | — | — | — | Q9R9J2 | fenF_1 | — | — | Malonyl CoA-acyl carrier protein transacylase |
| Contig1 | 1368028 | 1368813 | − | GENE_01272 | Prodigal: 2.6 | CDS | 1.1.1.30 | — | — | — | O86034 | bdhA_1 | — | — | D-beta-hydroxybutyrate dehydrogenase |
| Contig1 | 1368826 | 1369488 | − | GENE_01273 | Prodigal: 2.6 | CDS | 2.8.3.5 | — | — | — | P42316 | scoB_1 | — | — | putative succinyl-CoA:3-ketoacid coenzyme A transferase subunit B |
| Contig1 | 1369506 | 1370189 | − | GENE_01274 | Prodigal: 2.6 | CDS | 2.8.3.5 | — | — | — | P42315 | scoA | — | — | putative succinyl-CoA:3-ketoacid coenzyme A transferase subunit A |
| Contig1 | 1370232 | 1371677 | − | GENE_01275 | Prodigal: 2.6 | CDS | — | PRK09821 | — | — | P53554 | — | — | — | putative transporter |
| Contig1 | 1371980 | 1373176 | − | GENE_01276 | Prodigal: 2.6 | CDS | 1.14.15.12 | — | — | — | — | bioI | — | — | Biotin biosynthesis cytochrome P450 |
| Contig1 | 1373178 | 1374197 | − | GENE_01277 | Prodigal: 2.6 | CDS | 2.8.1.6 | — | — | — | P19206 | bioB_1 | — | — | Biotin synthase |
| Contig1 | 1374200 | 1374901 | − | GENE_01278 | Prodigal: 2.6 | CDS | 6.3.3.3 | — | — | — | P13000 | bioD1 | — | — | ATP-dependent dethiobiotin synthetase BioD 1 |
| Contig1 | 1374898 | 1376058 | − | GENE_01279 | Prodigal: 2.6 | CDS | 2.3.1.47 | — | — | — | P53556 | bioF | — | — | 8-amino-7-oxononanoate synthase 2 |
| Contig1 | 1376048 | 1377394 | − | GENE_01280 | Prodigal: 2.6 | CDS | 2.6.1.- | — | — | — | P53555 | bioK | — | — | L-Lysine-8-amino-7-oxononanoate aminotransferase |
| Contig1 | 1377391 | 1378161 | − | GENE_01281 | Prodigal: 2.6 | CDS | 6.2.1.14 | — | — | — | P22822 | bioW | — | — | 6-carboxyhexanoate--CoA ligase |
| Contig1 | 1378440 | 1378847 | + | GENE_01282 | Prodigal: 2.6 | CDS | — | — | PF04138.8 | — | — | — | — | — | GtrA-like protein |
| Contig1 | 1378854 | 1379747 | + | GENE_01283 | Prodigal: 2.6 | CDS | 2.7.7.9 | — | — | — | Q05852 | gtaB_1 | — | — | UTP--glucose-1-phosphate uridylyltransferase |
| Contig1 | 1379822 | 1380412 | + | GENE_01284 | Prodigal: 2.6 | CDS | — | — | — | — | P30149 | yabI | — | — | Inner membrane protein YabI |
| Contig1 | 1380465 | 1381994 | − | GENE_01285 | Prodigal: 2.6 | CDS | 2.1.3.1 | — | — | — | Q8GBW6 | — | — | — | Methylmalonyl-CoA carboxyltransferase 12S subunit |
| Contig1 | 1382012 | 1382791 | − | GENE_01286 | Prodigal: 2.6 | CDS | 4.2.1.17 | — | — | — | P64016 | echA8 | — | — | putative enoyl-CoA hydratase echA8 |
| Contig1 | 1382805 | 1383704 | − | GENE_01287 | Prodigal: 2.6 | CDS | 4.1.3.4 | — | — | — | O34873 | yngG | — | — | Hydroxymethylglutaryl-CoA lyase YngG |
| Contig1 | 1383720 | 1383932 | − | GENE_01288 | Prodigal: 2.6 | CDS | — | — | — | — | C0H419 | yngHB | — | — | Biotin/lipoyl attachment protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1383929 | 1385278 | − | GENE_01289 | Prodigal: 2.6 | CDS | 6.4.1.7 | — | — | — | D3DJ42 | cfiB_2 | — | — | 2-oxoglutarate carboxylase small subunit |
| Contig1 | 1385300 | 1386940 | − | GENE_01290 | Prodigal: 2.6 | CDS | 6.2.1.3 | — | — | — | O07610 | lcfB_2 | — | — | Long-chain-fatty-acid-CoA ligase |
| Contig1 | 1386985 | 1388127 | − | GENE_01291 | Prodigal: 2.6 | CDS | 1.3.99.- | — | — | — | P45867 | acdA | — | — | Acyl-CoA dehydrogenase |
| Contig1 | 1388268 | 1389806 | − | GENE_01292 | Prodigal: 2.6 | CDS | — | — | — | — | — | — | — | — | hypothetical protein |
| Contig1 | 1389928 | 1390308 | − | GENE_01293 | Prodigal: 2.6 | CDS | — | — | — | — | O31623 | yjcA_2 | — | — | Sporulation protein YjcA |
| Contig1 | 1390384 | 1394187 | − | GENE_01294 | Prodigal: 2.6 | CDS | 2.3.1.- | — | — | — | O31827 | PPsE | — | — | Plipastatin synthase subunit E |
| Contig1 | 1394206 | 1404981 | − | GENE_01295 | Prodigal: 2.6 | CDS | 2.3.1.- | — | — | — | P94459 | ppsD | — | — | Plipastatin synthase subunit D |
| Contig1 | 1405007 | 1410124 | − | GENE_01296 | Prodigal: 2.6 | CDS | 2.3.1.- | — | — | — | P39847 | ppsC_1 | — | — | Plipastatin synthase subunit C |
| Contig1 | 1410184 | 1412655 | − | GENE_01297 | Prodigal: 2.6 | CDS | 2.3.1.- | — | — | — | P39847 | ppsC_2 | — | — | Plipastatin synthase subunit C |
| Contig1 | 1412671 | 1420368 | − | GENE_01298 | Prodigal: 2.6 | CDS | 2.3.1.- | — | — | — | P39846 | ppsB_1 | — | — | Plipastatin synthase subunit B |
| Contig1 | 1420394 | 1428052 | − | GENE_01299 | Prodigal: 2.6 | CDS | 2.3.1.- | — | — | — | P39845 | ppsA_2 | — | — | Plipastatin synthase subunit A |
| Contig1 | 1428532 | 1430007 | − | GENE_01300 | Prodigal: 2.6 | CDS | 3.4.16.4 | — | — | — | P39844 | dacC | — | — | D-alanyl-D-alanine carboxypeptidase DacC precursor |
| Contig1 | 1430025 | 1431000 | − | GENE_01301 | Prodigal: 2.6 | CDS | 5.1.3.3 | — | — | — | P39840 | galM | — | — | Aldose 1-epimerase |
| Contig1 | 1431110 | 1432498 | − | GENE_01302 | Prodigal: 2.6 | CDS | — | — | — | — | Q7A7N0 | mepA | — | — | Multidrug export protein MepA |
| Contig1 | 1432727 | 1433269 | + | GENE_01303 | Prodigal: 2.6 | CDS | — | — | — | — | — | — | — | — | hypothetical protein |
| Contig1 | 1433415 | 1433487 | − | GENE_01304 | Aragorn: 1.2 | tRNA | — | — | — | — | — | — | — | — | tRNA-Arg(cct) |
| Contig1 | 1433530 | 1434075 | − | GENE_01305 | Prodigal: 2.6 | CDS | — | — | — | MF_01808 | — | xerC_2 | — | — | Tyrosine recombinase XerC |
| Contig1 | 1434391 | 1434621 | − | GENE_01306 | Prodigal: 2.6 | CDS | — | — | PF12728.1 | — | — | — | — | — | Helix-turn-helix domain protein |
| Contig1 | 1434865 | 1436640 | + | GENE_01307 | Prodigal: 2.6 | CDS | 2.32.2 | — | — | — | P54422 | ggt | — | — | Gamma-glutamyltranspeptidase precursor |
| Contig1 | 1436687 | 1437862 | − | GENE_01308 | Prodigal: 2.6 | CDS | — | PRK10141 | — | — | Q797E3 | pbuE_2 | — | — | Purine efflux pump PbuE |
| Contig1 | 1438006 | 1438308 | − | GENE_01309 | Prodigal: 2.6 | CDS | — | — | — | — | — | — | — | — | DNA-binding transcriptional repressor ArsR |
| Contig1 | 1438346 | 1440274 | − | GENE_01310 | Prodigal: 2.6 | CDS | 6.1.1.3 | — | — | — | P18256 | thrZ | — | — | Threonine-tRNA ligase 2 |
| Contig1 | 1440920 | 1441786 | − | GENE_01311 | Prodigal: 2.6 | CDS | — | — | — | — | O34685 | yofA_1 | — | — | HTH-type transcriptional regulator YofA |
| Contig1 | 1441905 | 1442885 | + | GENE_01312 | Prodigal: 2.6 | CDS | 1.3.1.86 | — | — | — | Q82LU9 | ccrA2 | — | — | Crotonyl-CoA reductase |
| Contig1 | 1443261 | 1444742 | − | GENE_01313 | Prodigal: 2.6 | CDS | 1.4.1.13 | — | — | — | O34399 | gltB | — | — | Glutamate synthase [NADPH] small chain |
| Contig1 | 1444759 | 1449318 | − | GENE_01314 | Prodigal: 2.6 | CDS | 1.4.1.13 | — | — | — | P39812 | gltA_2 | — | — | Glutamate synthase [NADPH] large chain |
| Contig1 | 1449455 | 1450366 | + | GENE_01315 | Prodigal: 2.6 | CDS | — | — | — | — | P20668 | gltC_1 | — | — | HTH-type transcriptional regulator GltC |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1450427 | 1451545 | − | GENE_01316 | Prodigal: 2.6 | CDS | 2.7.2.11 | — | — | — | P39820 | proB_2 | — | — | Glutamate 5-kinase 1 |
| Contig1 | 1451570 | 1452367 | − | GENE_01317 | Prodigal: 2.6 | CDS | 1.5.1.2 | — | — | — | P22008 | proC_1 | — | — | Pyrroline-5-carboxylate reductase |
| Contig1 | 1452595 | 1452972 | − | GENE_01318 | Prodigal: 2.6 | CDS | — | — | — | — | P0CI76 | — | — | Replication termination protein | hypothetical protein |
| Contig1 | 1453249 | 1453965 | − | GENE_01319 | Prodigal: 2.6 | CDS | 1.1.1.100 | — | — | — | P99093 | fabG_3 | — | — | 3-oxoacyl-[acyl-carrier-protein] reductase FabG |
| Contig1 | 1454095 | 1454400 | + | GENE_01320 | Prodigal: 2.6 | CDS | — | — | — | — | — | — | — | — | hypothetical protein |
| Contig1 | 1454466 | 1455227 | + | GENE_01321 | Prodigal: 2.6 | CDS | — | — | — | — | — | — | — | — | hypothetical protein |
| Contig1 | 1455259 | 1456506 | − | GENE_01322 | Prodigal: 2.6 | CDS | — | — | — | — | O34864 | yoaB | — | — | Putative transporter YoaB |
| Contig1 | 1456554 | 1458020 | − | GENE_01323 | Prodigal: 2.6 | CDS | 2.7.1.- | — | — | — | O34861 | yoaC | — | — | Putative sugar kinase YoaC |
| Contig1 | 1458013 | 1459029 | − | GENE_01324 | Prodigal: 2.6 | CDS | 1.1.1.- | — | — | — | O34815 | yoaD | — | — | Putative 2-hydroxyacid dehydrogenase YoaD |
| Contig1 | 1459391 | 1461454 | + | GENE_01325 | Prodigal: 2.6 | CDS | 1.8.5.3 | — | — | — | P18775 | dmsA_1 | — | — | Dimethyl sulfoxide reductase DmsA precursor |
| Contig1 | 1461538 | 1461822 | + | GENE_01326 | Prodigal: 2.6 | CDS | — | — | — | — | — | — | — | — | hypothetical protein |
| Contig1 | 1461866 | 1462081 | + | GENE_01327 | Prodigal: 2.6 | CDS | — | — | — | — | — | — | — | — | hypothetical protein |
| Contig1 | 1462280 | 1462858 | + | GENE_01328 | Prodigal: 2.6 | CDS | — | — | PF12802.1 | — | — | — | — | — | MarR family protein |
| Contig1 | 1462851 | 1463132 | + | GENE_01329 | Prodigal: 2.6 | CDS | — | — | — | — | — | — | — | — | hypothetical protein |
| Contig1 | 1463515 | 1464261 | − | GENE_01330 | Prodigal: 2.6 | CDS | 1.1.1.47 | — | — | — | P12310 | gdh_1 | — | — | Glucose 1-dehydrogenase |
| Contig1 | 1464430 | 1464786 | + | GENE_01331 | Prodigal: 2.6 | CDS | — | — | — | — | O34533 | ytcD_1 | — | — | putative HTH-type transcriptional regulator YtcD |
| Contig1 | 1465386 | 1465718 | − | GENE_01332 | Prodigal: 2.6 | CDS | 6.1.1.10 | — | — | — | P67579 | metG_1 | — | — | Methionine--tRNA ligase |
| Contig1 | 1465787 | 1466497 | − | GENE_01333 | Prodigal: 2.6 | CDS | — | — | — | — | P40408 | btr_1 | — | — | HTH-type transcriptional activator Btr |
| Contig1 | 1466548 | 1467114 | − | GENE_01334 | Prodigal: 2.6 | CDS | — | — | PF00440.17 | — | — | — | — | — | Bacterial regulatory proteins, tetR family |
| Contig1 | 1467114 | 1467494 | − | GENE_01335 | Prodigal: 2.6 | CDS | — | — | — | — | — | — | — | — | hypothetical protein |
| Contig1 | 1467455 | 1467832 | − | GENE_01336 | Prodigal: 2.6 | CDS | 3.-.-.- | — | — | — | Q5XD24 | — | — | — | putative metallo-hydrolase |
| Contig1 | 1468056 | 1468577 | + | GENE_01337 | Prodigal: 2.6 | CDS | — | — | — | — | — | — | — | — | hypothetical protein |
| Contig1 | 1468607 | 1468939 | − | GENE_01338 | Prodigal: 2.6 | CDS | — | — | — | — | O31844 | czrA | — | — | HTH-type transcriptional repressor CzrA |
| Contig1 | 1469131 | 1469796 | + | GENE_01339 | Prodigal: 2.6 | CDS | — | — | — | — | — | — | — | — | hypothetical protein |
| Contig1 | 1469861 | 1470397 | + | GENE_01340 | Prodigal: 2.6 | CDS | — | — | — | — | — | — | — | — | hypothetical protein |
| Contig1 | 1470542 | 1471324 | − | GENE_01341 | Prodigal: 2.6 | CDS | — | — | — | — | — | — | — | — | hypothetical protein |
| Contig1 | 1471519 | 1472016 | + | GENE_01342 | Prodigal: 2.6 | CDS | — | — | — | — | — | — | — | — | hypothetical protein |
| Contig1 | 1472080 | 1473057 | + | GENE_01343 | Prodigal: 2.6 | CDS | 3.4.16.- | — | — | — | O34851 | ykfA_2 | — | — | putative murein peptide carboxypeptidase |
| Contig1 | 1473089 | 1473514 | − | GENE_01344 | Prodigal: 2.6 | CDS | — | — | — | — | — | — | — | — | hypothetical protein |
| Contig1 | 1473643 | 1474515 | − | GENE_01345 | Prodigal: 2.6 | CDS | — | — | — | — | O34669 | yocH_1 | — | — | Cell wall-binding protein YocH precursor |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1474751 | 1476529 | − | GENE_01346 | Prodigal: 2.6 | CDS | 3.6.4.12 | — | — | — | P15043 | recQ_1 | — | — | ATP-dependent DNA helicase RecQ |
| Contig1 | 1477037 | 1477663 | − | GENE_01347 | Prodigal: 2.6 | CDS | 1.7.-.- | — | — | — | O35022 | azoR1 | — | — | FMN-dependent NADH-azoreductase 1 |
| Contig1 | 1477687 | 1477788 | − | GENE_01348 | Prodigal: 2.6 | CDS | — | — | — | — | — | — | — | — | hypothetical protein |
| Contig1 | 1477808 | 1478299 | − | GENE_01349 | Prodigal: 2.6 | CDS | — | — | — | — | P80872 | yocK2 | — | — | General stress protein 160 |
| Contig1 | 1478383 | 1478730 | − | GENE_01350 | Prodigal: 2.6 | CDS | — | — | — | — | — | — | — | — | hypothetical protein |
| Contig1 | 1478856 | 1479089 | + | GENE_01351 | Prodigal: 2.6 | CDS | — | — | — | — | — | — | — | — | hypothetical protein |
| Contig1 | 1479076 | 1479558 | + | GENE_01352 | Prodigal: 2.6 | CDS | — | — | — | — | P96698 | cotP_2 | — | — | Spore coat protein P |
| Contig1 | 1479629 | 1479901 | + | GENE_01353 | Prodigal: 2.6 | CDS | — | — | — | — | — | — | — | — | hypothetical protein |
| Contig1 | 1479898 | 1480131 | + | GENE_01354 | Prodigal: 2.6 | CDS | — | — | — | — | — | — | — | — | hypothetical protein |
| Contig1 | 1480176 | 1480520 | − | GENE_01355 | Prodigal: 2.6 | CDS | — | — | — | — | — | — | — | — | hypothetical protein |
| Contig1 | 1480813 | 1480953 | − | GENE_01356 | Prodigal: 2.6 | CDS | — | — | — | — | — | — | — | — | hypothetical protein |
| Contig1 | 1481019 | 1481222 | − | GENE_01357 | Prodigal: 2.6 | CDS | — | — | — | — | — | — | — | — | hypothetical protein |
| Contig1 | 1481405 | 1482892 | + | GENE_01358 | Prodigal: 2.6 | CDS | 1.2.1.39 | — | — | — | P80668 | feaB | — | — | Phenylacetaldehyde dehydrogenase |
| Contig1 | 1482988 | 1484871 | + | GENE_01359 | Prodigal: 2.6 | CDS | 4.2.1.137 | — | — | — | Q796C3 | sqhC | — | — | Sporulenol synthase |
| Contig1 | 1484868 | 1485713 | + | GENE_01360 | Prodigal: 2.6 | CDS | 1.15.1.1 | — | — | — | P80293 | sodA_1 | — | — | Superoxide dismutase [Mn/Fe] |
| Contig1 | 1485754 | 1487091 | − | GENE_01361 | Prodigal: 2.6 | CDS | — | — | PF00209.12 | — | — | — | — | — | Sodium:neurotransmitter symporter family protein |
| Contig1 | 1487295 | 1488263 | + | GENE_01362 | Prodigal: 2.6 | CDS | — | — | PF01758.10 | — | — | — | — | — | Sodium Bile acid symporter family protein |
| Contig1 | 1488291 | 1489037 | − | GENE_01363 | Prodigal: 2.6 | CDS | 3.-.-.- | — | — | — | O34409 | yflN_2 | — | — | putative metallo-hydrolase YflN |
| Contig1 | 1489111 | 1490358 | − | GENE_01364 | Prodigal: 2.6 | CDS | 2.3.1.61 | — | — | — | Q7A5N4 | odhB | — | — | Dihydrolipoyllysine-residue succinyltransferase component of 2-oxoglutarate dehydrogenase complex |
| Contig1 | 1490374 | 1493228 | − | GENE_01365 | Prodigal: 2.6 | CDS | 1.2.4.2 | — | — | — | Q931R8 | odhA | — | — | 2-oxoglutarate dehydrogenase E1 component |
| Contig1 | 1493436 | 1495352 | − | GENE_01366 | Prodigal: 2.6 | CDS | — | — | PF11775.2 | — | — | — | — | — | Cobalamin biosynthesis protein CobT VWA domain protein |
| Contig1 | 1495363 | 1496253 | − | GENE_01367 | Prodigal: 2.6 | CDS | — | — | — | — | Q02441 | nirQ | — | — | Denitrification regulatory protein NirQ |
| Contig1 | 1496331 | 1496921 | − | GENE_01368 | Prodigal: 2.6 | CDS | — | — | — | — | O31851 | yojM | — | — | Superoxide dismutase-like protein YojM precursor |
| Contig1 | 1497005 | 1498246 | − | GENE_01369 | Prodigal: 2.6 | CDS | 3.4.19.11 | — | — | — | O31852 | cwlS | — | — | D-gamma-glutamyl-meso-diaminopimelic acid endopeptidase CwlS precursor |
| Contig1 | 1498567 | 1499778 | − | GENE_01370 | Prodigal: 2.6 | CDS | 2.4.1.- | — | — | — | Q53685 | oleD_3 | — | — | Oleandomycin glycosyltransferase |
| Contig1 | 1499897 | 1500523 | − | GENE_01371 | Prodigal: 2.6 | CDS | 2.7.7.85 | — | — | MF_01438 | — | disA_1 | — | — | DNA integrity scanning protein DisA |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1500616 | 1500726 | + | GENE_01372 | Prodigal: 2.6 | CDS | — | — | — | — | — | — | — | — | hypothetical protein |
| Contig1 | 1500801 | 1502162 | + | GENE_01373 | Prodigal: 2.6 | CDS | — | — | — | — | O82855 | norM_2 | — | — | Multidrug resistance protein NorM |
| Contig1 | 1502176 | 1503024 | + | GENE_01374 | Prodigal: 2.6 | CDS | — | — | — | — | O31856 | rsbRC | — | — | RsbT co-antagonist protein RsbRC |
| Contig1 | 1503052 | 1503717 | − | GENE_01375 | Prodigal: 2.6 | CDS | 3.5.1.103 | — | — | — | Q9F344 | mshB_1 | — | — | 1 D-myo-inositol 2-acetamido-2-deoxy-alpha-D-glucopyranoside deacetylase |
| Contig1 | 1503735 | 1504085 | − | GENE_01376 | Prodigal: 2.6 | CDS | — | — | — | — | — | — | — | — | hypothetical protein |
| Contig1 | 1504082 | 1504360 | − | GENE_01377 | Prodigal: 2.6 | CDS | — | — | — | — | — | — | — | — | hypothetical protein |
| Contig1 | 1504428 | 1505324 | − | GENE_01378 | Prodigal: 2.6 | CDS | — | — | — | — | — | — | — | — | putative DMT superfamily transporter inner membrane protein |
| Contig1 | 1505422 | 1505886 | + | GENE_01379 | Prodigal: 2.6 | CDS | — | — | — | — | Q7WY67 | gerT | — | — | Spore germination protein GerT |
| Contig1 | 1505921 | 1506160 | − | GENE_01380 | Prodigal: 2.6 | CDS | — | — | — | — | — | — | — | — | hypothetical protein |
| Contig1 | 1506314 | 1506703 | + | GENE_01381 | Prodigal: 2.6 | CDS | — | — | PF01361.1 | — | — | — | — | — | Tautomerase enzyme |
| Contig1 | 1506756 | 1507124 | + | GENE_01382 | Prodigal: 2.6 | CDS | — | — | — | — | — | — | — | — | hypothetical protein |
| Contig1 | 1507164 | 1507493 | − | GENE_01383 | Prodigal: 2.6 | CDS | — | — | — | — | O34844 | yodB_1 | — | — | HTH-type transcriptional regulator YodB |
| Contig1 | 1507635 | 1508243 | + | GENE_01384 | Prodigal: 2.6 | CDS | 1.-.-.- | — | — | — | P81102 | yodC_1 | — | — | Putative NAD(P)H nitroreductase YodC |
| Contig1 | 1508287 | 1508889 | − | GENE_01385 | Prodigal: 2.6 | CDS | 3.1.-.- | — | — | — | O34842 | mhqD | — | — | Putative hydrolase MhqD |
| Contig1 | 1508892 | 1509815 | − | GENE_01386 | Prodigal: 2.6 | CDS | 1.13.11.- | — | — | — | O34543 | mhqE | — | — | Putative ring-cleaving dioxygenase MhqE |
| Contig1 | 1510001 | 1510201 | + | GENE_01387 | Prodigal: 2.6 | CDS | — | — | — | — | — | — | — | — | hypothetical protein |
| Contig1 | 1510201 | 1511703 | + | GENE_01388 | Prodigal: 2.6 | CDS | — | — | — | — | O34745 | yodF_2 | — | — | putative symporter YodF |
| Contig1 | 1511738 | 1513216 | − | GENE_01389 | Prodigal: 2.6 | CDS | — | — | PF02055.10 | — | — | — | — | — | O-Glycosyl hydrolase family 30 |
| Contig1 | 1513364 | 1514806 | − | GENE_01390 | Prodigal: 2.6 | CDS | 3.2.1.86 | — | — | — | P42973 | bglA | — | — | Aryl-phospho-beta-D-glucosidase BglA |
| Contig1 | 1515056 | 1515781 | + | GENE_01391 | Prodigal: 2.6 | CDS | — | — | — | — | Q45591 | yydK | — | — | putative HTH-type transcriptional regulator YydK |
| Contig1 | 1515842 | 1517245 | − | GENE_01392 | Prodigal: 2.6 | CDS | 3.4.21.102 | — | — | — | O34666 | ctpA | — | — | Carboxy-terminal processing protease CtpA precursor |
| Contig1 | 1517392 | 1518093 | + | GENE_01393 | Prodigal: 2.6 | CDS | 2.1.1.197 | — | — | — | P36571 | bioC | — | — | Malonyl-[acyl-carrier protein] O-methyltransferase |
| Contig1 | 1518186 | 1518440 | + | GENE_01394 | Prodigal: 2.6 | CDS | — | — | — | — | — | — | — | — | hypothetical protein |
| Contig1 | 1518484 | 1519302 | − | GENE_01395 | Prodigal: 2.6 | CDS | 3.4.16.4 | — | — | — | Q47746 | vanYB | — | — | D-alanyl-D-alanine carboxypeptidase |
| Contig1 | 1519386 | 1520084 | − | GENE_01396 | Prodigal: 2.6 | CDS | 2.4.2.1 | — | — | — | O34925 | deoD | — | — | Purine nucleoside phosphorylase DeoD-type |
| Contig1 | 1520220 | 1520345 | + | GENE_01397 | Prodigal: 2.6 | CDS | — | — | — | — | — | — | — | — | hypothetical protein |
| Contig1 | 1520400 | 1520720 | − | GENE_01398 | Prodigal: 2.6 | CDS | — | — | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1520780 | 1521448 | − | GENE_01399 | Prodigal: 2.6 | CDS | — | PRK10699 | — | — | — | — | — | — | phosphatidylglycero-phosphatase B |
| Contig1 | 1521464 | 1521637 | − | GENE_01400 | Prodigal: 2.6 | CDS | — | — | — | — | — | — | — | — | hypothetical protein |
| Contig1 | 1521755 | 1521898 | + | GENE_01401 | Prodigal: 2.6 | CDS | — | — | — | — | — | — | — | — | hypothetical protein |
| Contig1 | 1521895 | 1522575 | − | GENE_01402 | Prodigal: 2.6 | CDS | — | — | — | — | — | — | — | — | hypothetical protein |
| Contig1 | 1522321 | 1522645 | − | GENE_01403 | Prodigal: 2.6 | CDS | — | — | — | — | — | — | — | — | hypothetical protein |
| Contig1 | 1523620 | 1523898 | − | GENE_01404 | Prodigal: 2.6 | CDS | — | — | — | — | — | — | — | — | hypothetical protein |
| Contig1 | 1523895 | 1525316 | − | GENE_01405 | Prodigal: 2.6 | CDS | 5.4.3.2 | — | — | — | O34676 | kamA | — | — | L-lysine 2,3-aminomutase |
| Contig1 | 1525313 | 1526179 | − | GENE_01406 | Prodigal: 2.6 | CDS | 2.3.1.- | — | — | — | O34895 | yodP | — | — | N-acetyltransferase YodP |
| Contig1 | 1526148 | 1526606 | − | GENE_01407 | Prodigal: 2.6 | CDS | 3.5.1.- | — | — | — | Q9K9G9 | — | — | — | N-formyl-4-amino-5-aminomethyl-2-methylpyrimidine deformylase |
| Contig1 | 1526615 | 1527448 | − | GENE_01408 | Prodigal: 2.6 | CDS | 3.5.1.- | — | — | — | Q9K9G9 | — | — | — | N-formyl-4-amino-5-aminomethyl-2-methylpyrimidine deformylase |
| Contig1 | 1527420 | 1528115 | − | GENE_01409 | Prodigal: 2.6 | CDS | 2.8.3.5 | — | — | — | P42316 | scoB_2 | — | — | putative succinyl-CoA:3-ketoacid coenzyme A transferase subunit B |
| Contig1 | 1528100 | 1528789 | − | GENE_01410 | Prodigal: 2.6 | CDS | 2.8.3.8 | — | — | — | P76458 | atoD | — | — | Acetate CoA-transferase subunit alpha |
| Contig1 | 1528796 | 1530127 | − | GENE_01411 | Prodigal: 2.6 | CDS | 2.6.1.77 | — | — | — | Q9APM5 | tpa_2 | — | — | Taurine–pyruvate aminotransferase |
| Contig1 | 1530689 | 1530841 | − | GENE_01412 | Prodigal: 2.6 | CDS | — | — | PF09680.4 | — | — | — | — | — | hypothetical protein |
| Contig1 | 1530979 | 1531125 | − | GENE_01413 | Prodigal: 2.6 | CDS | — | — | — | — | — | — | — | — | Protein of unknown function (Tiny_TM_bacill) |
| Contig1 | 1531204 | 1531983 | − | GENE_01414 | Prodigal: 2.6 | CDS | — | — | PF00583.18 | — | — | — | — | — | Acetyltransferase (GNAT) family protein |
| Contig1 | 1532022 | 1533293 | − | GENE_01415 | Prodigal: 2.6 | CDS | — | — | — | — | P39621 | spsA_1 | — | — | Spore coat polysaccharide biosynthesis protein SpsA |
| Contig1 | 1533358 | 1533657 | − | GENE_01416 | Prodigal: 2.6 | CDS | — | — | — | — | — | — | — | — | hypothetical protein |
| Contig1 | 1533869 | 1534300 | + | GENE_01417 | Prodigal: 2.6 | CDS | — | — | — | — | — | — | — | — | hypothetical protein |
| Contig1 | 1534307 | 1535263 | − | GENE_01418 | Prodigal: 2.6 | CDS | — | — | — | — | O31681 | ykvP | — | — | Spore protein YkvP |
| Contig1 | 1535313 | 1536464 | − | GENE_01419 | Prodigal: 2.6 | CDS | 3.1.3.8 | — | — | — | O66037 | phy | — | — | 3-phytase precursor |
| Contig1 | 1536780 | 1537205 | + | GENE_01420 | Prodigal: 2.6 | CDS | 5.1.3.2 | — | — | — | Q9ZDJ5 | capD | — | — | UDP-glucose 4-epimerase |
| Contig1 | 1537239 | 1537415 | − | GENE_01421 | Prodigal: 2.6 | CDS | — | — | — | — | — | — | — | — | hypothetical protein |
| Contig1 | 1537767 | 1538024 | − | GENE_01422 | Prodigal: 2.6 | CDS | — | — | — | — | — | — | — | — | hypothetical protein |
| Contig1 | 1538331 | 1538498 | + | GENE_01423 | Prodigal: 2.6 | CDS | — | — | — | — | — | — | — | — | hypothetical protein |
| Contig1 | 1538523 | 1538723 | − | GENE_01424 | Prodigal: 2.6 | CDS | — | — | — | — | — | — | — | — | hypothetical protein |
| Contig1 | 1539367 | 1539741 | − | GENE_01425 | Prodigal: 2.6 | CDS | — | — | — | — | — | — | — | — | hypothetical protein |
| Contig1 | 1539973 | 1540425 | + | GENE_01426 | Prodigal: 2.6 | CDS | — | — | — | — | — | — | — | — | hypothetical protein |
| Contig1 | 1540768 | 1541904 | + | GENE_01427 | Prodigal: 2.6 | CDS | 3.1.-.- | — | — | — | Q00828 | rapA_2 | — | — | Response regulator aspartate phosphatase A |
| Contig1 | 1541858 | 1542076 | + | GENE_01428 | Prodigal: 2.6 | CDS | — | — | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1542403 | 1543194 | + | GENE_01429 | Prodigal: 2.6 | CDS | — | — | — | — | — | — | — | — | hypothetical protein |
| Contig1 | 1543488 | 1543847 | − | GENE_01430 | Prodigal: 2.6 | CDS | — | — | — | — | — | — | — | — | hypothetical protein |
| Contig1 | 1544059 | 1544517 | − | GENE_01431 | Prodigal: 2.6 | CDS | — | — | — | — | — | — | — | — | Antitoxin YobK |
| Contig1 | 1544533 | 1546332 | − | GENE_01432 | Prodigal: 2.6 | CDS | 3.1.-.- | — | — | — | O34596 | yobK | — | — | Ribonuclease YobL |
| Contig1 | 1546369 | 1546803 | − | GENE_01433 | Prodigal: 2.6 | CDS | — | — | PF09346 | — | O34330 | yobL | — | — | SMI1/KNR4 family protein |
| Contig1 | 1546743 | 1546901 | − | GENE_01434 | Prodigal: 2.6 | CDS | — | — | — | — | — | — | — | — | hypothetical protein |
| Contig1 | 1547065 | 1548045 | + | GENE_01435 | Prodigal: 2.6 | CDS | 3.1.-.- | — | — | — | O32001 | yokF | — | — | SPBc2 prophage-derived endonuclease YokF precursor |
| Contig1 | 1548174 | 1548494 | − | GENE_01436 | Prodigal: 2.6 | CDS | — | — | — | — | — | — | — | — | hypothetical protein |
| Contig1 | 1548518 | 1549081 | − | GENE_01437 | Prodigal: 2.6 | CDS | — | — | — | — | — | — | — | — | hypothetical protein |
| Contig1 | 1549455 | 1551122 | + | GENE_01438 | Prodigal: 2.6 | CDS | — | — | PF07508.7 | — | — | — | — | — | Recombinase |
| Contig1 | 1551163 | 1551735 | + | GENE_01439 | Prodigal: 2.6 | CDS | 4.2.1.115 | — | — | — | Q0P8W4 | pseB | — | — | UDP-N-acetylglucosamine 4,6-dehydratase (inverting) |
| Contig1 | 1551776 | 1552210 | − | GENE_01440 | Prodigal: 2.6 | CDS | 1.8.4.12 | — | — | — | P54155 | msrB | — | — | Peptide methionine sulfoxide reductase MsrB |
| Contig1 | 1552212 | 1552745 | − | GENE_01441 | Prodigal: 2.6 | CDS | 1.8.4.11 | — | — | — | P54154 | msrA | — | — | Peptide methionine sulfoxide reductase MsrA |
| Contig1 | 1552895 | 1553299 | + | GENE_01442 | Prodigal: 2.6 | CDS | — | — | — | — | O32181 | yusO_3 | — | — | putative HTH-type transcriptional regulator YusO |
| Contig1 | 1553350 | 1553916 | − | GENE_01443 | Prodigal: 2.6 | CDS | — | — | — | — | — | — | — | — | hypothetical protein |
| Contig1 | 1553923 | 1554678 | − | GENE_01444 | Prodigal: 2.6 | CDS | 3.-.-.- | — | — | — | P42969 | lipC_1 | — | — | Spore germination lipase LipC |
| Contig1 | 1554756 | 1555379 | − | GENE_01445 | Prodigal: 2.6 | CDS | — | — | — | — | P54178 | — | — | SCO1 protein homolog precursor | hypothetical protein |
| Contig1 | 1555436 | 1555687 | − | GENE_01446 | Prodigal: 2.6 | CDS | — | — | — | — | — | — | — | — | hypothetical protein |
| Contig1 | 1555780 | 1557048 | − | GENE_01447 | Prodigal: 2.6 | CDS | 4.3.1.19 | — | — | — | P04968 | ilvA | — | — | L-threonine dehydratase biosynthetic IlvA |
| Contig1 | 1557233 | 1558225 | + | GENE_01448 | Prodigal: 2.6 | CDS | — | — | — | — | P41789 | glnG | — | — | Nitrogen regulation protein NR(I) |
| Contig1 | 1558242 | 1558880 | + | GENE_01449 | Prodigal: 2.6 | CDS | — | — | PF03006.14 | — | — | — | — | — | Haemolysin-III related |
| Contig1 | 1558922 | 1559545 | − | GENE_01450 | Prodigal: 2.6 | CDS | — | — | — | — | — | — | — | — | hypothetical protein |
| Contig1 | 1559561 | 1560046 | − | GENE_01451 | Prodigal: 2.6 | CDS | 1.5.1.3 | — | — | — | P11045 | dfrA | — | — | Dihydrofolate reductase |
| Contig1 | 1560043 | 1560837 | − | GENE_01452 | Prodigal: 2.6 | CDS | 2.1.1.45 | — | — | — | P11044 | thyA2 | — | — | Thymidylate synthase 2 |
| Contig1 | 1560937 | 1561545 | − | GENE_01453 | Prodigal: 2.6 | CDS | — | — | — | — | — | — | — | — | hypothetical protein |
| Contig1 | 1561808 | 1562578 | − | GENE_01454 | Prodigal: 2.6 | CDS | 2.1.1.242 | — | — | — | Q7UAV7 | rsmj | — | — | Ribosomal RNA small subunit methyltransferase J |
| Contig1 | 1562618 | 1563052 | − | GENE_01455 | Prodigal: 2.6 | CDS | — | — | — | — | — | — | — | — | hypothetical protein |
| Contig1 | 1563134 | 1564810 | − | GENE_01456 | Prodigal: 2.6 | CDS | 4.2.1.9 | — | — | — | P51785 | ilvD | — | — | Dihydroxy-acid dehydratase |

TABLE 5-continued

| #ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1565069 | 1566202 | − | GENE_01457 | Prodigal: 2.6 | CDS | — | — | — | — | Q931R7 | — | — | Conserved virulence factor C | hypothetical protein |
| Contig1 | 1566271 | 1566879 | − | GENE_01458 | Prodigal: 2.6 | CDS | — | PRK10119 | — | — | — | — | — | — | putative hydrolase |
| Contig1 | 1566891 | 1567373 | − | GENE_01459 | Prodigal: 2.6 | CDS | — | — | — | — | P99097 | — | — | Glutathione peroxidase homolog BsaA | hypothetical protein |
| Contig1 | 1567654 | 1568562 | + | GENE_01460 | Prodigal: 2.6 | CDS | 2.3.1.46 | — | — | — | Q72X44 | metA | — | — | Homoserine O-succinyltransferase |
| Contig1 | 1568787 | 1569929 | + | GENE_01461 | Prodigal: 2.6 | CDS | 2.4.1.- | — | — | — | P54166 | ugtP | — | — | Processive diacylglycerol beta-glucosyltransferase |
| Contig1 | 1570151 | 1570351 | + | GENE_01462 | Prodigal: 2.6 | CDS | — | — | — | — | P51777 | cspD | — | — | Cold shock protein CspD |
| Contig1 | 1570403 | 1570585 | + | GENE_01463 | Prodigal: 2.6 | CDS | — | — | — | — | P68731 | degR | — | — | Regulatory protein DegR |
| Contig1 | 1570747 | 1571004 | + | GENE_01464 | Prodigal: 2.6 | CDS | — | — | — | — | — | — | — | — | hypothetical protein |
| Contig1 | 1571031 | 1571213 | − | GENE_01465 | Prodigal: 2.6 | CDS | — | — | — | — | — | — | — | — | hypothetical protein |
| Contig1 | 1571216 | 1571887 | − | GENE_01466 | Prodigal: 2.6 | CDS | 3.1.26.4 | — | — | MF_00042 | — | mhA_1 | — | — | Ribonuclease H |
| Contig1 | 1571969 | 1572649 | − | GENE_01467 | Prodigal: 2.6 | CDS | — | — | — | — | P37619 | yhhQ | — | — | Inner membrane protein YhhQ |
| Contig1 | 1572653 | 1573048 | + | GENE_01468 | Prodigal: 2.6 | CDS | — | — | — | — | P54162 | mhA_2 | — | — | 14.7 kDa ribonuclease H-like protein |
| Contig1 | 1573100 | 1573228 | + | GENE_01469 | Prodigal: 2.6 | CDS | — | — | — | — | Q7WY66 | sspL | — | — | Small, acid-soluble spore protein L |
| Contig1 | 1573234 | 1574121 | − | GENE_01470 | Prodigal: 2.6 | CDS | 3.1.11.- | — | — | — | P54161 | ypcP | — | — | 5'-3' exonuclease |
| Contig1 | 1574217 | 1574360 | − | GENE_01471 | Prodigal: 2.6 | CDS | — | — | — | — | — | — | — | — | hypothetical protein |
| Contig1 | 1574437 | 1574694 | − | GENE_01472 | Prodigal: 2.6 | CDS | — | — | — | — | — | — | — | — | hypothetical protein |
| Contig1 | 1574762 | 1578346 | − | GENE_01473 | Prodigal: 2.6 | CDS | 3.6.5.5 | — | — | — | B2IZD3 | — | — | — | Bacterial dynamin-like protein |
| Contig1 | 1578697 | 1579203 | − | GENE_01474 | Prodigal: 2.6 | CDS | — | — | PF04140.8 | — | — | — | — | — | Isoprenylcysteine carboxyl methyltransferase (ICMT) family protein |
| Contig1 | 1579203 | 1580303 | − | GENE_01475 | Prodigal: 2.6 | CDS | 2.3.1.- | — | — | — | O06587 | — | — | — | Alpha-pyrone synthesis polyketide synthase-like Pks11 |
| Contig1 | 1580469 | 1580915 | + | GENE_01476 | Prodigal: 2.6 | CDS | — | — | — | — | — | — | — | — | hypothetical protein |
| Contig1 | 1581107 | 1581415 | − | GENE_01477 | Prodigal: 2.6 | CDS | 2.1.1.63 | — | — | MF_00772 | — | ogt_2 | — | — | Methylated-DNA--protein-cysteine methyltransferase |
| Contig1 | 1581637 | 1581900 | + | GENE_01478 | Prodigal: 2.6 | CDS | — | — | — | — | — | — | — | — | hypothetical protein |
| Contig1 | 1582247 | 1582447 | + | GENE_01479 | Prodigal: 2.6 | CDS | — | — | — | — | — | — | — | — | hypothetical protein |
| Contig1 | 1582453 | 1582830 | + | GENE_01480 | Prodigal: 2.6 | CDS | — | — | — | — | — | — | — | — | hypothetical protein |
| Contig1 | 1583035 | 1583601 | + | GENE_01481 | Prodigal: 2.6 | CDS | 3.5.2.19 | — | — | — | Q1MW86 | sttH | — | — | Streptothricin hydrolase |
| Contig1 | 1583936 | 1584211 | + | GENE_01482 | Prodigal: 2.6 | CDS | — | — | — | — | — | — | — | — | hypothetical protein |
| Contig1 | 1584603 | 1585907 | − | GENE_01483 | Prodigal: 2.6 | CDS | — | — | — | — | O32140 | pucK | — | — | Uric acid permease PucK |
| Contig1 | 1585904 | 1586488 | − | GENE_01484 | Prodigal: 2.6 | CDS | 2.4.2.22 | — | — | — | P42085 | xpt | — | — | Xanthine phosphoribosyltransferase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1586821 | 1588323 | − | GENE_01485 | Prodigal: 2.6 | CDS | 3.4.24.- | — | — | — | P50848 | ypwA | — | — | Putative metalloprotease YpwA |
| Contig1 | 1588435 | 1590354 | − | GENE_01486 | Prodigal: 2.6 | CDS | 3.6.4.12 | — | — | — | P27296 | dinG | — | — | putative ATP-dependent helicase DinG |
| Contig1 | 1590459 | 1590650 | − | GENE_01487 | Prodigal: 2.6 | CDS | — | — | — | — | — | — | — | — | hypothetical protein |
| Contig1 | 1590817 | 1590969 | + | GENE_01488 | Prodigal: 2.6 | CDS | — | — | — | — | — | — | — | — | hypothetical protein |
| Contig1 | 1591028 | 1592176 | − | GENE_01489 | Prodigal: 2.6 | CDS | — | — | — | — | P75864 | rlmL | — | — | Ribosomal RNA large subunit methyltransferase K/L |
| Contig1 | 1592710 | 1593009 | − | GENE_01490 | Prodigal: 2.6 | CDS | — | — | — | — | P0CI74 | gpsB | — | — | Cell cycle protein GpsB |
| Contig1 | 1593089 | 1593637 | − | GENE_01491 | Prodigal: 2.6 | CDS | — | — | — | — | — | — | — | — | hypothetical protein |
| Contig1 | 1593726 | 1593962 | − | GENE_01492 | Prodigal: 2.6 | CDS | — | — | PF11122.2 | — | — | — | — | — | Inner spore coat protein D |
| Contig1 | 1594046 | 1594141 | − | GENE_01493 | Prodigal: 2.6 | CDS | — | — | — | — | — | — | — | — | hypothetical protein |
| Contig1 | 1594275 | 1595513 | − | GENE_01494 | Prodigal: 2.6 | CDS | — | — | — | — | — | — | — | — | hypothetical protein |
| Contig1 | 1595533 | 1597779 | − | GENE_01495 | Prodigal: 2.6 | CDS | 3.6.4.13 | — | — | MF_00965 | — | dbpA_1 | — | — | ATP-dependent RNA helicase DbpA |
| Contig1 | 1597878 | 1598384 | − | GENE_01496 | Prodigal: 2.6 | CDS | 2.7.1.- | — | — | — | P60857 | err | — | — | Glucose-specific phosphotransferase enzyme HA component |
| Contig1 | 1598523 | 1598936 | + | GENE_01497 | Prodigal: 2.6 | CDS | — | — | — | — | — | — | — | — | hypothetical protein |
| Contig1 | 1598966 | 1599367 | − | GENE_01498 | Prodigal: 2.6 | CDS | — | — | — | — | — | — | — | — | hypothetical protein |
| Contig1 | 1599554 | 1599736 | + | GENE_01499 | Prodigal: 2.6 | CDS | — | — | — | — | — | — | — | — | hypothetical protein |
| Contig1 | 1599775 | 1600143 | − | GENE_01500 | Prodigal: 2.6 | CDS | — | — | — | — | — | — | — | — | hypothetical protein |
| Contig1 | 1600189 | 1600434 | − | GENE_01501 | Prodigal: 2.6 | CDS | — | — | — | — | — | — | — | — | hypothetical protein |
| Contig1 | 1600640 | 1600744 | + | GENE_01502 | Prodigal: 2.6 | CDS | — | — | — | — | Q7WY65 | sspM | — | — | Small, acid-soluble spore protein M |
| Contig1 | 1600788 | 1601753 | − | GENE_01503 | Prodigal: 2.6 | CDS | — | — | — | — | — | — | — | — | hypothetical protein |
| Contig1 | 1601795 | 1602403 | + | GENE_01504 | Prodigal: 2.6 | CDS | 3.1.22.- | — | — | — | P39792 | recU | — | — | Holliday junction resolvase RecU |
| Contig1 | 1602442 | 1605225 | + | GENE_01505 | Prodigal: 2.6 | CDS | — | — | — | — | P39793 | ponA | — | — | Penicillin-binding protein 1A/1B |
| Contig1 | 1605304 | 1605795 | − | GENE_01506 | Prodigal: 2.6 | CDS | — | — | — | — | — | — | — | — | hypothetical protein |
| Contig1 | 1605792 | 1606451 | − | GENE_01507 | Prodigal: 2.6 | CDS | 4.2.99.18 | — | — | — | P0AB83 | nth | — | — | Endonuclease III |
| Contig1 | 1606470 | 1607168 | − | GENE_01508 | Prodigal: 2.6 | CDS | — | — | — | — | P39787 | dnaD | — | — | DNA replication protein DnaD |
| Contig1 | 1607263 | 1608555 | − | GENE_01509 | Prodigal: 2.6 | CDS | 6.1.1.22 | — | — | — | P67572 | asnS | — | — | Asparagine--tRNA ligase |
| Contig1 | 1608690 | 1609337 | − | GENE_01510 | Prodigal: 2.6 | CDS | 2.6.1.1 | — | — | — | P23034 | — | — | — | Aspartate aminotransferase |
| Contig1 | 1609403 | 1609870 | − | GENE_01511 | Prodigal: 2.6 | CDS | 2.6.1.1 | — | — | — | P23034 | — | — | — | Aspartate aminotransferase |
| Contig1 | 1609893 | 1610378 | − | GENE_01512 | Prodigal: 2.6 | CDS | — | — | — | — | — | — | — | — | hypothetical protein |
| Contig1 | 1610388 | 1610558 | − | GENE_01513 | Prodigal: 2.6 | CDS | — | — | — | — | — | — | — | — | hypothetical protein |
| Contig1 | 1610706 | 1613492 | − | GENE_01514 | Prodigal: 2.6 | CDS | — | — | — | — | Q7A5K4 | — | — | Probable ATP-dependent helicase DinG homolog | hypothetical protein |
| Contig1 | 1613614 | 1613997 | − | GENE_01515 | Prodigal: 2.6 | CDS | 4.1.1.11 | — | — | — | A4JQ59 | panD | — | — | Aspartate 1-decarboxylase precursor |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1613999 | 1614859 | − | GENE_01516 | Prodigal: 2.6 | CDS | 6.3.2.1 | — | — | — | Q6GDK5 | panC | — | — | Pantothenate synthetase |
| Contig1 | 1614863 | 1615696 | − | GENE_01517 | Prodigal: 2.6 | CDS | 2.1.2.11 | — | — | — | P65656 | panB | — | — | 3-methyl-2-oxobutanoate hydroxymethyltransferase |
| Contig1 | 1615941 | 1616918 | − | GENE_01518 | Prodigal: 2.6 | CDS | 6.3.4.15 | — | — | — | P0CI75 | birA | — | — | Bifunctional ligase/repressor BirA |
| Contig1 | 1616903 | 1618093 | − | GENE_01519 | Prodigal: 2.6 | CDS | 2.7.7.72 | — | — | — | Q7SIB1 | cca | — | — | CCA-adding enzyme |
| Contig1 | 1618098 | 1619231 | − | GENE_01520 | Prodigal: 2.6 | CDS | 2.4.1.250 | — | — | — | A0QQZ8 | mshA_1 | — | — | D-inositol 3-phosphate glycosyltransferase |
| Contig1 | 1619228 | 1619941 | − | GENE_01521 | Prodigal: 2.6 | CDS | 3.5.1.103 | — | — | MF_0169 | — | mshB_2 | — | — | 1D-myo-inositol 2-acetamido-2-deoxy-alpha-D-glucopyranoside deacetylase |
| Contig1 | 1619934 | 1620347 | − | GENE_01522 | Prodigal: 2.6 | CDS | 4.2.3.3 | — | — | — | Q5SHD6 | mgsA | — | — | Methylglyoxal synthase |
| Contig1 | 1620370 | 1621173 | − | GENE_01523 | Prodigal: 2.6 | CDS | 1.17.1.8 | — | — | — | P63895 | dapB | — | — | 4-hydroxy-tetrahydrodipicolinate reductase |
| Contig1 | 1621182 | 1621517 | − | GENE_01524 | Prodigal: 2.6 | CDS | — | PRK09562 | — | — | — | — | — | — | nucleoside triphosphate pyrophosphohydrolase |
| Contig1 | 1621660 | 1622532 | + | GENE_01525 | Prodigal: 2.6 | CDS | — | PRK04164 | — | — | — | — | — | — | hypothetical protein |
| Contig1 | 1622556 | 1623731 | − | GENE_01526 | Prodigal: 2.6 | CDS | 4.1.1.2 | — | — | — | O34714 | oxdC_1 | — | — | Oxalate decarboxylase OxdC |
| Contig1 | 1623761 | 1624543 | − | GENE_01527 | Prodigal: 2.6 | CDS | — | — | PF09577.4 | — | — | — | — | — | Sporulation protein YpjB (SpoYpjB) |
| Contig1 | 1624611 | 1625204 | − | GENE_01528 | Prodigal: 2.6 | CDS | — | — | — | — | — | — | — | — | hypothetical protein |
| Contig1 | 1625312 | 1626079 | − | GENE_01529 | Prodigal: 2.6 | CDS | — | — | — | — | Q56247 | cccA_1 | — | — | Cytochrome c-551 precursor |
| Contig1 | 1626111 | 1626785 | − | GENE_01530 | Prodigal: 2.6 | CDS | — | — | — | — | P46912 | qcrB | — | — | Menaquinol-cytochrome c reductase cytochrome b subunit |
| Contig1 | 1626787 | 1627146 | − | GENE_01531 | Prodigal: 2.6 | CDS | 1.10.9.1 | — | — | — | Q46136 | petC | — | — | Cytochrome b6-f complex iron-sulfur subunit |
| Contig1 | 1627167 | 1627289 | − | GENE_01532 | Prodigal: 2.6 | CDS | — | — | — | — | — | — | — | — | hypothetical protein |
| Contig1 | 1627427 | 1627873 | − | GENE_01533 | Prodigal: 2.6 | CDS | — | — | — | — | — | — | — | — | hypothetical protein |
| Contig1 | 1627928 | 1628467 | − | GENE_01534 | Prodigal: 2.6 | CDS | — | PRK03636 | — | — | — | — | — | — | hypothetical protein |
| Contig1 | 1628541 | 1629812 | − | GENE_01535 | Prodigal: 2.6 | CDS | — | PRK11788 | — | — | — | — | — | — | tetratricopeptide repeat protein |
| Contig1 | 1630131 | 1631417 | − | GENE_01536 | Prodigal: 2.6 | CDS | 2.5.1.19 | — | — | — | Q9KCA6 | aroA1 | — | — | 3-phosphoshikimate 1-carboxyvinyltransferase 1 |
| Contig1 | 1631429 | 1632535 | − | GENE_01537 | Prodigal: 2.6 | CDS | — | PRK06545 | — | — | — | — | — | — | prephenate dehydrogenase |
| Contig1 | 1632596 | 1633678 | − | GENE_01538 | Prodigal: 2.6 | CDS | 2.6.1.9 | — | — | — | Q92A83 | hisC | — | — | Histidinol-phosphate aminotransferase |
| Contig1 | 1633690 | 1634487 | − | GENE_01539 | Prodigal: 2.6 | CDS | 4.2.1.20 | — | — | — | P16608 | trpA | — | — | Tryptophan synthase alpha chain |
| Contig1 | 1634480 | 1635682 | − | GENE_01540 | Prodigal: 2.6 | CDS | 4.2.1.20 | — | — | — | Q81TL8 | trpB | — | — | Tryptophan synthase beta chain |
| Contig1 | 1635663 | 1636316 | − | GENE_01541 | Prodigal: 2.6 | CDS | 5.3.1.24 | — | — | — | Q56320 | trpF | — | — | N-(5'-phosphoribosyl)anthranilate isomerase |
| Contig1 | 1636321 | 1637073 | − | GENE_01542 | Prodigal: 2.6 | CDS | 4.1.1.48 | — | — | — | Q2YRR4 | trpC | — | — | Indole-3-glycerol phosphate synthase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1637066 | 1638082 | − | GENE_01543 | Prodigal: 2.6 | CDS | 2.4.2.18 | — | — | — | P00500 | trpD | — | — | Anthranilate phosphoribosyltransferase |
| Contig1 | 1638054 | 1639601 | − | GENE_01544 | Prodigal: 2.6 | CDS | 4.1.3.27 | — | — | — | A0QX93 | trpE | — | — | Anthranilate synthase component 1 |
| Contig1 | 1639825 | 1640208 | − | GENE_01545 | Prodigal: 2.6 | CDS | 5.4.99.5 | — | — | — | P19080 | aroH | — | — | Chorismate mutase AroH |
| Contig1 | 1640205 | 1641293 | − | GENE_01546 | Prodigal: 2.6 | CDS | 4.2.3.4 | — | — | — | Q6GGU4 | aroB | — | — | 3-dehydroquinate synthase |
| Contig1 | 1641293 | 1642465 | − | GENE_01547 | Prodigal: 2.6 | CDS | 4.2.3.5 | — | — | — | P31104 | aroF_1 | — | — | Chorismate synthase |
| Contig1 | 1642537 | 1643307 | − | GENE_01548 | Prodigal: 2.6 | CDS | 2.1.1.80 | — | — | — | Q88ER1 | cheR2 | — | — | Chemotaxis protein methyltransferase Cher2 |
| Contig1 | 1643497 | 1643943 | − | GENE_01549 | Prodigal: 2.6 | CDS | 2.7.4.6 | — | — | — | P31103 | ndk | — | — | Nucleoside diphosphate kinase |
| Contig1 | 1644064 | 1645113 | − | GENE_01550 | Prodigal: 2.6 | CDS | 2.5.1.30 | — | — | — | P31114 | hepT | — | — | Heptaprenyl diphosphate synthase component 2 |
| Contig1 | 1645055 | 1645756 | − | GENE_01551 | Prodigal: 2.6 | CDS | 2.1.1.163 | — | — | — | P31113 | ubiE | — | — | Demethylmenaquinone methyltransferase |
| Contig1 | 1645762 | 1646526 | − | GENE_01552 | Prodigal: 2.6 | CDS | 2.5.1.30 | — | — | — | P31112 | hepS | — | — | Heptaprenyl diphosphate synthase component 1 |
| Contig1 | 1646674 | 1646901 | − | GENE_01553 | Prodigal: 2.6 | CDS | — | — | — | — | P19466 | mtrB | — | — | Transcription attenuation protein MtrB |
| Contig1 | 1646922 | 1647494 | − | GENE_01554 | Prodigal: 2.6 | CDS | 3.5.4.16 | — | — | — | P19465 | folE | — | — | GTP cyclohydrolase 1 |
| Contig1 | 1647681 | 1647959 | − | GENE_01555 | Prodigal: 2.6 | CDS | — | — | — | — | P08821 | hupA | — | — | DNA-binding protein HU 1 |
| Contig1 | 1648333 | 1649811 | − | GENE_01556 | Prodigal: 2.6 | CDS | 3.6.1.3 | — | — | — | P35149 | spoIVA | — | — | Stage IV sporulation protein A |
| Contig1 | 1649997 | 1650731 | − | GENE_01557 | Prodigal: 2.6 | CDS | — | — | — | — | — | — | — | — | hypothetical protein |
| Contig1 | 1650751 | 1650954 | − | GENE_01558 | Prodigal: 2.6 | CDS | — | — | — | — | — | — | — | — | hypothetical protein |
| Contig1 | 1651273 | 1652310 | + | GENE_01559 | Prodigal: 2.6 | CDS | 1.1.1.94 | — | — | — | Q97NF1 | gpsA | — | — | Glycerol-3-phosphate dehydrogenase [NAD(P)+] |
| Contig1 | 1652328 | 1653638 | − | GENE_01560 | Prodigal: 2.6 | CDS | — | — | — | — | P50743 | der_1 | — | — | GTPase Der |
| Contig1 | 1653831 | 1654433 | − | GENE_01561 | Prodigal: 2.6 | CDS | — | — | — | — | — | — | — | — | hypothetical protein |
| Contig1 | 1654510 | 1654641 | − | GENE_01562 | Prodigal: 2.6 | CDS | — | — | — | — | — | — | — | — | hypothetical protein |
| Contig1 | 1654676 | 1655725 | − | GENE_01563 | Prodigal: 2.6 | CDS | 5.3.3.2 | — | — | — | P50740 | fni | — | — | Isopentenyl-diphosphate delta-isomerase |
| Contig1 | 1655740 | 1656888 | − | GENE_01564 | Prodigal: 2.6 | CDS | — | — | — | — | P38494 | — | — | 30S ribosomal protein S1 homolog | hypothetical protein |
| Contig1 | 1657117 | 1657791 | − | GENE_01565 | Prodigal: 2.6 | CDS | 2.7.4.25 | — | — | — | P38493 | cmk | — | — | Cytidylate kinase |
| Contig1 | 1657870 | 1658046 | − | GENE_01566 | Prodigal: 2.6 | CDS | — | — | — | — | — | — | — | — | hypothetical protein |
| Contig1 | 1658093 | 1658470 | − | GENE_01567 | Prodigal: 2.6 | CDS | — | — | — | MF_01457 | — | ycgR | — | — | Flagellar brake protein YcgR |
| Contig1 | 1658467 | 1658748 | − | GENE_01568 | Prodigal: 2.6 | CDS | — | — | PF12945.1 | — | — | — | — | — | Flagellar protein YcgR |
| Contig1 | 1658836 | 1660185 | − | GENE_01569 | Prodigal: 2.6 | CDS | — | — | — | — | P38490 | ypeB | — | — | Sporulation protein YpeB |
| Contig1 | 1660210 | 1661079 | − | GENE_01570 | Prodigal: 2.6 | CDS | — | — | — | — | P50739 | sleB_2 | — | — | Spore cortex-lytic enzyme precursor |
| Contig1 | 1661212 | 1661868 | − | GENE_01571 | Prodigal: 2.6 | CDS | 3.4.-.- | — | — | — | P50738 | prsW | — | — | Protease PrsW |
| Contig1 | 1661965 | 1662948 | − | GENE_01572 | Prodigal: 2.6 | CDS | 1.18.1.2 | — | — | — | Q8KCB2 | — | — | — | Ferredoxin--NADP reductase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1663054 | 1664328 | − | GENE_01573 | Prodigal: 2.6 | CDS | 1.4.1.2 | — | — | — | P50735 | gudB | — | — | Cryptic catabolic NAD-specific glutamate dehydrogenase GudB |
| Contig1 | 1664489 | 1665073 | − | GENE_01574 | Prodigal: 2.6 | CDS | — | — | — | — | P50734 | mecB | — | — | Adapter protein MecA 2 |
| Contig1 | 1665224 | 1666012 | − | GENE_01575 | Prodigal: 2.6 | CDS | 3.1.-.- | — | — | — | Q9PP77 | — | — | — | putative metallophosphoesterase |
| Contig1 | 1666099 | 1666557 | − | GENE_01576 | Prodigal: 2.6 | CDS | — | — | — | — | — | — | — | — | hypothetical protein |
| Contig1 | 1666626 | 1667396 | − | GENE_01577 | Prodigal: 2.6 | CDS | — | — | — | — | Q7A5I6 | ebpS | — | — | Elastin-binding protein EbpS |
| Contig1 | 1667374 | 1667961 | − | GENE_01578 | Prodigal: 2.6 | CDS | — | — | PF02517.10 | — | — | — | — | — | CAAX amino terminal protease self-immunity |
| Contig1 | 1667976 | 1669394 | − | GENE_01579 | Prodigal: 2.6 | CDS | 3.6.4.12 | — | — | — | P15043 | recQ_2 | — | — | ATP-dependent DNA helicase RecQ |
| Contig1 | 1669459 | 1670517 | − | GENE_01580 | Prodigal: 2.6 | CDS | — | — | — | — | — | — | — | — | hypothetical protein |
| Contig1 | 1670786 | 1671034 | + | GENE_01581 | Prodigal: 2.6 | CDS | — | — | — | — | P50727 | fer | — | — | Ferredoxin |
| Contig1 | 1671174 | 1671746 | − | GENE_01582 | Prodigal: 2.6 | CDS | — | — | — | — | P50726 | fmnP | — | — | Riboflavin transporter FmnP |
| Contig1 | 1672233 | 1673816 | + | GENE_01583 | Prodigal: 2.6 | CDS | 1.1.1.95 | — | — | — | P0A544 | serA | — | — | D-3-phosphoglycerate dehydrogenase |
| Contig1 | 1673863 | 1674960 | − | GENE_01584 | Prodigal: 2.6 | CDS | — | — | — | — | P35166 | rsiX | — | — | Sigma-X negative effector |
| Contig1 | 1674899 | 1675483 | − | GENE_01585 | Prodigal: 2.6 | CDS | — | — | — | — | P35165 | sigX | — | — | RNA polymerase sigma factor SigX |
| Contig1 | 1675675 | 1677456 | − | GENE_01586 | Prodigal: 2.6 | CDS | 2.7.13.3 | — | — | — | Q5HFT1 | srrB | — | — | Sensor protein SrrB |
| Contig1 | 1677464 | 1678174 | − | GENE_01587 | Prodigal: 2.6 | CDS | — | — | — | — | Q9L524 | srrA_1 | — | — | Transcriptional regulatory protein SrrA |
| Contig1 | 1678256 | 1679431 | − | GENE_01588 | Prodigal: 2.6 | CDS | — | — | — | — | P72978 | ccsA_1 | — | — | Cytochrome c biogenesis protein CcsA |
| Contig1 | 1679450 | 1681078 | − | GENE_01589 | Prodigal: 2.6 | CDS | — | — | — | — | P73912 | ccsB | — | — | Cytochrome c biogenesis protein CcsB |
| Contig1 | 1681075 | 1681614 | − | GENE_01590 | Prodigal: 2.6 | CDS | — | — | — | — | P35160 | resA_2 | — | — | Thiol-disulfide oxidoreductase ResA |
| Contig1 | 1681699 | 1682433 | − | GENE_01591 | Prodigal: 2.6 | CDS | 5.4.99.22 | — | — | — | P35159 | rluB | — | — | Ribosomal large subunit pseudouridine synthase B |
| Contig1 | 1682527 | 1683063 | − | GENE_01592 | Prodigal: 2.6 | CDS | — | — | — | — | P35158 | spmB | — | — | Spore maturation protein B |
| Contig1 | 1683068 | 1683658 | − | GENE_01593 | Prodigal: 2.6 | CDS | — | — | — | — | P35157 | spmA | — | — | Spore maturation protein A |
| Contig1 | 1683646 | 1684797 | − | GENE_01594 | Prodigal: 2.6 | CDS | 3.4.16.4 | — | — | — | P35150 | dacB | — | — | D-alanyl-D-alanine carboxypeptidase DacB precursor |
| Contig1 | 1684910 | 1685440 | − | GENE_01595 | Prodigal: 2.6 | CDS | — | — | — | — | — | — | — | — | hypothetical protein |
| Contig1 | 1685485 | 1686078 | − | GENE_01596 | Prodigal: 2.6 | CDS | — | — | — | — | P35155 | scpB | — | — | Segregation and condensation protein B |
| Contig1 | 1686068 | 1686823 | − | GENE_01597 | Prodigal: 2.6 | CDS | — | — | — | — | P35154 | scpA | — | — | Segregation and condensation protein A |
| Contig1 | 1687031 | 1687120 | + | GENE_01598 | Prodigal: 2.6 | CDS | — | — | PF09680.4 | — | — | — | — | — | Protein of unknown function (Tiny_TM_bacill) |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1687207 | 1687728 | + | GENE_01599 | Prodigal: 2.6 | CDS | — | — | — | — | — | — | — | — | hypothetical protein |
| Contig1 | 1687794 | 1688168 | − | GENE_01600 | Prodigal: 2.6 | CDS | — | — | PF00583.18 | — | — | — | — | — | Acetyltransferase (GNAT) family protein |
| Contig1 | 1688285 | 1688749 | − | GENE_01601 | Prodigal: 2.6 | CDS | 2.5.1.78 | — | — | — | P11998 | ribH | — | — | 6,7-dimethyl-8-ribityllumazine synthase |
| Contig1 | 1688782 | 1689978 | − | GENE_01602 | Prodigal: 2.6 | CDS | — | — | — | — | Q99TA0 | ribBA | — | — | Riboflavin biosynthesis protein RibBA |
| Contig1 | 1689993 | 1690640 | − | GENE_01603 | Prodigal: 2.6 | CDS | 2.5.1.9 | — | — | — | P16440 | ribE | — | — | Riboflavin synthase |
| Contig1 | 1690621 | 1691736 | − | GENE_01604 | Prodigal: 2.6 | CDS | — | — | — | — | P17618 | ribD | — | — | Riboflavin biosynthesis protein RibD |
| Contig1 | 1692134 | 1692478 | − | GENE_01605 | Prodigal: 2.6 | CDS | — | — | — | — | — | — | — | — | hypothetical protein |
| Contig1 | 1692726 | 1693286 | − | GENE_01606 | Prodigal: 2.6 | CDS | 3.4.21.89 | — | — | — | P28628 | sipS | — | — | Signal peptidase I S |
| Contig1 | 1693382 | 1693873 | − | GENE_01607 | Prodigal: 2.6 | CDS | — | — | — | — | — | — | — | — | hypothetical protein |
| Contig1 | 1694023 | 1694454 | − | GENE_01608 | Prodigal: 2.6 | CDS | 5.2.1.8 | — | — | — | P35137 | ppiB | — | — | Peptidyl-prolyl cis-trans isomerase B |
| Contig1 | 1694739 | 1695638 | + | GENE_01609 | Prodigal: 2.6 | CDS | — | — | — | — | — | — | — | — | hypothetical protein |
| Contig1 | 1695683 | 1697002 | − | GENE_01610 | Prodigal: 2.6 | CDS | 4.1.1.20 | — | — | — | P09890 | lysA | — | — | Diaminopimelate decarboxylase |
| Contig1 | 1697127 | 1698608 | − | GENE_01611 | Prodigal: 2.6 | CDS | — | — | — | — | Q9ZFB4 | gerXA | — | — | Spore germination protein XA |
| Contig1 | 1698562 | 1699167 | − | GENE_01612 | Prodigal: 2.6 | CDS | — | — | — | — | — | — | — | — | hypothetical protein |
| Contig1 | 1699174 | 1699524 | − | GENE_01613 | Prodigal: 2.6 | CDS | — | — | PF03862.7 | — | — | — | — | — | SpoVA protein |
| Contig1 | 1699525 | 1700541 | − | GENE_01614 | Prodigal: 2.6 | CDS | — | — | — | — | P40869 | spoVAD | — | — | Stage V sporulation protein AD |
| Contig1 | 1700553 | 1701005 | − | GENE_01615 | Prodigal: 2.6 | CDS | — | — | PF03862.7 | — | — | — | — | — | SpoVA protein |
| Contig1 | 1701018 | 1701389 | − | GENE_01616 | Prodigal: 2.6 | CDS | — | — | — | — | — | — | — | — | hypothetical protein |
| Contig1 | 1701433 | 1702053 | − | GENE_01617 | Prodigal: 2.6 | CDS | — | — | PF12164.2 | — | — | — | — | — | Stage V sporulation protein AA |
| Contig1 | 1702180 | 1702947 | − | GENE_01618 | Prodigal: 2.6 | CDS | 2.7.11.1 | — | — | — | P07860 | sigF_2 | — | — | RNA polymerase sigma-F factor |
| Contig1 | 1702959 | 1703399 | − | GENE_01619 | Prodigal: 2.6 | CDS | — | — | — | — | P10728 | spoIIAB | — | — | Anti-sigma F factor |
| Contig1 | 1703396 | 1703749 | − | GENE_01620 | Prodigal: 2.6 | CDS | — | — | — | — | P10727 | spoIIAA | — | — | Anti-sigma F factor antagonist |
| Contig1 | 1703845 | 1705014 | − | GENE_01621 | Prodigal: 2.6 | CDS | 3.4.16.4 | — | — | — | P38422 | dacF | — | — | D-alanyl-D-alanine carboxypeptidase DacF precursor |
| Contig1 | 1705151 | 1705969 | − | GENE_01622 | Prodigal: 2.6 | CDS | 2.4.2.1 | — | — | — | P46354 | punA | — | — | Purine nucleoside phosphorylase 1 |
| Contig1 | 1705982 | 1707166 | − | GENE_01623 | Prodigal: 2.6 | CDS | 5.4.2.7 | — | — | — | Q81ZN9 | deoB | — | — | Phosphopentomutase |
| Contig1 | 1707335 | 1708225 | − | GENE_01624 | Prodigal: 2.6 | CDS | — | — | — | — | P0A0P0 | xerD | — | — | Tyrosine recombinase XerD |
| Contig1 | 1708233 | 1708460 | − | GENE_01625 | Prodigal: 2.6 | CDS | — | — | — | — | — | — | — | — | hypothetical protein |
| Contig1 | 1708575 | 1709024 | − | GENE_01626 | Prodigal: 2.6 | CDS | — | — | — | — | P54574 | fur | — | — | Ferric uptake regulation protein |
| Contig1 | 1709137 | 1709781 | − | GENE_01627 | Prodigal: 2.6 | CDS | — | — | — | — | P37873 | spoIIM | — | — | Stage II sporulation protein M |
| Contig1 | 1709815 | 1709919 | − | GENE_01628 | Prodigal: 2.6 | CDS | — | — | — | — | — | — | — | — | hypothetical protein |
| Contig1 | 1709858 | 1710085 | − | GENE_01629 | Prodigal: 2.6 | CDS | — | — | — | — | — | — | — | — | hypothetical protein |
| Contig1 | 1710143 | 1710433 | − | GENE_01630 | Prodigal: 2.6 | CDS | — | — | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1710546 | 1711859 | − | GENE_01631 | Prodigal: 2.6 | CDS | 1.1.1.38 | — | — | — | P16468 | — | — | — | NAD-dependent malic enzyme |
| Contig1 | 1711872 | 1713278 | − | GENE_01632 | Prodigal: 2.6 | CDS | — | — | — | — | P54571 | mleN | — | — | Malate-2H(+)/Na(+)-lactate antiporter |
| Contig1 | 1713420 | 1714847 | − | GENE_01633 | Prodigal: 2.6 | CDS | 4.3.1.1 | — | — | — | P0AC38 | aspA | — | — | Aspartate ammonia-lyase |
| Contig1 | 1714885 | 1715874 | − | GENE_01634 | Prodigal: 2.6 | CDS | 3.5.1.1 | — | — | — | P26900 | ansA | — | — | L-asparaginase 1 |
| Contig1 | 1716051 | 1716404 | + | GENE_01635 | Prodigal: 2.6 | CDS | — | — | — | — | P23789 | xre_2 | — | — | HTH-type transcriptional regulator Xre |
| Contig1 | 1716415 | 1717578 | − | GENE_01636 | Prodigal: 2.6 | CDS | — | — | — | — | — | — | — | — | hypothetical protein |
| Contig1 | 1717578 | 1718135 | − | GENE_01637 | Prodigal: 2.6 | CDS | 3.6.1.13 | — | — | — | P54570 | nudF | — | — | ADP-ribose pyrophosphatase |
| Contig1 | 1718211 | 1718333 | + | GENE_01638 | Prodigal: 2.6 | CDS | — | — | — | — | — | — | — | — | hypothetical protein |
| Contig1 | 1718396 | 1719316 | + | GENE_01639 | Prodigal: 2.6 | CDS | 1.1.1.- | — | — | — | P80874 | yhdN_1 | — | — | General stress protein 69 |
| Contig1 | 1719349 | 1719576 | + | GENE_01640 | Prodigal: 2.6 | CDS | — | — | — | — | — | — | — | — | hypothetical protein |
| Contig1 | 1719696 | 1720610 | + | GENE_01641 | Prodigal: 2.6 | CDS | — | — | — | MF_00832 | — | rutD_1 | — | — | Putative aminoacrylate hydrolase RutD |
| Contig1 | 1720650 | 1720889 | − | GENE_01642 | Prodigal: 2.6 | CDS | — | — | — | — | — | — | — | — | hypothetical protein |
| Contig1 | 1720864 | 1721226 | − | GENE_01643 | Prodigal: 2.6 | CDS | — | — | — | — | — | — | — | — | hypothetical protein |
| Contig1 | 1721299 | 1722267 | − | GENE_01644 | Prodigal: 2.6 | CDS | — | PRK03333 | — | — | — | — | — | — | dephospho-CoA kinase/protein folding accessory domain-containing protein |
| Contig1 | 1722264 | 1722608 | − | GENE_01645 | Prodigal: 2.6 | CDS | — | — | PF03992.10 | — | — | — | — | — | Antibiotic biosynthesis monooxygenase |
| Contig1 | 1722621 | 1723091 | − | GENE_01646 | Prodigal: 2.6 | CDS | — | — | — | MF_01127 | Q47155 | ypeA | — | — | Acetyltransferase YpeA |
| Contig1 | 1723307 | 1724533 | + | GENE_01647 | Prodigal: 2.6 | CDS | 2.7.7.7 | — | — | — | — | dinB_1 | — | — | DNA polymerase IV |
| Contig1 | 1724548 | 1724892 | + | GENE_01648 | Prodigal: 2.6 | CDS | — | — | PF08863.4 | — | — | — | — | — | YoID-like protein |
| Contig1 | 1724989 | 1725198 | + | GENE_01649 | Prodigal: 2.6 | CDS | — | — | — | — | — | — | — | — | hypothetical protein |
| Contig1 | 1725889 | 1726341 | + | GENE_01650 | Prodigal: 2.6 | CDS | — | PRK12287 | — | — | — | — | — | — | pheromone autoinducer 2 transporter |
| Contig1 | 1726433 | 1726600 | + | GENE_01651 | Prodigal: 2.6 | CDS | — | — | — | — | — | — | — | — | hypothetical protein |
| Contig1 | 1726602 | 1726994 | − | GENE_01652 | Prodigal: 2.6 | CDS | — | — | PF00903.19 | — | — | — | — | — | Glyoxalase/Bleomycin resistance protein/Dioxygenase superfamily protein |
| Contig1 | 1727016 | 1727975 | − | GENE_01653 | Prodigal: 2.6 | CDS | 2.7.1.33 | — | — | — | P63810 | coaA | — | — | Pantothenate kinase |
| Contig1 | 1728051 | 1729400 | − | GENE_01654 | Prodigal: 2.6 | CDS | 4.3.1.18 | — | — | — | Q82L08 | dsdA | — | — | D-serine dehydratase |
| Contig1 | 1729417 | 1730193 | − | GENE_01655 | Prodigal: 2.6 | CDS | 1.-.-.- | — | — | — | Q99RF5 | — | — | — | — | putative oxidoreductase |
| Contig1 | 1730199 | 1731158 | − | GENE_01656 | Prodigal: 2.6 | CDS | 3.1.2.6 | — | — | MF_01374 | — | gloB_1 | — | — | Hydroxyacylglutathione hydrolase |
| Contig1 | 1731554 | 1732396 | + | GENE_01657 | Prodigal: 2.6 | CDS | 1.5.1.2 | — | — | — | P22008 | proC_2 | — | — | Pyrroline-5-carboxylate reductase |
| Contig1 | 1732430 | 1733176 | − | GENE_01658 | Prodigal: 2.6 | CDS | 4.-.-.- | — | — | — | P40802 | pksI_2 | — | — | Putative polyketide biosynthesis enoyl-CoA isomerase PksI |
| Contig1 | 1733226 | 1734533 | − | GENE_01659 | Prodigal: 2.6 | CDS | 2.3.3.- | — | — | — | P40830 | pksG_2 | — | — | Polyketide biosynthesis 3-hydroxy-3-methylglutaryl-ACP synthase PksG |
| Contig1 | 1734530 | 1735684 | − | GENE_01660 | Prodigal: 2.6 | CDS | 1.14.99.- | — | — | — | Q06069 | — | — | — | Cytochrome P450(MEG) |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1735766 | 1736614 | − | GENE_01661 | Prodigal: 2.6 | CDS | 2.3.1.− | — | — | — | O31784 | pksR_2 | — | — | Polyketide synthase PksR |
| Contig1 | 1736611 | 1741980 | − | GENE_01662 | Prodigal: 2.6 | CDS | — | — | — | — | Q05470 | pksL_6 | — | — | Polyketide synthase PksL |
| Contig1 | 1741977 | 1743908 | − | GENE_01663 | Prodigal: 2.6 | CDS | 2.3.1.− | — | — | — | O31782 | pksN_3 | — | — | Polyketide synthase PksN |
| Contig1 | 1743965 | 1748131 | − | GENE_01664 | Prodigal: 2.6 | CDS | — | — | — | — | Q05470 | pksL_7 | — | — | Polyketide synthase PksL |
| Contig1 | 1748154 | 1752545 | − | GENE_01665 | Prodigal: 2.6 | CDS | — | — | — | — | P40806 | pksJ_6 | — | — | Polyketide synthase PksJ |
| Contig1 | 1752512 | 1755871 | − | GENE_01666 | Prodigal: 2.6 | CDS | 2.3.1.− | — | — | — | O31782 | pksN_4 | — | — | Polyketide synthase PksN |
| Contig1 | 1755876 | 1764896 | − | GENE_01667 | Prodigal: 2.6 | CDS | 2.3.1.− | — | — | — | O31782 | pksN_5 | — | — | Polyketide synthase PksN |
| Contig1 | 1764857 | 1771486 | − | GENE_01668 | Prodigal: 2.6 | CDS | — | — | — | — | P40872 | pksM_2 | — | — | Polyketide synthase PksM |
| Contig1 | 1771538 | 1777264 | − | GENE_01669 | Prodigal: 2.6 | CDS | — | — | — | — | Q05470 | pksL_8 | — | — | Polyketide synthase PksL |
| Contig1 | 1777304 | 1783600 | − | GENE_01670 | Prodigal: 2.6 | CDS | — | — | — | — | P40806 | pksJ_7 | — | — | Polyketide synthase PksJ |
| Contig1 | 1783619 | 1796200 | − | GENE_01671 | Prodigal: 2.6 | CDS | 2.3.1.− | — | — | — | O31782 | pksN_6 | — | — | Polyketide synthase PksN |
| Contig1 | 1796240 | 1796977 | − | GENE_01672 | Prodigal: 2.6 | CDS | 1.1.1.100 | — | — | — | Q9KQH7 | fabG_4 | — | — | 3-oxoacyl-[acyl-carrier-protein] reductase FabG |
| Contig1 | 1796992 | 1798356 | − | GENE_01673 | Prodigal: 2.6 | CDS | 6.2.1.3 | — | — | — | O07610 | lcfB_3 | — | — | Long-chain-fatty-acid-CoA ligase |
| Contig1 | 1798353 | 1798625 | − | GENE_01674 | Prodigal: 2.6 | CDS | — | — | — | MF_01217 | — | acpP | — | — | Acyl carrier protein |
| Contig1 | 1798650 | 1799630 | − | GENE_01675 | Prodigal: 2.6 | CDS | — | — | — | — | — | — | — | — | hypothetical protein |
| Contig1 | 1799670 | 1801928 | − | GENE_01676 | Prodigal: 2.6 | CDS | — | — | — | — | O34787 | pksE | — | — | Polyketide biosynthesis protein PksE |
| Contig1 | 1802663 | 1803193 | + | GENE_01677 | Prodigal: 2.6 | CDS | — | — | — | — | P0AFG0 | — | — | Transcription termination/antitermination protein NusG | hypothetical protein |
| Contig1 | 1803534 | 1804412 | − | GENE_01678 | Prodigal: 2.6 | CDS | — | — | — | — | Q55459 | cmpR_1 | — | — | HTH-type transcriptional activator CmpR |
| Contig1 | 1804551 | 1804874 | + | GENE_01679 | Prodigal: 2.6 | CDS | — | — | PF06942.6 | — | — | — | — | — | GlpM protein |
| Contig1 | 1805014 | 1806030 | + | GENE_01680 | Prodigal: 2.6 | CDS | 1.6.99.1 | — | — | — | P54550 | namA | — | — | NADPH dehydrogenase |
| Contig1 | 1806144 | 1806917 | + | GENE_01681 | Prodigal: 2.6 | CDS | — | — | — | MF_00832 | — | rutD_2 | — | — | Putative aminoacrylate hydrolase RutD |
| Contig1 | 1807195 | 1808121 | − | GENE_01682 | Prodigal: 2.6 | CDS | 3.1.26.11 | — | — | — | P54548 | rnz | — | — | Ribonuclease Z |
| Contig1 | 1808330 | 1809799 | + | GENE_01683 | Prodigal: 2.6 | CDS | 1.1.1.49 | — | — | — | P54547 | zwf | — | — | Glucose-6-phosphate 1-dehydrogenase |
| Contig1 | 1809891 | 1811300 | − | GENE_01684 | Prodigal: 2.6 | CDS | 1.1.1.44 | — | — | — | P80859 | gndA | — | — | 6-phosphogluconate dehydrogenase, NADP(+)-dependent, decarboxylating |
| Contig1 | 1811409 | 1812653 | − | GENE_01685 | Prodigal: 2.6 | CDS | 2.7.7.7 | — | — | — | Q47155 | dinB_2 | — | — | DNA polymerase IV |
| Contig1 | 1812729 | 1813010 | + | GENE_01686 | Prodigal: 2.6 | CDS | — | — | — | — | Q7WY64 | miM | — | — | Membrane protein insertion and folding monitor |
| Contig1 | 1813043 | 1813879 | + | GENE_01687 | Prodigal: 2.6 | CDS | — | — | — | — | P54544 | misCB | — | — | Membrane protein insertase MisCB precursor |
| Contig1 | 1813999 | 1815114 | − | GENE_01688 | Prodigal: 2.6 | CDS | 3.4.11.4 | — | — | — | P29745 | pepT_1 | — | — | Peptidase T |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1815131 | 1816654 | − | GENE_01689 | Prodigal: 2.6 | CDS | 2.1.3.1 | — | — | — | Q8GBW6 | — | — | — | Methylmalonyl-CoA carboxyltransferase 12S subunit |
| Contig1 | 1816641 | 1817069 | − | GENE_01690 | Prodigal: 2.6 | CDS | — | — | PF12681.1 | — | — | — | — | — | Glyoxalase-like domain protein |
| Contig1 | 1817163 | 1817258 | + | GENE_01691 | Prodigal: 2.6 | CDS | — | — | — | — | — | — | — | — | hypothetical protein |
| Contig1 | 1817272 | 1817802 | − | GENE_01692 | Prodigal: 2.6 | CDS | 2.-.-.- | — | — | — | O34816 | ykuD_2 | — | — | Putative L,D-transpeptidase YkuD |
| Contig1 | 1817872 | 1818825 | − | GENE_01693 | Prodigal: 2.6 | CDS | — | — | — | — | — | — | — | — | hypothetical protein |
| Contig1 | 1818902 | 1819624 | − | GENE_01694 | Prodigal: 2.6 | CDS | — | — | — | — | P54537 | artM | — | — | Arginine transport ATP-binding protein ArtM |
| Contig1 | 1819617 | 1820276 | − | GENE_01695 | Prodigal: 2.6 | CDS | — | — | — | — | P54536 | artQ | — | — | Arginine transport system permease protein ArtQ |
| Contig1 | 1820338 | 1821105 | − | GENE_01696 | Prodigal: 2.6 | CDS | — | — | — | — | P54535 | artP | — | — | Arginine-binding extracellular protein ArtP precursor |
| Contig1 | 1821351 | 1821788 | − | GENE_01697 | Prodigal: 2.6 | CDS | — | — | — | — | — | — | — | — | hypothetical protein |
| Contig1 | 1821966 | 1822862 | + | GENE_01698 | Prodigal: 2.6 | CDS | 2.7.1.- | — | — | — | P39074 | bmrU | — | — | Putative lipid kinase BmrU |
| Contig1 | 1822906 | 1824168 | − | GENE_01699 | Prodigal: 2.6 | CDS | 2.3.1.12 | — | — | — | P65636 | pdhC_3 | — | — | Dihydrolipoyllysine-residue acetyltransferase component of pyruvate dehydrogenase complex |
| Contig1 | 1824190 | 1825173 | − | GENE_01700 | Prodigal: 2.6 | CDS | 1.2.4.4 | — | — | — | P37941 | bfmBAB | — | — | 2-oxoisovalerate dehydrogenase subunit beta |
| Contig1 | 1825186 | 1826178 | − | GENE_01701 | Prodigal: 2.6 | CDS | 1.2.4.4 | — | — | — | P37940 | bfmBAA | — | — | 2-oxoisovalerate dehydrogenase subunit alpha |
| Contig1 | 1826201 | 1827622 | − | GENE_01702 | Prodigal: 2.6 | CDS | 1.8.1.4 | — | — | — | Q8NTE1 | lpd | — | — | Dihydrolipoyl dehydrogenase |
| Contig1 | 1827612 | 1828721 | − | GENE_01703 | Prodigal: 2.6 | CDS | 27.2.7 | — | — | — | Q97II1 | buk2 | — | — | Butyrate kinase 2 |
| Contig1 | 1828745 | 1829839 | − | GENE_01704 | Prodigal: 2.6 | CDS | 1.4.1.9 | — | — | — | P13154 | ldh_1 | — | — | Leucine dehydrogenase |
| Contig1 | 1829853 | 1830746 | − | GENE_01705 | Prodigal: 2.6 | CDS | 2.3.1.8 | — | — | — | Q9X0L4 | pta_1 | — | — | Phosphate acetyltransferase |
| Contig1 | 1830869 | 1832938 | − | GENE_01706 | Prodigal: 2.6 | CDS | — | — | — | — | P38022 | rocR_1 | — | — | Arginine utilization regulatory protein RocR |
| Contig1 | 1833092 | 1833334 | + | GENE_01707 | Prodigal: 2.6 | CDS | — | — | — | — | — | — | — | — | hypothetical protein |
| Contig1 | 1833363 | 1834268 | − | GENE_01708 | Prodigal: 2.6 | CDS | 4.1.3.30 | — | — | — | Q56062 | prpB | — | — | Methylisocitrate lyase |
| Contig1 | 1834287 | 1835714 | − | GENE_01709 | Prodigal: 2.6 | CDS | 4.2.1.79 | — | — | — | P45859 | prpD | — | — | 2-methylcitrate dehydratase |
| Contig1 | 1835740 | 1836837 | − | GENE_01710 | Prodigal: 2.6 | CDS | 2.3.3.5 | — | — | — | P45858 | mmgD | — | — | 2-methylcitrate synthase |
| Contig1 | 1836861 | 1837994 | − | GENE_01711 | Prodigal: 2.6 | CDS | 1.3.99.- | — | — | — | P45857 | mmgC | — | — | Acyl-CoA dehydrogenase |
| Contig1 | 1838024 | 1838875 | − | GENE_01712 | Prodigal: 2.6 | CDS | 1.1.1.157 | — | — | — | P45856 | mmgB | — | — | putative 3-hydroxybutyryl-CoA dehydrogenase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1838895 | 1840076 | − | GENE_01713 | Prodigal: 2.6 | CDS | 2.3.1.9 | — | — | — | P45855 | mmgA | — | — | Acetyl-CoA acetyltransferase |
| Contig1 | 1840217 | 1840954 | − | GENE_01714 | Prodigal: 2.6 | CDS | 3.1.4.46 | — | — | — | P10908 | ugpQ_2 | — | — | Glycerophosphoryl diester phosphodiesterase |
| Contig1 | 1841042 | 1841668 | − | GENE_01715 | Prodigal: 2.6 | CDS | 3.5.1.28 | — | — | — | Q02114 | lytC_1 | — | — | N-acetylmuramoyl-L-alanine amidase LytC precursor |
| Contig1 | 1841687 | 1841980 | − | GENE_01716 | Prodigal: 2.6 | CDS | — | — | — | — | — | — | — | — | hypothetical protein |
| Contig1 | 1842314 | 1842937 | − | GENE_01717 | Prodigal: 2.6 | CDS | — | — | — | MF_01521 | — | mntP_1 | — | — | Putative manganese efflux pump MntP |
| Contig1 | 1843084 | 1843716 | + | GENE_01718 | Prodigal: 2.6 | CDS | — | — | PF01381.16 | — | — | — | — | — | Helix-turn-helix |
| Contig1 | 1843837 | 1843932 | + | GENE_01719 | Prodigal: 2.6 | CDS | — | — | — | — | — | — | — | — | hypothetical protein |
| Contig1 | 1844238 | 1845356 | + | GENE_01720 | Prodigal: 2.6 | CDS | 1.-.-.- | — | — | — | P32382 | — | — | — | NADH oxidase |
| Contig1 | 1845480 | 1845695 | + | GENE_01721 | Prodigal: 2.6 | CDS | — | — | — | — | O06716 | gerPF_2 | — | — | putative spore germination protein GerPF |
| Contig1 | 1845822 | 1846034 | + | GENE_01722 | Prodigal: 2.6 | CDS | — | — | — | — | O06716 | gerPF_3 | — | — | putative spore germination protein GerPF |
| Contig1 | 1846209 | 1847390 | + | GENE_01723 | Prodigal: 2.6 | CDS | 5.1.1.1 | — | — | — | Q9S5V6 | alr_1 | — | — | Alanine racemase |
| Contig1 | 1847538 | 1848338 | − | GENE_01724 | Prodigal: 2.6 | CDS | — | — | — | — | P06534 | spo0A_1 | — | — | Stage 0 sporulation protein A |
| Contig1 | 1848619 | 1849899 | − | GENE_01725 | Prodigal: 2.6 | CDS | 3.4.21.11 | — | — | — | P17896 | spoIVB | — | — | SpoIVB peptidase precursor |
| Contig1 | 1850063 | 1851793 | − | GENE_01726 | Prodigal: 2.6 | CDS | — | — | — | — | P05824 | recN | — | — | DNA repair protein RecN |
| Contig1 | 1851825 | 1852274 | − | GENE_01727 | Prodigal: 2.6 | CDS | — | — | — | — | P17893 | argR | — | — | Arginine repressor |
| Contig1 | 1852369 | 1853214 | − | GENE_01728 | Prodigal: 2.6 | CDS | — | — | — | — | Q06803 | tlyA | — | — | Hemolysin A |
| Contig1 | 1853211 | 1855112 | − | GENE_01729 | Prodigal: 2.6 | CDS | 2.2.1.7 | — | — | — | P77488 | dxs | — | — | 1-deoxy-D-xylulose-5-phosphate synthase |
| Contig1 | 1855256 | 1856146 | − | GENE_01730 | Prodigal: 2.6 | CDS | 2.5.1.10 | — | — | — | Q08291 | — | — | — | Farnesyl diphosphate synthase |
| Contig1 | 1856136 | 1856390 | − | GENE_01731 | Prodigal: 2.6 | CDS | 3.1.11.6 | — | — | — | P0A8G9 | xseB | — | — | Exodeoxyribonuclease 7 small subunit |
| Contig1 | 1856387 | 1857733 | − | GENE_01732 | Prodigal: 2.6 | CDS | 3.1.11.6 | — | — | — | P04994 | xseA | — | — | Exodeoxyribonuclease 7 large subunit |
| Contig1 | 1857857 | 1858708 | − | GENE_01733 | Prodigal: 2.6 | CDS | — | — | — | — | Q0PA35 | folD | — | — | Bifunctional protein FolD protein |
| Contig1 | 1858720 | 1859112 | − | GENE_01734 | Prodigal: 2.6 | CDS | — | — | — | — | P65578 | — | — | N utilization substance protein B homolog | hypothetical protein |
| Contig1 | 1859377 | 1859784 | − | GENE_01735 | Prodigal: 2.6 | CDS | — | — | — | — | P0A0P8 | — | — | — | Alkaline shock protein 23 |
| Contig1 | 1859806 | 1861158 | − | GENE_01736 | Prodigal: 2.6 | CDS | 6.3.4.14 | — | — | — | P37798 | accC | — | — | Biotin carboxylase |
| Contig1 | 1861173 | 1861652 | − | GENE_01737 | Prodigal: 2.6 | CDS | — | — | — | — | Q06881 | accB | — | — | Biotin carboxyl carrier protein of acetyl-CoA carboxylase |
| Contig1 | 1861806 | 1862456 | − | GENE_01738 | Prodigal: 2.6 | CDS | — | — | — | — | P49785 | spoIIIAH | — | — | Stage III sporulation protein AH |

TABLE 5-continued

| #ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1862460 | 1863152 | − | GENE_01739 | Prodigal: 2.6 | CDS | — | — | — | — | — | — | — | — | hypothetical protein |
| Contig1 | 1863145 | 1863765 | − | GENE_01740 | Prodigal: 2.6 | CDS | — | — | PF09581.4 | — | — | — | — | — | Stage III sporulation protein AF (Spore_III_AF) |
| Contig1 | 1863782 | 1864990 | − | GENE_01741 | Prodigal: 2.6 | CDS | — | — | — | — | P49782 | spoIIIAE | — | — | Stage III sporulation protein AE precursor |
| Contig1 | 1865023 | 1865355 | − | GENE_01742 | Prodigal: 2.6 | CDS | — | — | PF06686.5 | — | — | — | — | — | Stage III sporulation protein AC/AD protein family protein |
| Contig1 | 1865425 | 1865631 | − | GENE_01743 | Prodigal: 2.6 | CDS | — | — | PF06686.5 | — | — | — | — | — | Stage III sporulation protein AC/AD protein family protein |
| Contig1 | 1865654 | 1866169 | − | GENE_01744 | Prodigal: 2.6 | CDS | — | PRK08307 | — | — | — | — | — | — | stage III sporulation protein SpoAB |
| Contig1 | 1866163 | 1867086 | − | GENE_01745 | Prodigal: 2.6 | CDS | — | — | PF03266.9 | — | — | — | — | — | NTPase |
| Contig1 | 1867163 | 1867444 | − | GENE_01746 | Prodigal: 2.6 | CDS | — | — | — | — | — | — | — | — | hypothetical protein |
| Contig1 | 1867592 | 1868149 | − | GENE_01747 | Prodigal: 2.6 | CDS | — | — | — | — | P99066 | efp | — | — | Elongation factor P |
| Contig1 | 1868174 | 1869235 | − | GENE_01748 | Prodigal: 2.6 | CDS | 3.4.13.9 | — | PF11085.2 | — | Q9S6S1 | pepQ | — | — | Xaa-Pro dipeptidase |
| Contig1 | 1869367 | 1869897 | − | GENE_01749 | Prodigal: 2.6 | CDS | — | — | — | — | — | — | — | Conserved membrane protein YqhR | hypothetical protein |
| Contig1 | 1870119 | 1871075 | + | GENE_01750 | Prodigal: 2.6 | CDS | — | — | — | — | — | — | — | — | hypothetical protein |
| Contig1 | 1871110 | 1871505 | + | GENE_01751 | Prodigal: 2.6 | CDS | — | — | — | — | — | — | — | — | hypothetical protein |
| Contig1 | 1871502 | 1872377 | − | GENE_01752 | Prodigal: 2.6 | CDS | — | — | PF01734.1 | — | — | — | — | — | Patatin-like phospholipase |
| Contig1 | 1872492 | 1872920 | − | GENE_01753 | Prodigal: 2.6 | CDS | — | — | — | — | P54512 | mntR | — | — | Transcriptional regulator MntR |
| Contig1 | 1873020 | 1873856 | − | GENE_01754 | Prodigal: 2.6 | CDS | 2.3.1.181 | — | — | — | P54511 | lipM | — | — | Octanoyltransferase LipM |
| Contig1 | 1874050 | 1874430 | + | GENE_01755 | Prodigal: 2.6 | CDS | — | — | — | — | Q7D5X9 | moeZ | — | — | putative adenylyltransferase/ sulfurtransferase MoeZ |
| Contig1 | 1874483 | 1875958 | − | GENE_01756 | Prodigal: 2.6 | CDS | 1.4.4.2 | — | — | — | P99168 | gcvPB | — | — | putative glycine dehydrogenase (decarboxylating) subunit 2 |
| Contig1 | 1875951 | 1877297 | − | GENE_01757 | Prodigal: 2.6 | CDS | 1.4.4.2 | — | — | — | P64218 | gcvPA | — | — | putative glycine dehydrogenase (decarboxylating) subunit 1 |
| Contig1 | 1877312 | 1878415 | − | GENE_01758 | Prodigal: 2.6 | CDS | 2.1.2.10 | — | — | — | P54378 | gcvT | — | — | Aminomethyltransferase |
| Contig1 | 1878835 | 1880505 | + | GENE_01759 | Prodigal: 2.6 | CDS | 3.6.4.- | — | — | — | P60240 | rapA_3 | — | — | RNA polymerase-associated protein RapA |
| Contig1 | 1880523 | 1881317 | + | GENE_01760 | Prodigal: 2.6 | CDS | — | — | PF11079.2 | — | — | — | — | — | Bacterial protein YqhG of unknown function |
| Contig1 | 1881494 | 1881667 | + | GENE_01761 | Prodigal: 2.6 | CDS | — | — | PF08671.4 | — | — | — | — | — | Anti-repressor SinI |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1881695 | 1881997 | + | GENE_01762 | Prodigal: 2.6 | CDS | — | — | — | — | P06533 | sinR_1 | — | — | HTH-type transcriptional regulator SinR |
| Contig1 | 1882083 | 1882868 | — | GENE_01763 | Prodigal: 2.6 | CDS | — | — | — | — | P54507 | tasA | — | — | Spore coat-associated protein N precursor |
| Contig1 | 1882932 | 1883516 | — | GENE_01764 | Prodigal: 2.6 | CDS | 3.4.21.89 | — | — | — | P54506 | sipW | — | — | Signal peptidase I W |
| Contig1 | 1883488 | 1884159 | — | GENE_01765 | Prodigal: 2.6 | CDS | — | — | — | — | — | — | — | — | hypothetical protein |
| Contig1 | 1884418 | 1884747 | + | GENE_01766 | Prodigal: 2.6 | CDS | — | — | — | — | — | — | — | — | hypothetical protein |
| Contig1 | 1884787 | 1884966 | — | GENE_01767 | Prodigal: 2.6 | CDS | — | — | — | — | — | — | — | — | hypothetical protein |
| Contig1 | 1885023 | 1885400 | — | GENE_01768 | Prodigal: 2.6 | CDS | — | — | — | — | P25959 | comGG | — | — | ComG operon protein 7 precursor |
| Contig1 | 1885401 | 1885796 | — | GENE_01769 | Prodigal: 2.6 | CDS | — | — | — | — | — | — | — | — | hypothetical protein |
| Contig1 | 1885810 | 1886130 | — | GENE_01770 | Prodigal: 2.6 | CDS | — | — | — | — | — | — | — | — | hypothetical protein |
| Contig1 | 1886108 | 1886545 | — | GENE_01771 | Prodigal: 2.6 | CDS | — | — | — | — | — | — | — | — | hypothetical protein |
| Contig1 | 1886535 | 1886801 | — | GENE_01772 | Prodigal: 2.6 | CDS | — | — | — | — | P25955 | comGC | — | — | ComG operon protein 3 precursor |
| Contig1 | 1886848 | 1887885 | — | GENE_01773 | Prodigal: 2.6 | CDS | — | — | — | — | P45780 | epsF_1 | — | — | Type II secretion system protein F |
| Contig1 | 1887872 | 1888942 | — | GENE_01774 | Prodigal: 2.6 | CDS | — | — | — | — | P45759 | gspE | — | — | Putative type II secretion system protein E |
| Contig1 | 1889134 | 1890084 | — | GENE_01775 | Prodigal: 2.6 | CDS | — | — | — | — | P40948 | corA_2 | — | — | Magnesium transport protein CorA |
| Contig1 | 1890230 | 1891531 | + | GENE_01776 | Prodigal: 2.6 | CDS | — | — | — | — | P0A2L3 | corC_2 | — | — | Magnesium and cobalt efflux protein CorC |
| Contig1 | 1891569 | 1892399 | — | GENE_01777 | Prodigal: 2.6 | CDS | — | — | — | — | P54504 | rsbRD_2 | — | — | RsbT co-antagonist protein RsbRD |
| Contig1 | 1892471 | 1892541 | + | GENE_01778 | Aragorn: 1.2 | tRNA | — | — | — | — | — | — | — | — | tRNA-Gln(ttg) |
| Contig1 | 1892605 | 1892985 | + | GENE_01779 | Prodigal: 2.6 | CDS | — | — | — | — | P54503 | mgsR_1 | — | — | Regulatory protein MgsR |
| Contig1 | 1893222 | 1893467 | + | GENE_01780 | Prodigal: 2.6 | CDS | — | — | — | — | — | — | — | — | hypothetical protein |
| Contig1 | 1893508 | 1894146 | — | GENE_01781 | Prodigal: 2.6 | CDS | 3.-.-.- | — | — | — | Q5XD24 | — | — | — | putative metallo-hydrolase |
| Contig1 | 1894301 | 1894474 | + | GENE_01782 | Prodigal: 2.6 | CDS | — | — | — | — | — | — | — | — | hypothetical protein |
| Contig1 | 1894507 | 1894821 | — | GENE_01783 | Prodigal: 2.6 | CDS | — | — | — | — | — | — | — | — | hypothetical protein |
| Contig1 | 1894827 | 1895864 | — | GENE_01784 | Prodigal: 2.6 | CDS | — | — | — | — | — | — | — | — | hypothetical protein |
| Contig1 | 1895937 | 1897064 | — | GENE_01785 | Prodigal: 2.6 | CDS | 3.4.19.11 | — | — | — | Q03415 | — | — | — | Gamma-D-glutamyl-L-diamino acid endopeptidase 1 |
| Contig1 | 1897147 | 1898109 | — | GENE_01786 | Prodigal: 2.6 | CDS | 2.7.1.2 | — | — | — | P54495 | glcK | — | — | Glucokinase |
| Contig1 | 1898145 | 1898354 | — | GENE_01787 | Prodigal: 2.6 | CDS | — | — | — | — | — | — | — | — | hypothetical protein |
| Contig1 | 1898552 | 1899916 | + | GENE_01788 | Prodigal: 2.6 | CDS | — | — | — | — | O07553 | nhaC_2 | — | — | Na(+)/H(+) antiporter NhaC |
| Contig1 | 1899993 | 1900166 | — | GENE_01789 | Prodigal: 2.6 | CDS | — | — | — | — | — | — | — | — | hypothetical protein |
| Contig1 | 1900237 | 1900791 | — | GENE_01790 | Prodigal: 2.6 | CDS | 6.3.3.2 | — | — | — | P75430 | — | — | — | putative 5-formyltetrahydrofolate cyclo-ligase |
| Contig1 | 1900870 | 1901019 | — | GENE_01791 | Prodigal: 2.6 | CDS | — | — | — | — | P23375 | rpmGA | — | — | 50S ribosomal protein L33 1 |
| Contig1 | 1901367 | 1901720 | + | GENE_01792 | Prodigal: 2.6 | CDS | — | — | — | — | — | — | — | — | hypothetical protein |
| Contig1 | 1901717 | 1902181 | + | GENE_01793 | Prodigal: 2.6 | CDS | — | — | PF02618.10 | — | — | — | — | — | YceG-like family protein |
| Contig1 | 1902279 | 1903061 | — | GENE_01794 | Prodigal: 2.6 | CDS | 3.6.3.27 | — | — | — | P0A2V9 | pstB3_2 | — | — | Phosphate import ATP-binding protein PstB 3 |

TABLE 5-continued

| #ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1903073 | 1903879 | − | GENE_01795 | Prodigal: 2.6 | CDS | 3.6.3.27 | — | — | — | P0A2V9 | pstB3_3 | — | — | Phosphate import ATP-binding protein PstB 3 |
| Contig1 | 1903898 | 1904782 | − | GENE_01796 | Prodigal: 2.6 | CDS | | — | — | — | P07654 | pstA | — | — | Phosphate transport system permease protein PstA |
| Contig1 | 1904782 | 1905711 | − | GENE_01797 | Prodigal: 2.6 | CDS | | — | — | — | P0AGH8 | pstC | — | — | Phosphate transport system permease protein PstC |
| Contig1 | 1905760 | 1906662 | − | GENE_01798 | Prodigal: 2.6 | CDS | | — | — | — | Q8DPB1 | pstS1 | — | — | Phosphate-binding protein PstS 1 precursor |
| Contig1 | 1906818 | 1908965 | − | GENE_01799 | Prodigal: 2.6 | CDS | | — | — | — | Q796K8 | pbpH_2 | — | — | Penicillin-binding protein H |
| Contig1 | 1909067 | 1910356 | − | GENE_01800 | Prodigal: 2.6 | CDS | | — | PF07690.10 | — | — | — | — | — | Major Facilitator Superfamily protein |
| Contig1 | 1910474 | 1911079 | − | GENE_01801 | Prodigal: 2.6 | CDS | 1.15.1.1 | — | — | — | P54375 | sodA_2 | — | — | Superoxide dismutase [Mn] |
| Contig1 | 1911246 | 1911728 | − | GENE_01802 | Prodigal: 2.6 | CDS | | — | — | — | — | — | — | — | hypothetical protein |
| Contig1 | 1911887 | 1912651 | + | GENE_01803 | Prodigal: 2.6 | CDS | | — | — | — | — | — | — | — | hypothetical protein |
| Contig1 | 1912743 | 1913045 | + | GENE_01804 | Prodigal: 2.6 | CDS | | — | — | — | — | — | — | — | hypothetical protein |
| Contig1 | 1913169 | 1914296 | + | GENE_01805 | Prodigal: 2.6 | CDS | 1.17.7.1 | — | — | — | Q81LV7 | ispG | — | — | 4-hydroxy-3-methylbut-2-en-1-yl diphosphate synthase |
| Contig1 | 1914330 | 1914701 | + | GENE_01806 | Prodigal: 2.6 | CDS | | — | — | — | — | — | — | — | hypothetical protein |
| Contig1 | 1914841 | 1915422 | + | GENE_01807 | Prodigal: 2.6 | CDS | | — | — | — | — | — | — | — | hypothetical protein |
| Contig1 | 1915453 | 1915863 | − | GENE_01808 | Prodigal: 2.6 | CDS | | — | — | — | P54479 | zur | — | — | Zinc-specific metallo-regulatory protein |
| Contig1 | 1915987 | 1916868 | − | GENE_01809 | Prodigal: 2.6 | CDS | | — | — | — | — | — | — | — | hypothetical protein |
| Contig1 | 1916987 | 1917241 | + | GENE_01810 | Prodigal: 2.6 | CDS | | — | — | — | — | — | — | — | hypothetical protein |
| Contig1 | 1917270 | 1918163 | + | GENE_01811 | Prodigal: 2.6 | CDS | 3.1.21.2 | — | — | — | Q5KX27 | nfo | — | — | putative endonuclease 4 |
| Contig1 | 1918175 | 1919491 | − | GENE_01812 | Prodigal: 2.6 | CDS | 3.6.4.13 | — | — | — | P54475 | cshB_2 | — | — | DEAD-box ATP-dependent RNA helicase CshB |
| Contig1 | 1919657 | 1920352 | + | GENE_01813 | Prodigal: 2.6 | CDS | | — | — | — | — | — | — | — | hypothetical protein |
| Contig1 | 1920475 | 1921419 | + | GENE_01814 | Prodigal: 2.6 | CDS | 1.17.1.2 | — | — | — | P62623 | ispH | — | — | 4-hydroxy-3-methylbut-2-enyl diphosphate reductase |
| Contig1 | 1921440 | 1922561 | − | GENE_01815 | Prodigal: 2.6 | CDS | 3.5.4.16 | — | — | — | P67272 | — | — | — | Putative GTP cyclohydrolase 1 type 2 |
| Contig1 | 1922554 | 1923309 | − | GENE_01816 | Prodigal: 2.6 | CDS | 2.1.1.217 | — | — | — | P54471 | trmK | — | — | tRNA (adenine(22))-N(1)-methyltransferase |
| Contig1 | 1923384 | 1923746 | − | GENE_01817 | Prodigal: 2.6 | CDS | | — | — | — | P24469 | CCcA2 | — | — | Cytochrome c-550 |
| Contig1 | 1924097 | 1925218 | − | GENE_01818 | Prodigal: 2.6 | CDS | | — | — | — | P06224 | sigA | — | — | RNA polymerase sigma factor SigA |
| Contig1 | 1925410 | 1927221 | − | GENE_01819 | Prodigal: 2.6 | CDS | 2.7.7.- | — | — | — | Q9X4D0 | dnaG | — | — | DNA primase |
| Contig1 | 1927243 | 1927749 | − | GENE_01820 | Prodigal: 2.6 | CDS | | — | — | — | — | — | — | — | hypothetical protein |
| Contig1 | 1928005 | 1928817 | − | GENE_01821 | Prodigal: 2.6 | CDS | 2.7.11.32 | PRK00124 | — | — | P54470 | yqfL | — | — | Putative pyruvate, phosphate dikinase regulatory protein |
| Contig1 | 1928843 | 1929484 | − | GENE_01822 | Prodigal: 2.6 | CDS | | — | — | — | O34994 | ccpN | — | — | Transcriptional repressor CcpN |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1929582 | 1930295 | − | GENE_01823 | Prodigal: 2.6 | CDS | 6.1.1.14 | — | — | — | P00961 | glyS_1 | — | — | Glycine--tRNA ligase beta subunit |
| Contig1 | 1930259 | 1931620 | − | GENE_01824 | Prodigal: 2.6 | CDS | 6.1.1.14 | — | — | — | P00961 | glyS_2 | — | — | Glycine--tRNA ligase beta subunit |
| Contig1 | 1931613 | 1932500 | − | GENE_01825 | Prodigal: 2.6 | CDS | 6.1.1.14 | — | — | — | P00960 | glyQ | — | — | Glycine--tRNA ligase alpha subunit |
| Contig1 | 1932802 | 1933569 | − | GENE_01826 | Prodigal: 2.6 | CDS | — | — | — | — | P42095 | recO | — | — | DNA repair protein RecO |
| Contig1 | 1933606 | 1933749 | − | GENE_01827 | Prodigal: 2.6 | CDS | — | — | — | — | — | — | — | — | hypothetical protein |
| Contig1 | 1933905 | 1934810 | − | GENE_01828 | Prodigal: 2.6 | CDS | — | — | — | — | P42182 | era | — | — | GTPase Era |
| Contig1 | 1934791 | 1935201 | − | GENE_01829 | Prodigal: 2.6 | CDS | 3.5.4.5 | — | — | — | P19079 | cdd | — | — | Cytidine deaminase |
| Contig1 | 1935325 | 1935705 | − | GENE_01830 | Prodigal: 2.6 | CDS | 2.7.1.66 | — | — | — | P19638 | dgkA | — | — | Undecaprenol kinase |
| Contig1 | 1935680 | 1936153 | − | GENE_01831 | Prodigal: 2.6 | CDS | 3.1.-.- | — | — | — | O67367 | ybeY | — | — | Endoribonuclease YbeY |
| Contig1 | 1936154 | 1938286 | − | GENE_01832 | Prodigal: 2.6 | CDS | — | — | PF07697.5 | — | — | — | — | — | 7TM-HD extracellular PhoH-like protein |
| Contig1 | 1938367 | 1939326 | − | GENE_01833 | Prodigal: 2.6 | CDS | — | — | PF06898.5 | — | P0A9K3 | ybeZ_2 | — | — | Putative stage IV sporulation protein YqfD |
| Contig1 | 1939330 | 1940514 | − | GENE_01834 | Prodigal: 2.6 | CDS | — | — | — | — | — | — | — | — | YabP family protein |
| Contig1 | 1940532 | 1940813 | − | GENE_01835 | Prodigal: 2.6 | CDS | — | — | PF07873.5 | — | — | — | — | — | hypothetical protein |
| Contig1 | 1940870 | 1941304 | − | GENE_01836 | Prodigal: 2.6 | CDS | — | — | PF12127.2 | — | — | — | — | — | SigmaW regulon antibacterial |
| Contig1 | 1941332 | 1942324 | − | GENE_01837 | Prodigal: 2.6 | CDS | — | — | — | — | — | — | — | — | hypothetical protein |
| Contig1 | 1942349 | 1943665 | − | GENE_01838 | Prodigal: 2.6 | CDS | — | — | PF01957.12 | — | — | — | — | NfeD-like C-terminal, partner-binding | hypothetical protein |
| Contig1 | 1943788 | 1944234 | − | GENE_01839 | Prodigal: 2.6 | CDS | — | PRK04028 | — | — | — | — | — | — | glutamyl-tRNA(Gln) amidotransferase subunit E |
| Contig1 | 1944249 | 1944422 | − | GENE_01840 | Prodigal: 2.6 | CDS | — | — | — | — | — | — | — | — | 30S ribosomal protein S21 |
| Contig1 | 1944585 | 1945520 | + | GENE_01841 | Prodigal: 2.6 | CDS | 2.-.-.- | — | PF02690.9 | — | P21478 | rpsU | — | — | Na+/Pi-cotransporter |
| Contig1 | 1945558 | 1946913 | − | GENE_01842 | Prodigal: 2.6 | CDS | — | — | — | — | P54462 | mtaB | — | — | Threonylcarbamoyl-adenosine tRNA methylthiotransferase MtaB |
| Contig1 | 1946913 | 1947683 | − | GENE_01843 | Prodigal: 2.6 | CDS | 2.1.1.193 | — | — | — | P54461 | rsmE | — | — | Ribosomal RNA small subunit methyltransferase E |
| Contig1 | 1947706 | 1948641 | − | GENE_01844 | Prodigal: 2.6 | CDS | 2.1.1.- | — | — | — | P0A0P5 | prmA | — | — | Ribosomal protein L11 methyltransferase |
| Contig1 | 1948665 | 1949792 | − | GENE_01845 | Prodigal: 2.6 | CDS | — | — | — | — | P17631 | dnaJ | — | — | Chaperone protein DnaJ |
| Contig1 | 1949978 | 1951816 | − | GENE_01846 | Prodigal: 2.6 | CDS | — | — | — | MF_01151 | P17820 | dnaK | — | — | Chaperone protein DnaK |
| Contig1 | 1951841 | 1952416 | − | GENE_01847 | Prodigal: 2.6 | CDS | — | — | — | — | — | grpE | — | — | Protein GrpE |
| Contig1 | 1952476 | 1953507 | − | GENE_01847 | Prodigal: 2.6 | CDS | — | — | — | — | P30727 | hrcA | — | — | Heat-inducible transcription repressor HrcA |
| Contig1 | 1953588 | 1954727 | − | GENE_01849 | Prodigal: 2.6 | CDS | 1.3.99.22 | — | — | — | P54304 | hemN | — | — | Oxygen-independent coproporphyrinogen-III oxidase 1 |
| Contig1 | 1954787 | 1956622 | − | GENE_01850 | Prodigal: 2.6 | CDS | 3.6.5.- | — | — | — | Q2FXY7 | lepA | — | — | Elongation factor 4 |
| Contig1 | 1956755 | 1957093 | − | GENE_01851 | Prodigal: 2.6 | CDS | — | — | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1957110 | 1958303 | − | GENE_01852 | Prodigal: 2.6 | CDS | — | — | PF07454.5 | — | — | — | — | — | Stage II sporulation protein P (SpoIIP) |
| Contig1 | 1958371 | 1959477 | − | GENE_01853 | Prodigal: 2.6 | CDS | 3.4.24.78 | — | — | — | P22322 | gpr | — | — | Germination protease precursor |
| Contig1 | 1959680 | 1959946 | + | GENE_01854 | Prodigal: 2.6 | CDS | — | — | — | — | P21477 | rpsT | — | — | 30S ribosomal protein S20 |
| Contig1 | 1959982 | 1961004 | − | GENE_01855 | Prodigal: 2.6 | CDS | — | PRK05574 | — | — | — | — | — | — | DNA polymerase III subunit delta |
| Contig1 | 1961392 | 1963743 | − | GENE_01856 | Prodigal: 2.6 | CDS | — | PRK11539 | — | — | — | — | — | — | ComEC family competence protein |
| Contig1 | 1963744 | 1964313 | − | GENE_01857 | Prodigal: 2.6 | CDS | 3.5.4.33 | — | — | MF_00972 | — | tadA_1 | — | — | tRNA-specific adenosine deaminase |
| Contig1 | 1964380 | 1964994 | − | GENE_01858 | Prodigal: 2.6 | CDS | — | — | — | — | P39694 | comEA | — | — | ComE operon protein 1 |
| Contig1 | 1965053 | 1965874 | + | GENE_01859 | Prodigal: 2.6 | CDS | 1.5.1.2 | — | — | — | Q7A5G8 | proC_3 | — | — | Pyrroline-5-carboxylate reductase |
| Contig1 | 1965943 | 1966680 | − | GENE_01860 | Prodigal: 2.6 | CDS | 2.1.1.- | — | — | — | E5KIC0 | cypM_1 | — | — | Cypemycin methyltransferase |
| Contig1 | 1966677 | 1967033 | − | GENE_01861 | Prodigal: 2.6 | CDS | — | — | — | — | Q9KD89 | rsfS | — | — | Ribosomal silencing factor RsfS |
| Contig1 | 1967051 | 1967611 | − | GENE_01862 | Prodigal: 2.6 | CDS | — | PRK07152 | — | — | — | — | — | — | putative nicotinate-nucleotide adenylyltransferase |
| Contig1 | 1967601 | 1968170 | − | GENE_01863 | Prodigal: 2.6 | CDS | 2.7.7.18 | — | — | — | P54455 | nadD | — | — | Nicotinate-nucleotide adenylyltransferase |
| Contig1 | 1968181 | 1968471 | − | GENE_01864 | Prodigal: 2.6 | CDS | — | — | — | — | — | — | — | — | RNA-binding protein |
| Contig1 | 1968465 | 1969307 | − | GENE_01865 | Prodigal: 2.6 | CDS | 1.1.1.25 | — | — | — | P71376 | aroE_2 | — | — | Shikimate dehydrogenase |
| Contig1 | 1969327 | 1970427 | − | GENE_01866 | Prodigal: 2.6 | CDS | — | — | — | MF_00195 | Q5HNV1 | der_2 | — | — | GTPase Der |
| Contig1 | 1970430 | 1970948 | − | GENE_01867 | Prodigal: 2.6 | CDS | 3.1.3.18 | — | — | MF_00495 | — | gph | — | — | Phosphoglycolate phosphatase |
| Contig1 | 1971578 | 1971712 | − | GENE_01868 | Prodigal: 2.6 | CDS | — | — | — | — | — | — | — | — | hypothetical protein |
| Contig1 | 1971787 | 1972518 | − | GENE_01869 | Prodigal: 2.6 | CDS | — | PRK10528 | — | — | — | — | — | — | multifunctional acyl-CoA thioesterase I and protease I and lysophospholipase L1 |
| Contig1 | 1972588 | 1973322 | − | GENE_01870 | Prodigal: 2.6 | CDS | 3.5.1.- | — | — | — | O34798 | pdaC_1 | — | — | Peptidoglycan-N-acetylmuramic acid deacetylase PdaC |
| Contig1 | 1973556 | 1974182 | + | GENE_01871 | Prodigal: 2.6 | CDS | — | — | — | — | P76221 | ydjz2 | — | — | TVP38/TMEM64 family inner membrane protein YdjZ |
| Contig1 | 1974528 | 1974668 | − | GENE_01872 | Prodigal: 2.6 | CDS | — | — | — | — | — | — | — | — | hypothetical protein |
| Contig1 | 1974634 | 1975890 | − | GENE_01873 | Prodigal: 2.6 | CDS | — | PRK10489 | — | — | — | — | — | — | enterobactin exporter EntS |
| Contig1 | 1976345 | 1977070 | + | GENE_01874 | Prodigal: 2.6 | CDS | — | — | — | — | P12254 | sigK | — | — | RNA polymerase sigma-K factor precursor |
| Contig1 | 1977117 | 1977317 | − | GENE_01875 | Prodigal: 2.6 | CDS | — | — | — | — | — | — | — | — | hypothetical protein |
| Contig1 | 1977418 | 1978116 | − | GENE_01876 | Prodigal: 2.6 | CDS | 5.1.1.13 | — | — | — | P29079 | — | — | — | Aspartate racemase |
| Contig1 | 1979158 | 1980009 | − | GENE_01877 | Prodigal: 2.6 | CDS | 1.1.1.- | — | — | — | O32210 | yvgN_1 | — | — | Glyoxal reductase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 1980180 | 1980623 | + | GENE_01878 | Prodigal: 2.6 | CDS | — | — | — | — | O06008 | adhR_1 | — | — | HTH-type transcriptional regulator AdhR |
| Contig1 | 1980787 | 1980963 | − | GENE_01879 | Prodigal: 2.6 | CDS | — | — | — | — | — | — | — | — | hypothetical protein |
| Contig1 | 1981104 | 1982099 | − | GENE_01880 | Prodigal: 2.6 | CDS | — | — | — | — | — | — | — | — | hypothetical protein |
| Contig1 | 1982663 | 1983028 | − | GENE_01881 | Prodigal: 2.6 | CDS | — | — | — | — | — | — | — | — | hypothetical protein |
| Contig1 | 1983104 | 1983214 | − | GENE_01882 | Prodigal: 2.6 | CDS | — | — | — | — | — | — | — | — | hypothetical protein |
| Contig1 | 1983308 | 1983961 | − | GENE_01883 | Prodigal: 2.6 | CDS | — | — | — | — | — | — | — | — | hypothetical protein |
| Contig1 | 1983991 | 1984227 | − | GENE_01884 | Prodigal: 2.6 | CDS | — | — | — | — | — | — | — | — | hypothetical protein |
| Contig1 | 1985108 | 1985914 | + | GENE_01885 | Prodigal: 2.6 | CDS | — | — | — | — | D5EXZ4 | axel-6A | — | — | Carbohydrate acetyl esterase/feruloyl esterase precursor |
| Contig1 | 1985911 | 1986438 | + | GENE_01886 | Prodigal: 2.6 | CDS | — | — | PF03551.8 | — | — | — | — | — | Transcriptional regulator PadR-like family protein |
| Contig1 | 1986493 | 1986918 | + | GENE_01887 | Prodigal: 2.6 | CDS | — | — | PF06445.9 | — | — | — | — | — | Bacterial transcription activator, effector binding domain |
| Contig1 | 1987371 | 1987910 | − | GENE_01888 | Prodigal: 2.6 | CDS | — | PRK06217 | — | — | — | — | — | — | hypothetical protein |
| Contig1 | 1988391 | 1989767 | − | GENE_01889 | Prodigal: 2.6 | CDS | — | — | — | — | P31474 | hsrA_2 | — | — | putative transport protein HsrA |
| Contig1 | 1989976 | 1990500 | − | GENE_01890 | Prodigal: 2.6 | CDS | — | PRK10975 | — | — | — | — | — | — | TDP-fucosamine acetyltransferase |
| Contig1 | 1990657 | 1991157 | − | GENE_01891 | Prodigal: 2.6 | CDS | — | — | PF05163.6 | — | — | — | — | — | DinB family protein |
| Contig1 | 1991353 | 1991637 | − | GENE_01892 | Prodigal: 2.6 | CDS | 3.1.3.- | — | — | — | — | — | — | — | hypothetical protein |
| Contig1 | 1991878 | 1992681 | − | GENE_01893 | Prodigal: 2.6 | CDS | 3.1.3.- | — | — | — | P75809 | ybjI_1 | — | — | Flavin mononucleotide phosphatase YbjI |
| Contig1 | 1992714 | 1993526 | − | GENE_01894 | Prodigal: 2.6 | CDS | — | — | — | — | P75809 | ybjI_2 | — | — | Flavin mononucleotide phosphatase YbjI |
| Contig1 | 1993762 | 1994487 | + | GENE_01895 | Prodigal: 2.6 | CDS | — | — | — | — | Q45581 | ybbH_1 | — | — | putative HTH-type transcriptional regulator YbbH |
| Contig1 | 1994582 | 1995529 | − | GENE_01896 | Prodigal: 2.6 | CDS | 5.3.1.8 | — | — | — | P39841 | yvyI_1 | — | — | Putative mannose-6-phosphate isomerase YvyI |
| Contig1 | 1995544 | 1997502 | − | GENE_01897 | Prodigal: 2.6 | CDS | — | — | — | — | O31645 | manP | — | — | PTS system mannose-specific EIIBCA component |
| Contig1 | 1997655 | 1999607 | − | GENE_01898 | Prodigal: 2.6 | CDS | — | — | — | — | P46321 | licR_1 | — | — | putative licABCH operon regulator |
| Contig1 | 1999835 | 2000752 | − | GENE_01899 | Prodigal: 2.6 | CDS | — | PRK00685 | — | — | — | — | — | — | metal-dependent hydrolase |
| Contig1 | 2000799 | 2001281 | − | GENE_01900 | Prodigal: 2.6 | CDS | 4.2.-.- | — | — | — | P45202 | ybaK | — | — | Cys-tRNA(Pro)/Cys-tRNA(Cys) deacylase YbaK |
| Contig1 | 2001349 | 2002233 | − | GENE_01901 | Prodigal: 2.6 | CDS | — | — | — | — | P20668 | gltC_2 | — | — | HTH-type transcriptional regulator GltC |
| Contig1 | 2002358 | 2003566 | + | GENE_01902 | Prodigal: 2.6 | CDS | — | — | — | — | P43531 | ynfM_2 | — | — | Inner membrane transport protein YnfM |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2003716 | 2006877 | − | GENE_01903 | Prodigal: 2.6 | CDS | — | — | — | — | O08336 | cypE | — | — | putative bifunctional P-450/NADPH-P450 reductase 2 |
| Contig1 | 2006905 | 2007471 | − | GENE_01904 | Prodigal: 2.6 | CDS | — | — | — | — | P43506 | bm3R1_3 | — | — | HTH-type transcriptional repressor Bm3R1 |
| Contig1 | 2007681 | 2008220 | − | GENE_01905 | Prodigal: 2.6 | CDS | 2.1.1.- | — | — | — | O05400 | yrhH | — | — | Putative methyltransferase YrhH |
| Contig1 | 2008722 | 2008862 | − | GENE_01906 | Prodigal: 2.6 | CDS | — | — | PF09501.4 | — | — | — | — | — | putative sporulation protein (Bac_small_yrzI) |
| Contig1 | 2009252 | 2010052 | − | GENE_01907 | Prodigal: 2.6 | CDS | — | — | — | — | P0AC23 | focA | — | — | putative formate transporter 1 |
| Contig1 | 2010317 | 2010685 | − | GENE_01908 | Prodigal: 2.6 | CDS | — | — | — | — | — | — | — | — | hypothetical protein |
| Contig1 | 2010946 | 2013933 | + | GENE_01909 | Prodigal: 2.6 | CDS | 1.2.1.2 | — | — | — | Q99RW4 | — | — | — | Putative formate dehydrogenase |
| Contig1 | 2013951 | 2014442 | + | GENE_01910 | Prodigal: 2.6 | CDS | — | — | — | — | — | — | — | — | hypothetical protein |
| Contig1 | 2014481 | 2014711 | + | GENE_01911 | Prodigal: 2.6 | CDS | — | — | — | — | — | — | — | — | hypothetical protein |
| Contig1 | 2014795 | 2015937 | − | GENE_01912 | Prodigal: 2.6 | CDS | 4.4.1.1 | — | — | — | O05394 | mccB | — | — | Cystathionine gamma-lyase |
| Contig1 | 2015939 | 2016862 | − | GENE_01913 | Prodigal: 2.6 | CDS | 4.2.1.- | — | — | — | O05393 | mccA | — | — | O-acetylserine dependent cystathionine beta-synthase |
| Contig1 | 2016910 | 2017605 | − | GENE_01914 | Prodigal: 2.6 | CDS | 3.2.2.9 | — | — | — | Q9KPI8 | mtnN | — | — | 5′-methylthioadenosine/S-adenosylhomocysteine nucleosidase |
| Contig1 | 2017626 | 2018267 | − | GENE_01915 | Prodigal: 2.6 | CDS | 2.1.1.- | — | — | — | O32029 | yrrT | — | — | putative methyltransferase YrrT |
| Contig1 | 2018451 | 2018654 | + | GENE_01916 | Prodigal: 2.6 | CDS | — | — | — | — | — | — | — | — | hypothetical protein |
| Contig1 | 2018694 | 2019410 | − | GENE_01917 | Prodigal: 2.6 | CDS | — | — | — | — | — | — | — | — | hypothetical protein |
| Contig1 | 2019474 | 2020397 | − | GENE_01918 | Prodigal: 2.6 | CDS | — | — | — | — | O32032 | pbpI_1 | — | — | Penicillin-binding protein 4B |
| Contig1 | 2020424 | 2021227 | − | GENE_01919 | Prodigal: 2.6 | CDS | — | — | — | — | O32032 | pbpI_2 | — | — | Penicillin-binding protein 4B |
| Contig1 | 2021280 | 2021753 | − | GENE_01920 | Prodigal: 2.6 | CDS | — | — | — | — | P80240 | greA | — | — | Transcription elongation factor GreA |
| Contig1 | 2022007 | 2022642 | − | GENE_01921 | Prodigal: 2.6 | CDS | 2.7.1.48 | — | — | — | P67411 | udk | — | — | Uridine kinase |
| Contig1 | 2022649 | 2023917 | − | GENE_01922 | Prodigal: 2.6 | CDS | 3.4.-.- | — | — | — | P45527 | yhbU_1 | — | — | putative protease YhbU precursor |
| Contig1 | 2023935 | 2024864 | − | GENE_01923 | Prodigal: 2.6 | CDS | 3.4.-.- | — | — | — | P45527 | yhbU_2 | — | — | putative protease YhbU precursor |
| Contig1 | 2024871 | 2025524 | − | GENE_01924 | Prodigal: 2.6 | CDS | 2.1.1.- | — | — | — | Q05632 | cbiT | — | — | putative cobalt-precorrin-6Y C(15)-methyltransferase [decarboxylating] |
| Contig1 | 2025676 | 2026767 | − | GENE_01925 | Prodigal: 2.6 | CDS | — | PRK10270 | — | — | — | — | — | — | putative aminodeoxy-chorismate lyase |
| Contig1 | 2026878 | 2027159 | − | GENE_01926 | Prodigal: 2.6 | CDS | — | — | — | — | — | — | — | — | hypothetical protein |
| Contig1 | 2027172 | 2027588 | − | GENE_01927 | Prodigal: 2.6 | CDS | 3.1.-.- | — | — | — | O34634 | yrrK | — | — | Putative Holliday junction resolvase |
| Contig1 | 2027597 | 2027863 | − | GENE_01928 | Prodigal: 2.6 | CDS | — | PRK05473 | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2027948 | 2030584 | – | GENE_01929 | Prodigal: 2.6 | CDS | 6.1.1.7 | — | — | — | P67011 | alaS | — | — | Alanine--tRNA ligase |
| Contig1 | 2030916 | 2031977 | – | GENE_01930 | Prodigal: 2.6 | CDS | — | — | — | — | P0AFS5 | tqsA | — | — | AI-2 transport protein TqsA |
| Contig1 | 2032197 | 2032925 | + | GENE_01931 | Prodigal: 2.6 | CDS | 3.6.3.- | — | — | — | O34677 | glnQ | — | — | Glutamine transport ATP-binding protein GlnQ |
| Contig1 | 2032946 | 2033773 | + | GENE_01932 | Prodigal: 2.6 | CDS | — | — | — | — | O34563 | glnH | — | — | ABC transporter glutamine-binding protein GlnH precursor |
| Contig1 | 2033830 | 2034480 | + | GENE_01933 | Prodigal: 2.6 | CDS | — | — | — | — | O34671 | glnM | — | — | putative glutamine ABC transporter permease protein GlnM |
| Contig1 | 2034499 | 2035155 | + | GENE_01934 | Prodigal: 2.6 | CDS | — | — | — | — | O34606 | glnP | — | — | putative glutamine ABC transporter permease protein GlnP |
| Contig1 | 2035191 | 2035322 | – | GENE_01935 | Prodigal: 2.6 | CDS | — | — | — | — | — | — | — | — | hypothetical protein |
| Contig1 | 2035344 | 2035535 | – | GENE_01936 | Prodigal: 2.6 | CDS | — | — | — | — | — | — | — | — | hypothetical protein |
| Contig1 | 2035548 | 2036006 | – | GENE_01937 | Prodigal: 2.6 | CDS | — | — | PF05239.10 | — | — | — | — | — | PRC-barrel domain protein |
| Contig1 | 2036125 | 2038503 | – | GENE_01938 | Prodigal: 2.6 | CDS | 3.6.4.12 | — | — | — | Q9RT63 | recD2 | — | — | ATP-dependent RecD-like DNA helicase |
| Contig1 | 2038522 | 2039172 | – | GENE_01939 | Prodigal: 2.6 | CDS | — | — | — | — | O34452 | yrrB | — | — | TPR repeat-containing protein YrrB |
| Contig1 | 2039230 | 2040345 | – | GENE_01940 | Prodigal: 2.6 | CDS | 2.8.1.- | — | — | — | Q99TM8 | mnmA | — | — | tRNA-specific 2-thiouridylase MnmA |
| Contig1 | 2040382 | 2041521 | – | GENE_01941 | Prodigal: 2.6 | CDS | 2.8.1.7 | — | — | — | P0A6B7 | iscS_1 | — | — | Cysteine desulfurase |
| Contig1 | 2041540 | 2041917 | + | GENE_01942 | Prodigal: 2.6 | CDS | — | — | — | — | O34527 | cymR | — | — | HTH-type transcriptional regulator CymR |
| Contig1 | 2042151 | 2043419 | + | GENE_01943 | Prodigal: 2.6 | CDS | — | — | — | — | P0AAZ4 | rarA | — | — | Replication-associated recombination protein A |
| Contig1 | 2043495 | 2044259 | – | GENE_01944 | Prodigal: 2.6 | CDS | 6.1.-.- | — | — | — | Q46927 | tcdA | — | — | tRNA threonyl-carbamoyladenosine dehydratase |
| Contig1 | 2044586 | 2046364 | – | GENE_01945 | Prodigal: 2.6 | CDS | 6.1.1.12 | — | — | — | P67015 | aspS | — | — | Aspartate--tRNA ligase |
| Contig1 | 2046379 | 2047653 | – | GENE_01946 | Prodigal: 2.6 | CDS | 6.1.1.21 | — | — | — | P60911 | hisS | — | — | Histidine--tRNA ligase |
| Contig1 | 2047750 | 2047917 | – | GENE_01947 | Prodigal: 2.6 | CDS | — | — | — | — | — | — | — | — | hypothetical protein |
| Contig1 | 2048010 | 2048180 | – | GENE_01948 | Prodigal: 2.6 | CDS | — | — | — | — | — | — | — | — | hypothetical protein |
| Contig1 | 2048311 | 2049873 | + | GENE_01949 | Prodigal: 2.6 | CDS | 3.5.1.28 | — | — | — | Q02114 | lytc_2 | — | — | N-acetylmuramoyl-L-alanine amidase LytC precursor |
| Contig1 | 2049901 | 2050344 | – | GENE_01950 | Prodigal: 2.6 | CDS | 3.1.-.- | — | — | — | O66742 | dtd | — | — | D-tyrosyl-tRNA(Tyr) deacylase |
| Contig1 | 2050357 | 2052561 | – | GENE_01951 | Prodigal: 2.6 | CDS | 27.6.5 | — | — | — | Q99TL8 | relA | — | — | GTP pyrophosphokinase |
| Contig1 | 2052719 | 2053231 | – | GENE_01952 | Prodigal: 2.6 | CDS | 2.4.2.7 | — | — | — | P68779 | apt | — | — | Adenine phosphoribosyltransferase |
| Contig1 | 2053237 | 2055597 | – | GENE_01953 | Prodigal: 2.6 | CDS | 3.1.-.- | — | — | — | P21893 | recJ | — | — | Single-stranded-DNA-specific exonuclease RecJ |
| Contig1 | 2055653 | 2055979 | – | GENE_01954 | Prodigal: 2.6 | CDS | — | — | — | — | — | — | — | — | hypothetical protein |
| Contig1 | 2056043 | 2056540 | – | GENE_01955 | Prodigal: 2.6 | CDS | — | — | — | — | O07535 | khtT_2 | — | — | K(+)/H(+) antiporter subunit KhtT |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2056672 | 2058891 | − | GENE_01956 | Prodigal: 2.6 | CDS | — | — | — | MF_01463_B | — | secD | — | — | Protein translocase subunit SecD |
| Contig1 | 2058928 | 2059224 | − | GENE_01957 | Prodigal: 2.6 | CDS | — | — | — | — | O32049 | comN | — | — | Post-transcriptional regulator ComN |
| Contig1 | 2059340 | 2059582 | + | GENE_01958 | Prodigal: 2.6 | CDS | — | — | — | — | Q00758 | spoVB_1 | — | — | Stage V sporulation protein B |
| Contig1 | 2059579 | 2060895 | + | GENE_01959 | Prodigal: 2.6 | CDS | — | — | — | — | Q00758 | spoVB_2 | — | — | Stage V sporulation protein B |
| Contig1 | 2060903 | 2061559 | − | GENE_01960 | Prodigal: 2.6 | CDS | — | — | — | — | — | — | — | — | hypothetical protein |
| Contig1 | 2061726 | 2062112 | + | GENE_01961 | Prodigal: 2.6 | CDS | — | — | — | — | — | — | — | — | hypothetical protein |
| Contig1 | 2062164 | 2062424 | − | GENE_01962 | Prodigal: 2.6 | CDS | — | PRK05585 | — | — | — | — | — | — | preprotein translocase subunit YajC |
| Contig1 | 2062455 | 2063600 | − | GENE_01963 | Prodigal: 2.6 | CDS | 2.4.2.29 | — | — | — | P66905 | tgt | — | — | Queuine tRNA-ribosyltransferase |
| Contig1 | 2063628 | 2064656 | − | GENE_01964 | Prodigal: 2.6 | CDS | 2.4.99.17 | — | — | — | O32054 | queA | — | — | S-adenosyl-methionine:tRNA ribosyltransferase-isomerase |
| Contig1 | 2064682 | 2064882 | − | GENE_01965 | Prodigal: 2.6 | CDS | — | — | — | — | — | — | — | — | hypothetical protein |
| Contig1 | 2064875 | 2065879 | − | GENE_01966 | Prodigal: 2.6 | CDS | 3.6.4.12 | — | — | — | O32055 | ruvB | — | — | Holliday junction ATP-dependent DNA helicase RuvB |
| Contig1 | 2065890 | 2066495 | − | GENE_01967 | Prodigal: 2.6 | CDS | 3.6.4.12 | — | — | — | P66748 | ruvA | — | — | Holliday junction ATP-dependent DNA helicase RuvA |
| Contig1 | 2066630 | 2067139 | − | GENE_01968 | Prodigal: 2.6 | CDS | — | — | PF08955.4 | — | — | — | — | BofC C-terminal domain | hypothetical protein |
| Contig1 | 2067271 | 2067390 | − | GENE_01969 | Prodigal: 2.6 | CDS | — | — | — | — | — | — | — | — | hypothetical protein |
| Contig1 | 2067541 | 2068116 | − | GENE_01970 | Prodigal: 2.6 | CDS | — | — | — | — | P94446 | coxA | — | — | Sporulation cortex protein CoxA precursor |
| Contig1 | 2068264 | 2069469 | − | GENE_01971 | Prodigal: 2.6 | CDS | — | — | — | — | O32062 | safA | — | — | SpoIVD-associated factor A |
| Contig1 | 2069596 | 2070699 | − | GENE_01972 | Prodigal: 2.6 | CDS | 2.5.1.72 | — | — | — | P11458 | nadA | — | — | Quinolinate synthase A |
| Contig1 | 2070701 | 2071549 | − | GENE_01973 | Prodigal: 2.6 | CDS | 2.4.2.19 | PRK04435 | — | — | P39666 | nadC | — | — | putative nicotinate-nucleotide pyrophosphorylase [carboxylating] |
| Contig1 | 2071531 | 2073096 | − | GENE_01974 | Prodigal: 2.6 | CDS | 1.4.3.16 | — | — | — | P10902 | nadB | — | — | L-aspartate oxidase |
| Contig1 | 2073202 | 2074353 | + | GENE_01975 | Prodigal: 2.6 | CDS | 2.8.1.7 | — | — | — | P38033 | nifS | — | — | Putative cysteine desulfurase NifS |
| Contig1 | 2074350 | 2074892 | + | GENE_01976 | Prodigal: 2.6 | CDS | — | — | — | — | P39667 | nadR | — | — | Transcription repressor NadR |
| Contig1 | 2074918 | 2075775 | − | GENE_01977 | Prodigal: 2.6 | CDS | — | — | — | — | P0A9J8 | pheA | — | — | P-protein |
| Contig1 | 2075789 | 2076232 | − | GENE_01978 | Prodigal: 2.6 | CDS | — | — | — | — | — | — | — | — | hypothetical protein |
| Contig1 | 2076286 | 2077572 | − | GENE_01979 | Prodigal: 2.6 | CDS | — | — | — | — | P20964 | obg | — | — | GTPase ObgE |
| Contig1 | 2077604 | 2078182 | − | GENE_01980 | Prodigal: 2.6 | CDS | 2.7.-.- | — | — | — | P06535 | spo0B | — | — | Sporulation initiation phosphotransferase B |
| Contig1 | 2078500 | 2078784 | − | GENE_01981 | Prodigal: 2.6 | CDS | — | — | — | — | P66133 | rpmA | — | — | 50S ribosomal protein L27 |

TABLE 5-continued

| #ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2078797 | 2079138 | – | GENE_01982 | Prodigal: 2.6 | CDS | — | — | — | — | — | — | — | — | hypothetical protein |
| Contig1 | 2079141 | 2079449 | – | GENE_01983 | Prodigal: 2.6 | CDS | — | — | — | — | P26908 | rplU | — | — | 50S ribosomal protein L21 |
| Contig1 | 2079595 | 2080461 | – | GENE_01984 | Prodigal: 2.6 | CDS | 3.4.24.- | — | — | — | P26937 | spoIVFB | — | — | Stage IV sporulation protein FB |
| Contig1 | 2080454 | 2081257 | – | GENE_01985 | Prodigal: 2.6 | CDS | — | — | — | — | P26936 | spoIVFA | — | — | Stage IV sporulation protein FA |
| Contig1 | 2081385 | 2082188 | – | GENE_01986 | Prodigal: 2.6 | CDS | — | — | — | — | Q01464 | minD_1 | — | — | Septum site-determining protein MinD |
| Contig1 | 2082191 | 2082871 | – | GENE_01987 | Prodigal: 2.6 | CDS | — | — | — | — | Q01463 | minC | — | — | Septum site-determining protein MinC |
| Contig1 | 2082925 | 2083443 | – | GENE_01988 | Prodigal: 2.6 | CDS | — | — | — | — | Q01467 | mreD | — | — | Rod shape-determining protein MreD |
| Contig1 | 2083440 | 2084303 | – | GENE_01989 | Prodigal: 2.6 | CDS | — | — | — | — | Q01466 | mreC | — | — | Cell shape-determining protein MreC precursor |
| Contig1 | 2084334 | 2085347 | – | GENE_01990 | Prodigal: 2.6 | CDS | — | — | — | — | P0A9X4 | mreB_2 | — | — | Rod shape-determining protein MreB |
| Contig1 | 2085439 | 2086134 | – | GENE_01991 | Prodigal: 2.6 | CDS | — | PRK00024 | — | — | — | — | — | — | hypothetical protein |
| Contig1 | 2086166 | 2086735 | – | GENE_01992 | Prodigal: 2.6 | CDS | — | — | — | — | Q02169 | maf | — | — | Septum formation protein Maf |
| Contig1 | 2086876 | 2087877 | – | GENE_01993 | Prodigal: 2.6 | CDS | — | — | — | — | P37575 | spoIIB | — | — | Stage II sporulation protein B |
| Contig1 | 2088004 | 2088756 | – | GENE_01994 | Prodigal: 2.6 | CDS | — | — | — | — | P15378 | comC | — | — | Type 4 prepilin-like proteins leader peptide-processing enzyme |
| Contig1 | 2088896 | 2090188 | – | GENE_01995 | Prodigal: 2.6 | CDS | 6.3.2.17 | — | — | — | P15925 | fgs | — | — | Folylpolyglutamate synthase |
| Contig1 | 2090247 | 2092889 | – | GENE_01996 | Prodigal: 2.6 | CDS | 6.1.1.9 | — | — | — | Q05873 | valS | — | — | Valine--tRNA ligase |
| Contig1 | 2093342 | 2093533 | + | GENE_01997 | Prodigal: 2.6 | CDS | — | — | — | — | — | — | — | — | hypothetical protein |
| Contig1 | 2093548 | 2094582 | – | GENE_01998 | Prodigal: 2.6 | CDS | — | — | — | — | — | — | — | — | hypothetical protein |
| Contig1 | 2094604 | 2096592 | – | GENE_01999 | Prodigal: 2.6 | CDS | — | — | — | — | P37963 | spoVID | — | — | Stage VI sporulation protein D |
| Contig1 | 2096725 | 2098014 | – | GENE_02000 | Prodigal: 2.6 | CDS | 5.4.3.8 | — | — | — | P30949 | hemL | — | — | Glutamate-1-semialdehyde 2,1-aminomutase |
| Contig1 | 2098043 | 2099020 | – | GENE_02001 | Prodigal: 2.6 | CDS | 4.2.1.24 | — | — | — | P64334 | hemB | — | — | Delta-aminolevulinic acid dehydratase |
| Contig1 | 2099020 | 2099802 | – | GENE_02002 | Prodigal: 2.6 | CDS | — | PRK05928 | — | — | — | — | — | — | uroporphyrinogen-III synthase |
| Contig1 | 2099792 | 2100733 | – | GENE_02003 | Prodigal: 2.6 | CDS | 2.5.1.61 | — | — | — | P64341 | hemC | — | — | Porphobilinogen deaminase |
| Contig1 | 2100768 | 2101598 | – | GENE_02004 | Prodigal: 2.6 | CDS | — | — | — | — | P72978 | ccsA_2 | — | — | Cytochrome c biogenesis protein CcsA |
| Contig1 | 2101606 | 2102973 | – | GENE_02005 | Prodigal: 2.6 | CDS | 1.2.1.70 | — | — | — | P16618 | hemA | — | — | Glutamyl-tRNA reductase |
| Contig1 | 2103168 | 2103659 | + | GENE_02006 | Prodigal: 2.6 | CDS | — | — | — | — | — | — | — | — | hypothetical protein |
| Contig1 | 2103692 | 2104279 | – | GENE_02007 | Prodigal: 2.6 | CDS | — | — | — | — | P38424 | engB | — | — | putative GTP-binding protein EngB |
| Contig1 | 2104276 | 2106600 | – | GENE_02008 | Prodigal: 2.6 | CDS | 3.4.21.53 | — | — | — | P37945 | lon1 | — | — | Lon protease 1 |
| Contig1 | 2106800 | 2108458 | – | GENE_02009 | Prodigal: 2.6 | CDS | 3.4.21.53 | — | — | — | P42425 | lon2 | — | — | Lon protease 2 |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2108608 | 2109870 | − | GENE_02010 | Prodigal: 2.6 | CDS | — | — | — | — | P50866 | clpX | — | — | ATP-dependent Clp protease ATP-binding subunit ClpX |
| Contig1 | 2110142 | 2111416 | − | GENE_02011 | Prodigal: 2.6 | CDS | 5.2.1.8 | — | — | — | P80698 | tig | — | — | Trigger factor |
| Contig1 | 2111633 | 2112637 | − | GENE_02012 | Prodigal: 2.6 | CDS | — | — | PF07719.11 | — | — | — | — | — | Tetratricopeptide repeat protein |
| Contig1 | 2112755 | 2113354 | − | GENE_02013 | Prodigal: 2.6 | CDS | 4.2.1.33 | — | — | — | A5E8Z8 | leuD | — | — | 3-isopropylmalate dehydratase small subunit |
| Contig1 | 2113370 | 2114788 | − | GENE_02014 | Prodigal: 2.6 | CDS | 4.2.1.33 | — | — | — | P80858 | leuC | — | — | 3-isopropylmalate dehydratase large subunit |
| Contig1 | 2114834 | 2115931 | − | GENE_02015 | Prodigal: 2.6 | CDS | 1.1.1.85 | — | — | — | P12010 | leuB | — | — | 3-isopropylmalate dehydrogenase |
| Contig1 | 2115952 | 2117508 | − | GENE_02016 | Prodigal: 2.6 | CDS | 2.3.3.13 | — | — | — | Q71Y35 | leuA | — | — | 2-isopropylmalate synthase |
| Contig1 | 2117495 | 2118523 | − | GENE_02017 | Prodigal: 2.6 | CDS | 1.1.1.86 | — | — | — | P37253 | ilvC | — | — | Ketol-acid reductoisomerase |
| Contig1 | 2118546 | 2119064 | − | GENE_02018 | Prodigal: 2.6 | CDS | 2.2.1.6 | — | — | — | P65161 | ilvH | — | — | Putative acetolactate synthase small subunit |
| Contig1 | 2119061 | 2119411 | − | GENE_02019 | Prodigal: 2.6 | CDS | 2.2.1.6 | — | — | — | P37251 | ilvB_1 | — | — | Acetolactate synthase large subunit |
| Contig1 | 2119408 | 2120535 | − | GENE_02020 | Prodigal: 2.6 | CDS | 2.2.1.6 | — | — | — | P37251 | ilvB_2 | — | — | Acetolactate synthase large subunit |
| Contig1 | 2120532 | 2120783 | − | GENE_02021 | Prodigal: 2.6 | CDS | 2.2.1.6 | — | — | — | P37251 | ilvB_3 | — | — | Acetolactate synthase large subunit |
| Contig1 | 2121577 | 2121927 | + | GENE_02022 | Prodigal: 2.6 | CDS | — | — | — | — | — | — | — | — | hypothetical protein |
| Contig1 | 2121967 | 2122152 | − | GENE_02023 | Prodigal: 2.6 | CDS | — | — | — | — | — | — | — | — | hypothetical protein |
| Contig1 | 2122402 | 2122477 | − | GENE_02024 | Aragorn: 1.2 | tRNA | — | — | — | — | — | — | — | — | tRNA-Arg(tct) |
| Contig1 | 2122598 | 2122673 | − | GENE_02025 | Aragorn: 1.2 | tRNA | — | — | — | — | — | — | — | — | tRNA-Arg(tct) |
| Contig1 | 2122786 | 2123295 | − | GENE_02026 | Prodigal: 2.6 | CDS | — | — | — | — | P75349 | — | — | Putative metallo-phosphoesterase MG207 homolog | hypothetical protein |
| Contig1 | 2123311 | 2123898 | − | GENE_02027 | Prodigal: 2.6 | CDS | 3.6.1.19 | — | — | — | P99094 | — | — | — | Non-canonical purine NTP |
| Contig1 | 2123919 | 2124656 | − | GENE_02028 | Prodigal: 2.6 | CDS | 2.7.7.56 | — | — | — | P28619 | rph | — | — | Ribonuclease PH |
| Contig1 | 2124766 | 2125851 | − | GENE_02029 | Prodigal: 2.6 | CDS | — | — | — | — | P39072 | germ | — | — | Spore germination protein GerM |
| Contig1 | 2125957 | 2126772 | − | GENE_02030 | Prodigal: 2.6 | CDS | 5.1.1.3 | — | — | — | P94556 | racE | — | — | Glutamate racemase 1 |
| Contig1 | 2126783 | 2127223 | − | GENE_02031 | Prodigal: 2.6 | CDS | — | — | — | — | O32181 | yusO_4 | — | — | putative HTH-type transcriptional regulator YusO |
| Contig1 | 2127410 | 2127634 | − | GENE_02032 | Prodigal: 2.6 | CDS | — | — | — | — | P11470 | gerE | — | — | Spore germination protein GerE |
| Contig1 | 2127755 | 2128192 | − | GENE_02033 | Prodigal: 2.6 | CDS | — | — | PF03061.16 | — | — | — | — | — | Thioesterase superfamily protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2128252 | 2129010 | − | GENE_02034 | Prodigal: 2.6 | CDS | 1.3.99.1 | — | — | — | P17596 | frdB | — | — | Fumarate reductase iron-sulfur subunit |
| Contig1 | 2129013 | 2130773 | − | GENE_02035 | Prodigal: 2.6 | CDS | 1.3.5.4 | — | — | — | P00363 | frdA | — | — | Fumarate reductase flavoprotein subunit |
| Contig1 | 2130807 | 2131415 | − | GENE_02036 | Prodigal: 2.6 | CDS | — | — | — | — | P08064 | sdhC | — | — | Succinate dehydrogenase cytochrome b558 subunit |
| Contig1 | 2131711 | 2132157 | + | GENE_02037 | Prodigal: 2.6 | CDS | — | — | — | — | — | — | — | — | hypothetical protein |
| Contig1 | 2132204 | 2133433 | − | GENE_02038 | Prodigal: 2.6 | CDS | 2.7.2.4 | — | — | — | P08495 | lysC_2 | — | — | Aspartokinase 2 |
| Contig1 | 2133800 | 21355 | − | GENE_02039 | Prodigal: 2.6 | CDS | — | — | — | — | Q5KWH6 | uvrC_1 | — | — | UvrABC system protein C |
| Contig1 | 2135716 | 2136030 | − | GENE_02040 | Prodigal: 2.6 | CDS | — | — | — | — | P14949 | trxA_1 | — | — | Thioredoxin |
| Contig1 | 2136183 | 2137673 | − | GENE_02041 | Prodigal: 2.6 | CDS | 3.2.1.55 | — | — | — | P94552 | abf2 | — | — | Intracellular exo-alpha-L-arabinofuranosidase 2 |
| Contig1 | 2137882 | 2138859 | − | GENE_02042 | Prodigal: 2.6 | CDS | — | — | — | — | G3KIM6 | acrA | — | — | Acryloyl-CoA reductase electron transfer subunit beta |
| Contig1 | 2138891 | 2139664 | − | GENE_02043 | Prodigal: 2.6 | CDS | — | — | — | — | P38975 | etfB | — | — | Electron transfer flavoprotein subunit beta |
| Contig1 | 2139678 | 2140457 | − | GENE_02044 | Prodigal: 2.6 | CDS | 4.2.1.17 | — | — | — | P94549 | fadB | — | — | putative enoyl-CoA hydratase |
| Contig1 | 2140471 | 2141061 | − | GENE_02045 | Prodigal: 2.6 | CDS | — | — | — | — | P94548 | fadR | — | — | Fatty acid metabolism regulator protein |
| Contig1 | 2141144 | 2142832 | − | GENE_02046 | Prodigal: 2.6 | CDS | 6.2.1.3 | — | — | — | P69451 | fadD | — | — | Long-chain-fatty-acid-CoA ligase |
| Contig1 | 2142938 | 2143612 | + | GENE_02047 | Prodigal: 2.6 | CDS | — | — | — | — | — | — | — | — | hypothetical protein |
| Contig1 | 2143752 | 2144156 | − | GENE_02048 | Prodigal: 2.6 | CDS | — | — | — | — | — | — | — | — | hypothetical protein |
| Contig1 | 2144173 | 2146530 | − | GENE_02049 | Prodigal: 2.6 | CDS | 3.1.-.- | — | — | — | P65496 | mutS2 | — | — | Endonuclease MutS2 |
| Contig1 | 2146551 | 2148299 | − | GENE_02050 | Prodigal: 2.6 | CDS | — | — | — | — | P94544 | polX | — | — | DNA polymerase/3′-5′ exonuclease PolX |
| Contig1 | 2148369 | 2148902 | − | GENE_02051 | Prodigal: 2.6 | CDS | — | — | PF02674.10 | — | — | — | — | — | Colicin V production protein |
| Contig1 | 2148910 | 2149167 | − | GENE_02052 | Prodigal: 2.6 | CDS | — | — | — | — | P94542 | zapA | — | — | Cell division protein ZapA |
| Contig1 | 2149301 | 2150242 | + | GENE_02053 | Prodigal: 2.6 | CDS | 3.1.26.4 | — | — | — | P94541 | rnhC | — | — | Ribonuclease HIII |
| Contig1 | 2150280 | 2152694 | − | GENE_02054 | Prodigal: 2.6 | CDS | 6.1.1.20 | — | — | — | Q4L5E4 | pheT_1 | — | — | Phenylalanine tRNA ligase beta subunit |
| Contig1 | 2152708 | 2153742 | − | GENE_02055 | Prodigal: 2.6 | CDS | 6.1.1.20 | — | — | — | Q4L5E3 | pheS | — | — | Phenylalanine tRNA ligase alpha subunit |
| Contig1 | 2154104 | 2154850 | − | GENE_02056 | Prodigal: 2.6 | CDS | 2.1.1.- | — | — | — | Q7A794 | — | — | — | Putative TrmH family tRNA/rRNA methyltransferase |
| Contig1 | 2154971 | 2155186 | + | GENE_02057 | Prodigal: 2.6 | CDS | — | — | — | — | P94537 | sspI | — | — | Small, acid-soluble spore protein I |
| Contig1 | 2155248 | 2156333 | + | GENE_02058 | Prodigal: 2.6 | CDS | — | — | — | — | P37047 | cdaR_1 | — | — | Carbohydrate diacid regulator |
| Contig1 | 2156433 | 2157845 | + | GENE_02059 | Prodigal: 2.6 | CDS | 1.-.-.- | — | — | — | Q50685 | — | — | — | putative FAD-linked oxidoreductase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2157842 | 2159170 | + | GENE_02060 | Prodigal: 2.6 | CDS | — | — | — | — | O07020 | lutA_1 | — | — | Lactate utilization protein A |
| Contig1 | 2159240 | 2161036 | − | GENE_02061 | Prodigal: 2.6 | CDS | — | — | — | — | P15078 | cstA | — | — | Carbon starvation protein A |
| Contig1 | 2161149 | 2162648 | − | GENE_02062 | Prodigal: 2.6 | CDS | 3.2.1.55 | — | — | — | P94531 | abfA | — | — | Intracellular exo-alpha-(1->5)-L-arabinofuranosidase 1 |
| Contig1 | 2162667 | 2163509 | − | GENE_02063 | Prodigal: 2.6 | CDS | — | — | — | — | P94530 | araQ_1 | — | — | L-arabinose transport system permease protein AraQ |
| Contig1 | 2163513 | 2164454 | − | GENE_02064 | Prodigal: 2.6 | CDS | — | — | — | — | P94529 | araP_1 | — | — | L-arabinose transport system permease protein AraP |
| Contig1 | 2164496 | 2165791 | − | GENE_02065 | Prodigal: 2.6 | CDS | — | — | — | — | P94528 | araN | — | — | putative arabinose-binding protein precursor |
| Contig1 | 2165823 | 2167007 | − | GENE_02066 | Prodigal: 2.6 | CDS | 1.1.1.261 | — | — | — | P94527 | egsA | — | — | Glycerol-1-phosphate dehydrogenase [NAD(P)+] |
| Contig1 | 2167004 | 2167843 | − | GENE_02067 | Prodigal: 2.6 | CDS | — | — | — | — | P94526 | araL | — | — | Arabinose operon protein AraL |
| Contig1 | 2167788 | 2168477 | − | GENE_02068 | Prodigal: 2.6 | CDS | 5.1.3.4 | — | — | — | P94525 | araD | — | — | L-ribulose-5-phosphate 4-epimerase |
| Contig1 | 2168470 | 2170188 | − | GENE_02069 | Prodigal: 2.6 | CDS | 2.7.1.16 | — | — | — | P94524 | araB_1 | — | — | Ribulokinase |
| Contig1 | 2170157 | 2171656 | − | GENE_02070 | Prodigal: 2.6 | CDS | 5.3.1.4 | — | — | — | P94523 | araA | — | — | L-arabinose isomerase |
| Contig1 | 2171835 | 2172800 | − | GENE_02071 | Prodigal: 2.6 | CDS | 3.2.1.99 | — | — | — | P94522 | abnA | — | — | Extracellular endo-alpha-(1->5)-L-arabinanase 1 precursor |
| Contig1 | 2172944 | 2174029 | − | GENE_02072 | Prodigal: 2.6 | CDS | 3.4.11.- | — | — | — | P94521 | ysdC_2 | — | — | Putative aminopeptidase YsdC |
| Contig1 | 2174213 | 2174605 | + | GENE_02073 | Prodigal: 2.6 | CDS | — | — | — | — | P94520 | ysdB | — | — | Sigma-w pathway protein YsdB |
| Contig1 | 2174619 | 2174885 | − | GENE_02074 | Prodigal: 2.6 | CDS | — | — | — | — | — | — | — | — | hypothetical protein |
| Contig1 | 2174943 | 2175302 | − | GENE_02075 | Prodigal: 2.6 | CDS | — | — | — | — | P55873 | rplT | — | — | 50S ribosomal protein L20 |
| Contig1 | 2175334 | 2175534 | − | GENE_02076 | Prodigal: 2.6 | CDS | — | — | — | — | P75447 | rpmI | — | — | 50S ribosomal protein L35 |
| Contig1 | 2175547 | 2176050 | − | GENE_02077 | Prodigal: 2.6 | CDS | — | — | — | — | P03000 | infC | — | — | Translation initiation factor IF-3 |
| Contig1 | 2176439 | 2177122 | − | GENE_02078 | Prodigal: 2.6 | CDS | — | — | — | — | P60643 | lrgB | — | — | Antiholin-like protein LrgB |
| Contig1 | 2177135 | 2177575 | − | GENE_02079 | Prodigal: 2.6 | CDS | — | — | — | — | P72358 | lrgA | — | — | Antiholin-like protein LrgA |
| Contig1 | 2177705 | 2178439 | − | GENE_02080 | Prodigal: 2.6 | CDS | — | — | — | — | P60611 | lytR_1 | — | — | Sensory transduction protein LytR |
| Contig1 | 2178417 | 2180198 | − | GENE_02081 | Prodigal: 2.6 | CDS | 2.7.13.3 | — | — | — | P0AA93 | ypdA | — | — | Sensor histidine kinase YpdA |
| Contig1 | 2180383 | 2181177 | + | GENE_02082 | Prodigal: 2.6 | CDS | 3.1.3.5 | — | — | — | P0A8Y1 | yjjG | — | — | Pyrimidine 5'-nucleotidase YjjG |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2181231 | 2183162 | − | GENE_02083 | Prodigal: 2.6 | CDS | 6.1.1.3 | — | — | — | P18255 | thrS | — | — | Threonine--tRNA ligase 1 |
| Contig1 | 2183572 | 2184402 | − | GENE_02084 | Prodigal: 2.6 | CDS | — | — | PF08812.5 | — | — | — | — | — | YtxC-like family protein |
| Contig1 | 2184467 | 2185108 | − | GENE_02085 | Prodigal: 2.6 | CDS | — | — | — | — | P76221 | ydjZ_3 | — | — | TVP38/TMEM64 family inner membrane protein YdjZ |
| Contig1 | 2185140 | 2186075 | − | GENE_02086 | Prodigal: 2.6 | CDS | — | — | — | — | P06567 | dnaI | — | — | Primosomal protein DnaI |
| Contig1 | 2186100 | 2187506 | − | GENE_02087 | Prodigal: 2.6 | CDS | — | — | — | — | P07908 | dnaB | — | — | Replication initiation and membrane attachment protein |
| Contig1 | 2187618 | 2188076 | − | GENE_02088 | Prodigal: 2.6 | CDS | — | — | — | — | P0A8D0 | nrdR | — | — | Transcriptional repressor NrdR |
| Contig1 | 2188325 | 2188705 | − | GENE_02089 | Prodigal: 2.6 | CDS | 4.1.1.50 | — | — | — | O34426 | speH | — | — | S-adenosylmethionine decarboxylase proenzyme precursor |
| Contig1 | 2188944 | 2189966 | − | GENE_02090 | Prodigal: 2.6 | CDS | 1.2.1.59 | — | — | — | O34425 | gapB | — | — | Glyceraldehyde-3-phosphate dehydrogenase 2 |
| Contig1 | 2190175 | 2190561 | − | GENE_02091 | Prodigal: 2.6 | CDS | — | — | — | — | O34533 | ytcD_2 | — | — | putative HTH-type transcriptional regulator YteD |
| Contig1 | 2190745 | 2191944 | + | GENE_02092 | Prodigal: 2.6 | CDS | — | — | — | — | P77389 | ydhP_2 | — | — | Inner membrane transport protein YdhP |
| Contig1 | 2192002 | 2192844 | + | GENE_02093 | Prodigal: 2.6 | CDS | 1.-.-.- | — | — | — | O34678 | ytbE | — | — | putative oxidoreductase YtbE |
| Contig1 | 2192883 | 2193476 | − | GENE_02094 | Prodigal: 2.6 | CDS | 2.7.1.24 | — | — | MF_01521 | P63831 | coaE | — | — | Dephospho-CoA kinase |
| Contig1 | 2193492 | 2194124 | − | GENE_02095 | Prodigal: 2.6 | CDS | — | — | — | — | — | mntP_2 | — | — | manganese efflux pump MntP |
| Contig1 | 2194261 | 2195091 | − | GENE_02096 | Prodigal: 2.6 | CDS | 3.2.2.23 | — | — | — | P42371 | mutM | — | — | Formamidopyrimidine-DNA glycosylase |
| Contig1 | 2195116 | 2197755 | − | GENE_02097 | Prodigal: 2.6 | CDS | 2.7.7.7 | — | — | — | P52026 | polA | — | — | DNA polymerase I |
| Contig1 | 2198001 | 2199740 | − | GENE_02098 | Prodigal: 2.6 | CDS | 2.7.13.3 | — | — | — | P23545 | phoR_1 | — | — | Alkaline phosphatase synthesis sensor protein PhoR |
| Contig1 | 2199733 | 2200452 | − | GENE_02099 | Prodigal: 2.6 | CDS | — | — | — | — | P13792 | phoP | — | — | Alkaline phosphatase synthesis transcriptional regulatory protein PhoP |
| Contig1 | 2200668 | 2201606 | − | GENE_02100 | Prodigal: 2.6 | CDS | 1.1.1.37 | — | — | — | P49814 | mdh | — | — | Malate dehydrogenase |
| Contig1 | 2201652 | 2202923 | − | GENE_02101 | Prodigal: 2.6 | CDS | 1.1.1.42 | — | — | — | P39126 | icd | — | — | Isocitrate dehydrogenase [NADP] |
| Contig1 | 2203084 | 2204202 | − | GENE_02102 | Prodigal: 2.6 | CDS | 2.3.3.1 | — | — | — | P39120 | citZ | — | — | Citrate synthase 2 |
| Contig1 | 2205256 | 2205666 | − | GENE_02103 | Prodigal: 2.6 | CDS | — | — | — | — | — | — | — | — | hypothetical protein |
| Contig1 | 2206092 | 2206556 | − | GENE_02104 | Prodigal: 2.6 | CDS | — | — | — | — | — | — | — | — | hypothetical protein |
| Contig1 | 2206654 | 2207769 | − | GENE_02105 | Prodigal: 2.6 | CDS | — | — | — | — | — | — | — | — | hypothetical protein |
| Contig1 | 2207801 | 2208184 | + | GENE_02106 | Prodigal: 2.6 | CDS | — | — | — | — | — | — | — | — | phage T7 F exclusion suppressor FxsA |
| Contig1 | 2208295 | 2210052 | − | GENE_02107 | Prodigal: 2.6 | CDS | 2.7.1.40 | — | — | — | P80885 | pyk | — | — | Pyruvate kinase |
| Contig1 | 2210092 | 2211051 | − | GENE_02108 | Prodigal: 2.6 | CDS | 2.7.1.11 | — | — | — | O34529 | pfkA | — | — | 6-phosphofructokinase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2211243 | 2212220 | − | GENE_02109 | Prodigal: 2.6 | CDS | 6.4.1.2 | — | — | — | O34847 | accA | — | — | Acetyl-coenzyme A carboxylase carboxyl transferase subunit alpha |
| Contig1 | 2212205 | 2213077 | − | GENE_02110 | Prodigal: 2.6 | CDS | 6.4.1.2 | — | — | — | C0SP93 | accD | — | — | Acetyl-coenzyme A carboxylase carboxyl transferase subunit beta |
| Contig1 | 2213406 | 2214638 | − | GENE_02111 | Prodigal: 2.6 | CDS | 1.1.1.38 | — | — | — | P16468 | — | — | — | NAD-dependent malic enzyme |
| Contig1 | 2214778 | 2218119 | − | GENE_02112 | Prodigal: 2.6 | CDS | 2.7.7.7 | — | — | — | P63979 | dnaE | — | — | DNA polymerase III subunit alpha |
| Contig1 | 2218262 | 2218603 | + | GENE_02113 | Prodigal: 2.6 | CDS | — | — | — | — | C0H3P8 | ytrH | — | — | Sporulation membrane protein YtrH |
| Contig1 | 2218600 | 2219103 | + | GENE_02114 | Prodigal: 2.6 | CDS | — | — | — | — | O34460 | ytrI | — | — | Sporulation membrane protein YtrI |
| Contig1 | 2219209 | 2219400 | + | GENE_02115 | Prodigal: 2.6 | CDS | — | — | — | — | — | — | — | — | hypothetical protein |
| Contig1 | 2219418 | 2220359 | − | GENE_02116 | Prodigal: 2.6 | CDS | 3.1.-.- | — | — | — | O34600 | nrnA_1 | — | — | Bifunctional oligoribonuclease and PAP phosphatase NrnA |
| Contig1 | 2220476 | 2220778 | + | GENE_02117 | Prodigal: 2.6 | CDS | — | — | — | — | — | — | — | — | hypothetical protein |
| Contig1 | 2220807 | 2222123 | − | GENE_02118 | Prodigal: 2.6 | CDS | 3.6.1.1 | — | — | — | Q8XIQ9 | — | — | — | Cobalt-dependent inorganic pyrophosphatase |
| Contig1 | 2222262 | 2222948 | − | GENE_02119 | Prodigal: 2.6 | CDS | 3.1.2.6 | — | — | MF_01374 | — | — | — | — | Hydroxyacylglutathione hydrolase |
| Contig1 | 2223009 | 2223776 | − | GENE_02120 | Prodigal: 2.6 | CDS | 1.1.1.100 | — | — | — | P0A2C9 | fabG_5 | — | — | 3-oxoacyl-[acyl-carrier-protein] reductase FabG |
| Contig1 | 2223914 | 2224042 | − | GENE_02121 | Prodigal: 2.6 | CDS | — | — | — | — | — | — | — | — | hypothetical protein |
| Contig1 | 2224117 | 2225493 | − | GENE_02122 | Prodigal: 2.6 | CDS | 4.3.2.1 | — | — | — | P11447 | argH | — | — | Argininosuccinate lyase |
| Contig1 | 2225490 | 2226701 | − | GENE_02123 | Prodigal: 2.6 | CDS | 6.3.4.5 | — | — | — | P77973 | argG | — | — | Argininosuccinate synthase |
| Contig1 | 2226853 | 2227365 | − | GENE_02124 | Prodigal: 2.6 | CDS | — | — | — | — | Q816R0 | moaB | — | — | Molybdenum cofactor biosynthesis protein B |
| Contig1 | 2227465 | 2228652 | − | GENE_02125 | Prodigal: 2.6 | CDS | 2.7.2.1 | — | — | — | P37877 | ackA | — | — | Acetate kinase |
| Contig1 | 2228964 | 2229950 | − | GENE_02126 | Prodigal: 2.6 | CDS | 2.1.11.72 | — | — | — | Q89Z59 | — | — | — | putative type I restriction enzymeP M protein |
| Contig1 | 2230012 | 2230515 | − | GENE_02127 | Prodigal: 2.6 | CDS | 1.11.1.- | — | — | — | P80864 | tpx | — | — | putative thiol peroxidase |
| Contig1 | 2230631 | 2231071 | − | GENE_02128 | Prodigal: 2.6 | CDS | — | — | — | — | O34806 | ytfJ | — | — | putative spore protein YtfJ |
| Contig1 | 2231084 | 2231773 | − | GENE_02129 | Prodigal: 2.6 | CDS | — | — | — | — | — | — | — | — | hypothetical protein |
| Contig1 | 2231851 | 2232342 | − | GENE_02130 | Prodigal: 2.6 | CDS | — | — | PF06271.6 | — | — | — | — | — | RDD family protein |
| Contig1 | 2232356 | 2233363 | − | GENE_02131 | Prodigal: 2.6 | CDS | 3.4.21.- | — | — | — | O34525 | sppA | — | — | Putative signal peptide peptidase SppA |
| Contig1 | 2233521 | 2234351 | + | GENE_02132 | Prodigal: 2.6 | CDS | 2.7.1.23 | — | — | — | Q8Y8D7 | ppnK1 | — | — | putative inorganic polyphosphate/ATP-NAD kinase 1 |
| Contig1 | 2234368 | 2235963 | − | GENE_02133 | Prodigal: 2.6 | CDS | 3.5.1.91 | — | — | — | Q68AP4 | nfdA | — | — | N-substituted formamide deformylase |
| Contig1 | 2235987 | 2237573 | − | GENE_02134 | Prodigal: 2.6 | CDS | 6.2.1.1 | — | — | — | P39062 | acsA_1 | — | — | Acetyl-coenzyme A synthetase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2237722 | 2237940 | − | GENE_02135 | Prodigal: 2.6 | CDS | — | — | — | — | P84583 | — | — | — | Small, acid-soluble spore protein 1 |
| Contig1 | 2238021 | 2239226 | − | GENE_02136 | Prodigal: 2.6 | CDS | 2.8.1.4 | — | — | — | Q81KU0 | thiI | — | — | putative tRNA sulfurtransferase |
| Contig1 | 2239230 | 2240375 | − | GENE_02137 | Prodigal: 2.6 | CDS | 2.8.1.7 | — | — | — | P0A6B7 | iscS_2 | — | — | Cysteine desulfurase |
| Contig1 | 2240569 | 2241909 | + | GENE_02138 | Prodigal: 2.6 | CDS | — | — | — | — | P0AD99 | brnQ | — | — | Branched-chain amino acid transport system 2 carrier protein |
| Contig1 | 2242023 | 2243714 | − | GENE_02139 | Prodigal: 2.6 | CDS | — | — | — | — | O34894 | ezrA | — | — | Septation ring formation regulator EzrA |
| Contig1 | 2243910 | 2244722 | + | GENE_02140 | Prodigal: 2.6 | CDS | 3.1.3.15 | — | — | — | O34411 | hisK | — | — | Histidinol-phosphatase |
| Contig1 | 2244712 | 2245335 | − | GENE_02141 | Prodigal: 2.6 | CDS | — | — | — | — | O34970 | yttP | — | — | putative HTH-type transcriptional regulator YttP |
| Contig1 | 2245461 | 2245943 | + | GENE_02142 | Prodigal: 2.6 | CDS | 1.8.4.14 | — | — | — | P76270 | msrC | — | — | Free methionine-R-sulfoxide reductase |
| Contig1 | 2245978 | 2247726 | − | GENE_02143 | Prodigal: 2.6 | CDS | 2.7.7.65 | — | — | — | P76330 | yedQ_2 | — | — | putative diguanylate cyclase YedQ |
| Contig1 | 2248017 | 2248619 | + | GENE_02144 | Prodigal: 2.6 | CDS | — | — | — | — | P21466 | rpsD | — | — | 30S ribosomal protein S4 |
| Contig1 | 2248961 | 2250331 | + | GENE_02145 | Prodigal: 2.6 | CDS | 1.2.1.3 | — | — | — | P12693 | alkH_1 | — | — | Aldehyde dehydrogenase |
| Contig1 | 2250468 | 2251025 | − | GENE_02146 | Prodigal: 2.6 | CDS | — | — | PF09346.4 | — | — | — | — | — | SMI1/KNR4 family protein |
| Contig1 | 2251566 | 2251766 | − | GENE_02147 | Prodigal: 2.6 | CDS | — | — | — | — | — | — | — | — | hypothetical protein |
| Contig1 | 2251910 | 2252470 | − | GENE_02148 | Prodigal: 2.6 | CDS | — | — | — | — | — | — | — | — | hypothetical protein |
| Contig1 | 2252602 | 2253351 | − | GENE_02149 | Prodigal: 2.6 | CDS | — | — | — | — | — | — | — | — | hypothetical protein |
| Contig1 | 2253958 | 2254623 | − | GENE_02150 | Prodigal: 2.6 | CDS | — | — | — | — | — | — | — | — | hypothetical protein |
| Contig1 | 2255008 | 2255424 | + | GENE_02151 | Prodigal: 2.6 | CDS | — | — | — | — | — | — | — | — | hypothetical protein |
| Contig1 | 2256153 | 2256740 | − | GENE_02152 | Prodigal: 2.6 | CDS | — | — | — | — | — | — | — | — | hypothetical protein |
| Contig1 | 2257500 | 2258690 | − | GENE_02153 | Prodigal: 2.6 | CDS | 1.14.12.17 | — | — | — | P49852 | hmp_1 | — | — | Flavohemoprotein |
| Contig1 | 2258927 | 2259154 | + | GENE_02154 | Prodigal: 2.6 | CDS | — | — | — | — | — | — | — | — | hypothetical protein |
| Contig1 | 2259336 | 2259845 | + | GENE_02155 | Prodigal: 2.6 | CDS | 3.2.-.- | — | — | — | O06006 | yraA_1 | — | — | Putative cysteine protease YraA |
| Contig1 | 2259992 | 2260120 | + | GENE_02156 | Prodigal: 2.6 | CDS | — | — | — | — | — | — | — | — | hypothetical protein |
| Contig1 | 2260136 | 2260888 | − | GENE_02157 | Prodigal: 2.6 | CDS | — | — | PF00657.1 | — | — | — | — | — | GDSL-like Lipase/Acylhydrolase |
| Contig1 | 2261610 | 2262479 | − | GENE_02158 | Prodigal: 2.6 | CDS | — | — | — | — | P69380 | fieF | — | — | Ferrous-iron efflux pump FieF |
| Contig1 | 2262702 | 2263508 | + | GENE_02159 | Prodigal: 2.6 | CDS | — | — | PF01978.13 | — | — | — | — | — | Sugar-specific transcriptional regulator TrmB |
| Contig1 | 2263581 | 2264312 | + | GENE_02160 | Prodigal: 2.6 | CDS | — | — | — | — | P76630 | — | — | — | Inner membrane protein YgaZ |
| Contig1 | 2264309 | 2264632 | + | GENE_02161 | Prodigal: 2.6 | CDS | — | — | PF05437.6 | — | — | ygaZ | — | — | Branched-chain amino acid transport protein (AzlD) |
| Contig1 | 2264918 | 2266182 | − | GENE_02162 | Prodigal: 2.6 | CDS | 6.1.1.1 | — | — | — | P22326 | tyrS1 | — | — | Tyrosine-tRNA ligase 1 |
| Contig1 | 2266520 | 2268238 | − | GENE_02163 | Prodigal: 2.6 | CDS | 6.2.1.1 | — | — | — | P39062 | acsA_2 | — | — | Acetyl-coenzyme A synthetase |
| Contig1 | 2268397 | 2269029 | + | GENE_02164 | Prodigal: 2.6 | CDS | 2.3.1.- | — | — | — | P39065 | acuA | — | — | Acetoin utilization protein AcuA |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2269054 | 2269698 | + | GENE_02165 | Prodigal: 2.6 | CDS | — | — | — | — | O06186 | hrp1_3 | — | — | Hypoxic response protein 1 |
| Contig1 | 2269695 | 2270861 | + | GENE_02166 | Prodigal: 2.6 | CDS | — | — | — | — | P64376 | acuC | — | — | Acetoin utilization protein AcuC |
| Contig1 | 2270870 | 2271559 | − | GENE_02167 | Prodigal: 2.6 | CDS | — | — | — | — | P55892 | motB_2 | — | — | Motility protein B |
| Contig1 | 2271549 | 2272364 | − | GENE_02168 | Prodigal: 2.6 | CDS | — | — | — | — | O06873 | pomA_2 | — | — | Chemotaxis protein PomA |
| Contig1 | 2272433 | 2273437 | − | GENE_02169 | Prodigal: 2.6 | CDS | — | — | — | — | P25144 | ccpA_2 | — | — | Catabolite control protein A |
| Contig1 | 2273716 | 2274792 | − | GENE_02170 | Prodigal: 2.6 | CDS | 2.5.1.54 | — | — | — | Q9WYH8 | aroF_2 | — | — | Phospho-2-dehydro-3-deoxyheptonate aldolase |
| Contig1 | 2275029 | 2275355 | − | GENE_02171 | Prodigal: 2.6 | CDS | — | — | — | — | — | — | — | — | hypothetical protein |
| Contig1 | 2275381 | 2275794 | − | GENE_02172 | Prodigal: 2.6 | CDS | — | — | PF12732.1 | — | — | — | — | — | YtxH-like protein |
| Contig1 | 2275827 | 2276249 | − | GENE_02173 | Prodigal: 2.6 | CDS | — | — | — | — | — | — | — | — | hypothetical protein |
| Contig1 | 2276408 | 2277706 | − | GENE_02174 | Prodigal: 2.6 | CDS | 6.3.2.8 | — | — | — | P65475 | murC | — | — | UDP-N-acetyl-muramate--L-alanine ligase |
| Contig1 | 2277947 | 2280550 | − | GENE_02175 | Prodigal: 2.6 | CDS | — | — | — | — | C0SP86 | sfaA | — | — | DNA translocase SftA |
| Contig1 | 2280718 | 2281323 | − | GENE_02176 | Prodigal: 2.6 | CDS | 6.1.1.20 | — | — | — | Q4L5E4 | pheT_2 | — | — | Phenylalanine tRNA ligase beta subunit |
| Contig1 | 2281338 | 2282147 | − | GENE_02177 | Prodigal: 2.6 | CDS | — | — | — | — | — | — | — | — | hypothetical protein |
| Contig1 | 2282163 | 2282486 | − | GENE_02178 | Prodigal: 2.6 | CDS | — | — | — | — | O34357 | ytpP | — | — | Thioredoxin-like protein YtpP |
| Contig1 | 2282684 | 2283130 | + | GENE_02179 | Prodigal: 2.6 | CDS | — | — | — | — | — | — | — | — | hypothetical protein |
| Contig1 | 2283517 | 2283780 | − | GENE_02180 | Prodigal: 2.6 | CDS | 3.4.11.- | — | — | — | P94521 | ysdC_3 | — | — | Putative aminopeptidase YsdC |
| Contig1 | 2283777 | 2284589 | − | GENE_02181 | Prodigal: 2.6 | CDS | 3.4.11.- | — | — | — | P94521 | ysdC_4 | — | — | Putative aminopeptidase YsdC |
| Contig1 | 2284748 | 2285065 | + | GENE_02182 | Prodigal: 2.6 | CDS | — | — | PF03413.13 | — | — | — | — | — | Peptidase propeptide and YPEB domain protein |
| Contig1 | 2285121 | 2286818 | − | GENE_02183 | Prodigal: 2.6 | CDS | 1.1.1.38 | — | — | — | P45868 | maeA_1 | — | — | putative NAD-dependent malic enzyme 2 |
| Contig1 | 2286897 | 2287742 | − | GENE_02184 | Prodigal: 2.6 | CDS | 3.1.1.- | — | — | — | O34760 | ytnP | — | — | putative quorum-quenching lactonase YtnP |
| Contig1 | 2287801 | 2288454 | − | GENE_02185 | Prodigal: 2.6 | CDS | 2.1.1.33 | — | — | — | O34522 | trmB | — | — | tRNA (guanine-N(7))-methyltransferase |
| Contig1 | 2288641 | 2288919 | + | GENE_02186 | Prodigal: 2.6 | CDS | — | — | — | — | — | — | — | — | hypothetical protein |
| Contig1 | 2288920 | 2289717 | + | GENE_02187 | Prodigal: 2.6 | CDS | — | — | PF01636.17 | — | — | — | — | — | Phosphotransferase enzyme family protein |
| Contig1 | 2289988 | 2290917 | − | GENE_02188 | Prodigal: 2.6 | CDS | 2.7.1.- | — | — | — | O34799 | ytlR | — | — | Putative lipid kinase YtlR |
| Contig1 | 2290969 | 2291901 | − | GENE_02189 | Prodigal: 2.6 | CDS | — | — | — | — | — | — | — | — | hypothetical protein |
| Contig1 | 2291928 | 2292479 | − | GENE_02190 | Prodigal: 2.6 | CDS | 6.5.1.- | — | — | — | P37025 | ligT | — | — | 2'-5'-RNA ligase |
| Contig1 | 2292569 | 2293540 | + | GENE_02191 | Prodigal: 2.6 | CDS | 2.5.1.47 | — | — | — | P63871 | cysK_1 | — | — | Cysteine synthase |
| Contig1 | 2293578 | 2294969 | − | GENE_02192 | Prodigal: 2.6 | CDS | 3.4.13.- | — | — | — | Q7A522 | — | — | — | Putative dipeptidase |
| Contig1 | 2295065 | 2296369 | + | GENE_02193 | Prodigal: 2.6 | CDS | — | — | — | — | O34978 | pbuO | — | — | Guanine/hypoxanthine permease PbuO |
| Contig1 | 2296402 | 2297562 | − | GENE_02194 | Prodigal: 2.6 | CDS | — | — | PF05975.6 | — | — | — | — | — | Bacterial ABC transporter protein EcsB |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2297559 | 2298263 | − | GENE_02195 | Prodigal: 2.6 | CDS | — | — | — | — | P55339 | ecsA_2 | — | — | ABC-type transporter ATP-binding protein EcsA |
| Contig1 | 2298543 | 2298764 | + | GENE_02196 | Prodigal: 2.6 | CDS | — | — | — | — | O32067 | ytzE | — | — | putative HTH-type transcriptional regulator YtzE |
| Contig1 | 2298892 | 2299611 | − | GENE_02197 | Prodigal: 2.6 | CDS | 5.4.99.19 | — | — | — | P0AA43 | rsuA | — | — | Ribosomal small subunit pseudouridine synthase A |
| Contig1 | 2299668 | 2301305 | − | GENE_02198 | Prodigal: 2.6 | CDS | — | — | — | — | O34674 | ytgP_1 | — | — | putative cell division protein YtgP |
| Contig1 | 2301513 | 2302778 | + | GENE_02199 | Prodigal: 2.6 | CDS | 1.18.1.2 | — | — | MF_01685 | — | — | — | — | Ferredoxin–NADP reductase |
| Contig1 | 2302955 | 2304490 | − | GENE_02200 | Prodigal: 2.6 | CDS | — | — | — | — | P54417 | opuD | — | — | Glycine betaine transporter OpuD |
| Contig1 | 2304526 | 2304708 | − | GENE_02201 | Prodigal: 2.6 | CDS | — | — | — | — | P94496 | — | — | — | Sporulation protein cse60 |
| Contig1 | 2304909 | 2305934 | + | GENE_02202 | Prodigal: 2.6 | CDS | — | — | — | — | Q7WTB0 | lacR3 | — | — | HTH-type transcriptional regulator LacR |
| Contig1 | 2305976 | 2307253 | + | GENE_02203 | Prodigal: 2.6 | CDS | — | — | — | — | Q00749 | msmE_1 | — | — | Multiple sugar-binding protein precursor |
| Contig1 | 2307250 | 2308164 | + | GENE_02204 | Prodigal: 2.6 | CDS | — | — | — | — | P29823 | lacF_2 | — | — | Lactose transport system permease protein LacF |
| Contig1 | 2308161 | 2308982 | + | GENE_02205 | Prodigal: 2.6 | CDS | — | — | — | — | P94530 | araQ_2 | — | — | L-arabinose transport system permease protein AraQ |
| Contig1 | 2309005 | 2310303 | + | GENE_02206 | Prodigal: 2.6 | CDS | 3.2.1.22 | — | — | — | P06720 | melA | — | — | Alpha-galactosidase |
| Contig1 | 2310340 | 2310825 | − | GENE_02207 | Prodigal: 2.6 | CDS | 2.3.1.189 | — | — | MF_01698 | — | mshD_1 | — | — | Mycothiol acetyltransferase |
| Contig1 | 2310901 | 2311212 | − | GENE_02208 | Prodigal: 2.6 | CDS | 2.8.1.1 | — | — | — | P0A6V5 | glpE_1 | — | — | Thiosulfate sulfurtransferase GlpE |
| Contig1 | 2311329 | 2313743 | − | GENE_02209 | Prodigal: 2.6 | CDS | 6.1.1.4 | — | — | — | P67513 | leuS | — | — | Leucine--tRNA ligase |
| Contig1 | 2314169 | 2314504 | − | GENE_02210 | Prodigal: 2.6 | CDS | — | — | — | — | — | — | — | — | hypothetical protein |
| Contig1 | 2314894 | 2315679 | + | GENE_02211 | Prodigal: 2.6 | CDS | — | — | — | — | O34627 | pfyP | — | — | Blue-light photoreceptor |
| Contig1 | 2315721 | 2316905 | − | GENE_02212 | Prodigal: 2.6 | CDS | — | — | — | MF_01529 | — | mdtH | — | — | Multidrug resistance protein MdtH |
| Contig1 | 2317101 | 2317811 | − | GENE_02213 | Prodigal: 2.6 | CDS | — | — | PF09529.4 | — | — | — | — | — | Integral membrane protein ( ) |
| Contig1 | 2317919 | 2319859 | − | GENE_02214 | Prodigal: 2.6 | CDS | — | — | — | — | O34741 | bceB | — | — | Bacitracin export permease protein BceB |
| Contig1 | 2319856 | 2320608 | − | GENE_02215 | Prodigal: 2.6 | CDS | — | — | — | — | O34697 | bceA | — | — | Bacitracin export ATP-binding protein BceA |
| Contig1 | 2320714 | 2321676 | − | GENE_02216 | Prodigal: 2.6 | CDS | 2.7.13.3 | — | — | — | Q7A6Z3 | graS_1 | — | — | Sensor histidine kinase GraS |
| Contig1 | 2321711 | 2322406 | − | GENE_02217 | Prodigal: 2.6 | CDS | — | — | — | — | Q5HI09 | graR_1 | — | — | Response regulator protein GraR |
| Contig1 | 2322470 | 2323780 | − | GENE_02218 | Prodigal: 2.6 | CDS | — | — | — | — | O35005 | ytrF | — | — | ABC transporter permease YtrF precursor |
| Contig1 | 2323770 | 2324465 | − | GENE_02219 | Prodigal: 2.6 | CDS | — | — | — | — | O34392 | ytrE | — | — | ABC transporter ATP-binding protein YtrE |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2324481 | 2325464 | − | GENE_02220 | Prodigal: 2.6 | CDS | — | — | — | — | O34898 | ytrC_1 | — | — | putative ABC transporter permease YtrC |
| Contig1 | 2325501 | 2326487 | − | GENE_02221 | Prodigal: 2.6 | CDS | — | — | — | — | O34898 | ytrC_2 | — | — | putative ABC transporter permease YtrC |
| Contig1 | 2326503 | 2327489 | − | GENE_02222 | Prodigal: 2.6 | CDS | — | — | — | — | O34898 | ytrC_3 | — | — | putative ABC transporter permease YtrC |
| Contig1 | 2327483 | 2328361 | − | GENE_02223 | Prodigal: 2.6 | CDS | — | — | — | — | O34641 | ytrB_1 | — | — | ABC transporter ATP-binding protein YtrB |
| Contig1 | 2328354 | 2328746 | − | GENE_02224 | Prodigal: 2.6 | CDS | — | — | — | — | O34712 | ytrA_2 | — | — | HTH-type transcriptional repressor YtrA |
| Contig1 | 2328785 | 2328901 | − | GENE_02225 | Prodigal: 2.6 | CDS | — | — | — | — | — | — | — | — | hypothetical protein |
| Contig1 | 2329094 | 2329366 | − | GENE_02226 | Prodigal: 2.6 | CDS | — | — | — | — | — | — | — | — | hypothetical protein |
| Contig1 | 2329604 | 2330572 | + | GENE_02227 | Prodigal: 2.6 | CDS | 2.8.1.6 | — | — | MF_01694 | — | bioB_2 | — | — | Biotin synthase |
| Contig1 | 2330569 | 2331150 | + | GENE_02228 | Prodigal: 2.6 | CDS | 2.1.1.199 | — | — | MF_01007 | — | rsmH_2 | — | — | Ribosomal RNA small subunit methyltransferase H |
| Contig1 | 2331273 | 2331467 | + | GENE_02229 | Prodigal: 2.6 | CDS | — | — | — | — | — | — | — | — | hypothetical protein |
| Contig1 | 2331521 | 2332603 | − | GENE_02230 | Prodigal: 2.6 | CDS | 4.2.3.130 | — | — | — | — | — | — | — | Tetraprenyl-beta-curcumene synthase |
| Contig1 | 2332621 | 2333400 | − | GENE_02231 | Prodigal: 2.6 | CDS | 3.1.1.- | — | — | — | O34707 | ytpB | — | — | Phospholipase YtpA |
| Contig1 | 2333444 | 2333962 | + | GENE_02232 | Prodigal: 2.6 | CDS | 2.3.1.89 | — | — | — | O34705 | ytpA | — | — | 2,3,4,5-tetrahydropyridine-2,6-dicarboxylate N-acetyltransferase |
| Contig1 | — | — | — | — | — | — | — | — | — | — | Q7A2S0 | dapH_2 | — | — | |
| Contig1 | 2334138 | 2335541 | − | GENE_02233 | Prodigal: 2.6 | CDS | — | — | — | — | P0AAE2 | proY | — | — | Proline-specific permease ProY |
| Contig1 | 2335746 | 2337644 | − | GENE_02234 | Prodigal: 2.6 | CDS | 6.3.5.4 | — | — | — | P54420 | asnB | — | — | Asparagine synthetase [glutamine-hydrolyzing] 1 |
| Contig1 | 2337788 | 2338990 | − | GENE_02235 | Prodigal: 2.6 | CDS | 2.5.1.6 | — | — | — | P66767 | metK | — | — | S-adenosylmethionine synthase |
| Contig1 | 2339497 | 2341080 | + | GENE_02236 | Prodigal: 2.6 | CDS | 4.1.1.49 | — | — | — | P99128 | pckA | — | — | Phosphoenolpyruvate carboxykinase [ATP] |
| Contig1 | 2341123 | 2341365 | − | GENE_02237 | Prodigal: 2.6 | CDS | — | — | — | — | — | — | — | — | hypothetical protein |
| Contig1 | 2341423 | 2342196 | − | GENE_02238 | Prodigal: 2.6 | CDS | — | — | PF00326.1 | — | — | — | — | — | Prolyl oligopeptidase family protein |
| Contig1 | 2342335 | 2343339 | + | GENE_02239 | Prodigal: 2.6 | CDS | — | — | PF09084.5 | — | — | — | — | — | NMT1/THI5 like protein |
| Contig1 | 2343351 | 2344133 | + | GENE_02240 | Prodigal: 2.6 | CDS | 3.6.3.- | — | — | — | P97027 | ssuB_2 | — | — | Aliphatic sulfonates import ATP-binding protein SsuB |
| Contig1 | 2344108 | 2344933 | + | GENE_02241 | Prodigal: 2.6 | CDS | — | — | — | — | P40401 | ssuC_2 | — | — | Putative aliphatic sulfonates transport permease protein SsuC |
| Contig1 | 2344956 | 2345435 | − | GENE_02242 | Prodigal: 2.6 | CDS | 3.6.1.55 | — | — | — | O35013 | ytkD | — | — | Putative 8-oxo-dGTP diphosphatase YtkD |
| Contig1 | 2345568 | 2345972 | − | GENE_02243 | Prodigal: 2.6 | CDS | — | — | PF05105.6 | — | — | — | — | — | Holin family protein |
| Contig1 | 2346124 | 2346561 | − | GENE_02244 | Prodigal: 2.6 | CDS | — | — | — | — | P80879 | dps | — | — | General stress protein 20U |
| Contig1 | 2346686 | 2346835 | + | GENE_02245 | Prodigal: 2.6 | CDS | — | — | — | — | — | — | — | — | hypothetical protein |
| Contig1 | 2346832 | 2347275 | − | GENE_02246 | Prodigal: 2.6 | CDS | — | — | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2347390 | 2347863 | − | GENE_02247 | Prodigal: 2.6 | CDS | 4.4.1.21 | — | — | — | O34667 | luxS | — | — | S-ribosylhomocysteine lyase |
| Contig1 | 2347988 | 2348215 | + | GENE_02248 | Prodigal: 2.6 | CDS | — | — | — | — | P0A8C8 | yidD | — | — | Putative membrane protein insertion efficiency factor |
| Contig1 | 2348212 | 2348781 | − | GENE_02249 | Prodigal: 2.6 | CDS | 4.2.1.1 | — | — | — | P64797 | mtcA1_1 | — | — | Beta-carbonic anhydrase 1 |
| Contig1 | 2348900 | 2349148 | − | GENE_02250 | Prodigal: 2.6 | CDS | — | — | — | — | O34967 | rpmE2 | — | — | 50S ribosomal protein L31 type B |
| Contig1 | 2349346 | 2350677 | + | GENE_02251 | Prodigal: 2.6 | CDS | 1.10.3.- | — | — | — | C0SP90 | ythA | — | — | Putative cytochrome bd menaquinol oxidase subunit I |
| Contig1 | 2350712 | 2351740 | + | GENE_02252 | Prodigal: 2.6 | CDS | — | — | — | — | O34505 | ythB | — | — | Putative cytochrome bd menaquinol oxidase subunit II |
| Contig1 | 2351765 | 2351956 | + | GENE_02253 | Prodigal: 2.6 | CDS | — | — | — | — | — | — | — | — | hypothetical protein |
| Contig1 | 2352344 | 2353459 | − | GENE_02254 | Prodigal: 2.6 | CDS | 4.2.1.113 | — | — | — | O34514 | menC | — | — | o-succinylbenzoate synthase |
| Contig1 | 2353456 | 2354919 | − | GENE_02255 | Prodigal: 2.6 | CDS | 6.2.1.26 | — | — | — | P63526 | menE | — | — | 2-succinylbenzoate-CoA ligase |
| Contig1 | 2355007 | 2355825 | − | GENE_02256 | Prodigal: 2.6 | CDS | 4.1.3.36 | — | — | — | P23966 | menB | — | — | 1,4-Dihydroxy-2-naphthoyl-CoA synthase |
| Contig1 | 2355884 | 2356708 | − | GENE_02257 | Prodigal: 2.6 | CDS | 4.2.99.20 | — | — | — | P37355 | menH | — | — | 2-succinyl-6-hydroxy-2,4-cyclohexadiene-1-carboxylate synthase |
| Contig1 | 2356696 | 2358432 | − | GENE_02258 | Prodigal: 2.6 | CDS | 2.2.1.9 | — | — | — | P23970 | menD | — | — | 2-succinyl-5-enolpyruvyl-6-hydroxy-3-cyclohexene-1-carboxylate synthase |
| Contig1 | 2358429 | 2359844 | − | GENE_02259 | Prodigal: 2.6 | CDS | 5.4.4.2 | — | — | — | Q51508 | pchA | — | — | Salicylate biosynthesis isochorismate synthase |
| Contig1 | 2360127 | 2360846 | + | GENE_02260 | Prodigal: 2.6 | CDS | — | — | PF03073.9 | — | P80872 | yockK3 | — | — | General stress protein 160 TspO/MBR family protein |
| Contig1 | 2361002 | 2361472 | + | GENE_02261 | Prodigal: 2.6 | CDS | — | — | — | — | — | — | — | — | |
| Contig1 | 2361509 | 2361580 | − | GENE_02262 | Aragorn: 1.2 | tRNA | — | — | — | — | — | — | — | — | tRNA-Glu(ttc) |
| Contig1 | 2361584 | 2361674 | − | GENE_02263 | Aragorn: 1.2 | tRNA | — | — | — | — | — | — | — | — | tRNA-Ser(gct) |
| Contig1 | 2361678 | 2361752 | − | GENE_02264 | Aragorn: 1.2 | tRNA | — | — | — | — | — | — | — | — | tRNA-Asn(gtt) |
| Contig1 | 2361763 | 2361839 | − | GENE_02265 | Aragorn: 1.2 | tRNA | — | — | — | — | — | — | — | — | tRNA-Ile(gat) |
| Contig1 | 2361855 | 2361928 | − | GENE_02266 | Aragorn: 1.2 | tRNA | — | — | — | — | — | — | — | — | tRNA-Gly(tcc) |
| Contig1 | 2361937 | 2362012 | − | GENE_02267 | Aragorn: 1.2 | tRNA | — | — | — | — | — | — | — | — | tRNA-His(gtg) |
| Contig1 | 2362033 | 2362108 | − | GENE_02268 | Aragorn: 1.2 | tRNA | — | — | — | — | — | — | — | — | tRNA-Phe(gaa) |
| Contig1 | 2362119 | 2362195 | − | GENE_02269 | Aragorn: 1.2 | tRNA | — | — | — | — | — | — | — | — | tRNA-Asp(gtc) |
| Contig1 | 2362203 | 2362279 | − | GENE_02270 | Aragorn: 1.2 | tRNA | — | — | — | — | — | — | — | — | tRNA-Met(cat) |
| Contig1 | 2362299 | 2362391 | − | GENE_02271 | Aragorn: 1.2 | tRNA | — | — | — | — | — | — | — | — | tRNA-Ser(gga) |
| Contig1 | 2362399 | 2362475 | − | GENE_02272 | Aragorn: 1.2 | tRNA | — | — | — | — | — | — | — | — | tRNA-Met(cat) |
| Contig1 | 2362478 | 2362554 | − | GENE_02273 | Aragorn: 1.2 | tRNA | — | — | — | — | — | — | — | — | tRNA-Met(cat) |
| Contig1 | 2362573 | 2362646 | − | GENE_02274 | Aragorn: 1.2 | tRNA | — | — | — | — | — | — | — | — | tRNA-Ala(tgc) |
| Contig1 | 2362651 | 2362727 | − | GENE_02275 | Aragorn: 1.2 | tRNA | — | — | — | — | — | — | — | — | tRNA-Pro(tgg) |
| Contig1 | 2362745 | 2362821 | − | GENE_02276 | Aragorn: 1.2 | tRNA | — | — | — | — | — | — | — | — | tRNA-Arg(acg) |
| Contig1 | 2362830 | 2362916 | − | GENE_02277 | Aragorn: 1.2 | tRNA | — | — | — | — | — | — | — | — | tRNA-Leu(taa) |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2362936 | 2363010 | − | GENE_02278 | Aragorn: 1.2 | tRNA | — | — | — | — | — | — | — | — | tRNA-Gly(gcc) |
| Contig1 | 2363019 | 2363104 | − | GENE_02279 | Aragorn: 1.2 | tRNA | — | — | — | — | — | — | — | — | tRNA-Ser(cag) |
| Contig1 | 2363114 | 2363189 | − | GENE_02280 | Aragorn: 1.2 | tRNA | — | — | — | — | — | — | — | — | tRNA-Lys(ttt) |
| Contig1 | 2363227 | 2363302 | − | GENE_02281 | Aragorn: 1.2 | tRNA | — | — | — | — | — | — | — | — | tRNA-Thr(tgt) |
| Contig1 | 2363332 | 2363407 | − | GENE_02282 | Aragorn: 1.2 | tRNA | — | — | — | — | — | — | — | — | tRNA-Val(tac) |
| Contig1 | 2363434 | 2363544 | − | GENE_02283 | — | rRNA | — | — | — | — | — | — | — | — | 5S ribosomal RNA |
| Contig1 | 2363599 | 2366524 | − | GENE_02284 | — | rRNA | — | — | — | — | — | — | — | — | 23S ribosomal RNA |
| Contig1 | 2366702 | 2368249 | − | GENE_02285 | — | rRNA | — | — | — | — | — | — | — | — | 16S ribosomal RNA |
| Contig1 | 2368883 | 2369464 | + | GENE_02286 | Prodigal: 2.6 | CDS | — | — | — | — | O37074 | thiT | — | — | Thiamine transporter ThiT |
| Contig1 | 2369495 | 2371024 | − | GENE_02287 | Prodigal: 2.6 | CDS | — | — | — | — | P77306 | yqiK | — | — | Inner membrane protein YqiK |
| Contig1 | 2371044 | 2371574 | − | GENE_02288 | Prodigal: 2.6 | CDS | — | — | — | — | O32077 | yuaF | — | — | putative membrane protein YuaF |
| Contig1 | 2371720 | 2372208 | + | GENE_02289 | Prodigal: 2.6 | CDS | — | — | PF12867.1 | — | — | — | — | — | DinB superfamily protein |
| Contig1 | 2372338 | 2372790 | − | GENE_02290 | Prodigal: 2.6 | CDS | — | — | — | — | O32079 | yuaD | — | — | Putative metal-sulfur cluster biosynthesis proteins YuaD |
| Contig1 | 2372862 | 2374070 | − | GENE_02291 | Prodigal: 2.6 | CDS | 1.1.1.1 | — | — | — | P71017 | gbsB | — | — | Alcohol dehydrogenase |
| Contig1 | 2374087 | 2375559 | − | GENE_02292 | Prodigal: 2.6 | CDS | 1.2.1.8 | — | — | — | P71016 | gbsA | — | — | Betaine aldehyde dehydrogenase |
| Contig1 | 2375760 | 2376314 | + | GENE_02293 | Prodigal: 2.6 | CDS | — | — | — | — | O34709 | opcR_1 | — | — | HTH-type transcriptional repressor OpcR |
| Contig1 | 2376473 | 2377012 | − | GENE_02294 | Prodigal: 2.6 | CDS | — | — | — | — | — | — | — | — | hypothetical protein |
| Contig1 | 2377176 | 2377844 | + | GENE_02295 | Prodigal: 2.6 | CDS | — | — | — | — | O32080 | ktrA_2 | — | — | Ktr system potassium uptake protein A |
| Contig1 | 2377878 | 2378723 | − | GENE_02296 | Prodigal: 2.6 | CDS | 3.2.1.- | — | — | — | O32083 | lytG | — | — | Exo-glucosaminidase LytG precursor |
| Contig1 | 2378866 | 2380047 | − | GENE_02297 | Prodigal: 2.6 | CDS | 1.14.12.17 | — | — | — | P49852 | hmp_2 | — | — | Flavohemoprotein |
| Contig1 | 2380258 | 2380899 | + | GENE_02298 | Prodigal: 2.6 | CDS | — | — | — | — | — | — | — | — | Cupin |
| Contig1 | 2380967 | 2381287 | − | GENE_02299 | Prodigal: 2.6 | CDS | — | — | — | — | — | — | — | — | hypothetical protein |
| Contig1 | 2381520 | 2381756 | − | GENE_02300 | Prodigal: 2.6 | CDS | — | — | — | — | — | — | — | — | hypothetical protein |
| Contig1 | 2382172 | 2382294 | − | GENE_02301 | Prodigal: 2.6 | CDS | — | — | — | — | — | — | — | — | hypothetical protein |
| Contig1 | 2382311 | 2382439 | − | GENE_02302 | Prodigal: 2.6 | CDS | — | — | — | — | — | — | — | — | hypothetical protein |
| Contig1 | 2382429 | 2383559 | − | GENE_02303 | Prodigal: 2.6 | CDS | 3.1.- | — | PF00190.16 | — | Q59HN8 | rapH | — | — | Response regulator aspartate phosphatase H |
| Contig1 | 2383880 | 2384068 | + | GENE_02304 | Prodigal: 2.6 | CDS | — | — | — | — | — | — | — | — | hypothetical protein |
| Contig1 | 2384885 | 2384957 | − | GENE_02305 | Aragorn: 1.2 | tRNA | — | — | — | — | — | — | — | — | tRNA-Ala(ggc) |
| Contig1 | 2385085 | 2385915 | − | GENE_02306 | Prodigal: 2.6 | CDS | 3.6.1.27 | — | — | — | P60932 | uppP | — | — | Undecaprenyl-diphosphatase |
| Contig1 | 2386007 | 2387167 | − | GENE_02307 | Prodigal: 2.6 | CDS | — | PRK12287 | — | — | — | — | — | — | pheromone autoinducer 2 transporter |
| Contig1 | 2387347 | 2388333 | + | GENE_02308 | Prodigal: 2.6 | CDS | 1.1.1.292 | — | — | — | Q2I8V6 | afr | — | — | 1,5-anhydro-D-fructose reductase |
| Contig1 | 2388365 | 2388889 | − | GENE_02309 | Prodigal: 2.6 | CDS | 3.2.-.- | — | — | — | O06006 | yraA_2 | — | — | Putative cysteine protease YraA |
| Contig1 | 2388955 | 2390961 | − | GENE_02310 | Prodigal: 2.6 | CDS | — | — | — | — | P39214 | mcpA_2 | — | — | Methyl-accepting chemotaxis protein McpA |
| Contig1 | 2391077 | 2393062 | − | GENE_02311 | Prodigal: 2.6 | CDS | — | — | — | — | P39214 | mcpA_3 | — | — | Methyl-accepting chemotaxis protein McpA |

TABLE 5-continued

| # ContigID | Start | End | Strand | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|
| Contig1 | 2393190 | 2395178 | − | Prodigal: 2.6 | CDS | — | — | — | — | P39214 | mcpA_4 | — | — | Methyl-accepting chemotaxis protein McpA |
| Contig1 | 2395363 | 2397348 | − | Prodigal: 2.6 | CDS | — | — | — | — | P39215 | mcpB | — | — | Methyl-accepting chemotaxis protein McpB |
| Contig1 | 2397490 | 2398227 | + | Prodigal: 2.6 | CDS | 2.3.2.13 | — | — | — | P40746 | tgl | — | — | Protein-glutamine gamma-glutamyltransferase |
| Contig1 | 2398245 | 2398499 | − | Prodigal: 2.6 | CDS | — | — | — | — | — | — | — | — | hypothetical protein |
| Contig1 | 2398522 | 2399553 | − | Prodigal: 2.6 | CDS | 1.13.12.16 | — | — | — | Q914V0 | — | — | — | Nitronate monooxygenase |
| Contig1 | 2399550 | 2399966 | − | Prodigal: 2.6 | CDS | — | — | — | — | — | — | — | — | hypothetical protein |
| Contig1 | 2400088 | 2401746 | − | Prodigal: 2.6 | CDS | 3.2.1.10 | — | — | — | P29094 | malL | — | — | Oligo-1,6-glucosidase |
| Contig1 | 2401836 | 2403125 | − | Prodigal: 2.6 | CDS | — | — | — | — | P0A2L3 | corC_3 | — | — | Magnesium and cobalt efflux protein CorC |
| Contig1 | 2403168 | 2403845 | − | Prodigal: 2.6 | CDS | — | — | PF04298.6 | — | — | — | — | — | Putative neutral zinc metallopeptidase |
| Contig1 | 2403892 | 2404155 | + | Prodigal: 2.6 | CDS | — | — | — | — | — | — | — | — | hypothetical protein |
| Contig1 | 2404288 | 2404542 | + | Prodigal: 2.6 | CDS | — | — | PF11458.2 | — | — | — | — | — | Membrane-integrating protein Mistic |
| Contig1 | 2404539 | 2405525 | + | Prodigal: 2.6 | CDS | — | — | — | — | Q98GN8 | — | — | — | Cyclic nucleotide-gated potassium channel |
| Contig1 | 2405522 | 2405926 | − | Prodigal: 2.6 | CDS | — | — | PF08868.4 | — | — | — | — | — | YugN-like family protein |
| Contig1 | 2405949 | 2406347 | − | Prodigal: 2.6 | CDS | — | — | — | — | — | — | — | — | hypothetical protein |
| Contig1 | 2406369 | 2407721 | − | Prodigal: 2.6 | CDS | 5.3.1.9 | — | — | — | P80860 | pgi | — | — | Glucose-6-phosphate isomerase |
| Contig1 | 2408119 | 2408685 | + | Prodigal: 2.6 | CDS | 1.7.-.- | — | — | — | O07529 | azr_2 | — | — | FMN-dependent NADPH-azoreductase |
| Contig1 | 2408810 | 2409454 | + | Prodigal: 2.6 | CDS | — | PRK11609 | — | — | — | — | — | — | nicotinamidase/pyrazinamidase |
| Contig1 | 2409756 | 2410928 | − | Prodigal: 2.6 | CDS | 1.1.1.- | — | — | — | Q04944 | bdhA_2 | — | — | NADH-dependent butanol dehydrogenase A |
| Contig1 | 2411014 | 2412177 | − | Prodigal: 2.6 | CDS | 1.1.1.- | — | — | — | Q04944 | bdhA_3 | — | — | NADH-dependent butanol dehydrogenase A |
| Contig1 | 2412407 | 2412643 | + | Prodigal: 2.6 | CDS | — | — | — | — | — | — | — | — | hypothetical protein |
| Contig1 | 2412691 | 2413083 | − | Prodigal: 2.6 | CDS | — | — | — | — | P80870 | yugI_1 | — | — | General stress protein 13 |
| Contig1 | 2413278 | 2414447 | − | Prodigal: 2.6 | CDS | 2.6.1.- | — | — | — | P16524 | patA_2 | — | — | Putative N-acetyl-LL-diaminopimelate aminotransferase |
| Contig1 | 2414448 | 2414948 | − | Prodigal: 2.6 | CDS | — | PRK11169 | — | — | — | — | — | — | leucine-responsive transcriptional regulator |
| Contig1 | 2415101 | 2415922 | + | Prodigal: 2.6 | CDS | 3.7.1.13 | — | — | — | Q9AQM4 | carC | — | — | 2-hydroxy-6-oxo-6-(2'-aminophenyl)hexa-2,4-dienoic acid hydrolase |
| Contig1 | 2415947 | 2416207 | − | Prodigal: 2.6 | CDS | — | — | — | — | — | — | — | — | hypothetical protein |
| Contig1 | 2416294 | 2417457 | + | Prodigal: 2.6 | CDS | 4.4.1.8 | — | — | — | Q08432 | patB | — | — | Cystathionine beta-lyase PatB |
| Contig1 | 2417580 | 2418863 | + | Prodigal: 2.6 | CDS | 2.7.13.3 | — | — | — | P16497 | kinA_3 | — | — | Sporulation kinase A |
| Contig1 | 2418911 | 2419297 | + | Prodigal: 2.6 | CDS | — | — | — | — | Q08429 | kapB | — | — | Kinase-associated lipoprotein B precursor |
| Contig1 | 2419322 | 2419939 | − | Prodigal: 2.6 | CDS | 2.7.7.7 | — | — | MF_00356 | — | polC_3 | — | — | DNA polymerase III PolC-type |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2420090 | 2421334 | + | GENE_02341 | Prodigal: 2.6 | CDS | — | — | — | — | P0A0J9 | qacA_1 | — | — | Antiseptic resistance protein |
| Contig1 | 2421424 | 2423298 | + | GENE_02342 | Prodigal: 2.6 | CDS | — | — | — | — | P40750 | pbpD | — | — | Penicillin-binding protein 4 precursor |
| Contig1 | 2423320 | 2423733 | — | GENE_02343 | Prodigal: 2.6 | CDS | — | — | — | — | — | — | — | — | hypothetical protein |
| Contig1 | 2423748 | 2424305 | + | GENE_02344 | Prodigal: 2.6 | CDS | — | — | — | — | — | — | — | — | hypothetical protein |
| Contig1 | 2424480 | 2426081 | + | GENE_02345 | Prodigal: 2.6 | CDS | 2.7.13.3 | — | — | — | P0AEC8 | dcuS_1 | — | — | Sensor histidine kinase DcuS |
| Contig1 | 2426074 | 2426781 | + | GENE_02346 | Prodigal: 2.6 | CDS | — | — | — | — | P0AD01 | dcuR_1 | — | — | Transcriptional regulatory protein DcuR |
| Contig1 | 2427183 | 2428256 | + | GENE_02347 | Prodigal: 2.6 | CDS | — | — | — | — | P29724 | tmpC_2 | — | — | Membrane lipoprotein TmpC precursor |
| Contig1 | 2428398 | 2429930 | + | GENE_02348 | Prodigal: 2.6 | CDS | 3.6.3.17 | — | — | — | P0AAG8 | mglA | — | — | Galactose/methyl galactoside import ATP-binding protein MglA |
| Contig1 | 2429923 | 2430969 | + | GENE_02349 | Prodigal: 2.6 | CDS | — | — | — | — | — | — | — | — | D-allose transport system permease protein AlsC |
| Contig1 | 2430970 | 2431929 | + | GENE_02350 | Prodigal: 2.6 | CDS | — | — | PF02653.10 | — | P32720 | alsC | — | — | Branched-chain amino acid transport system/permease component |
| Contig1 | 2431974 | 2432192 | — | GENE_02351 | Prodigal: 2.6 | CDS | — | — | — | — | — | — | — | — | hypothetical protein |
| Contig1 | 2432435 | 2434837 | — | GENE_02352 | Prodigal: 2.6 | CDS | — | — | — | — | Q9K2S2 | mrpA | — | — | Na(+)/H(+) antiporter subunit A |
| Contig1 | 2434834 | 2435265 | + | GENE_02353 | Prodigal: 2.6 | CDS | — | — | — | — | O05259 | mrpB | — | — | Na(+)/H(+) antiporter subunit B |
| Contig1 | 2435265 | 2435606 | + | GENE_02354 | Prodigal: 2.6 | CDS | — | — | — | — | O05260 | mrpC | — | — | Na(+)/H(+) antiporter subunit C |
| Contig1 | 2435590 | 2437041 | + | GENE_02355 | Prodigal: 2.6 | CDS | — | — | — | — | O05229 | mrpD | — | — | Na(+)/H(+) antiporter subunit D |
| Contig1 | 2437085 | 2437561 | + | GENE_02356 | Prodigal: 2.6 | CDS | — | — | — | — | Q7WY60 | mrpE | — | — | Na(+)/H(+) antiporter subunit E |
| Contig1 | 2437561 | 2437845 | + | GENE_02357 | Prodigal: 2.6 | CDS | — | — | — | — | O05228 | mrpF | — | — | Na(+)/H(+) antiporter subunit F |
| Contig1 | 2437829 | 2438203 | + | GENE_02358 | Prodigal: 2.6 | CDS | — | — | — | — | O05227 | mrpG | — | — | Na(+)/H(+) antiporter subunit G |
| Contig1 | 2438243 | 2438626 | — | GENE_02359 | Prodigal: 2.6 | CDS | 3.1.2.- | — | — | — | P45083 | — | — | — | Putative esterase |
| Contig1 | 2438648 | 2439292 | — | GENE_02360 | Prodigal: 2.6 | CDS | — | — | — | — | P14204 | comA | — | — | Transcriptional regulatory protein ComA |
| Contig1 | 2439373 | 2441679 | — | GENE_02361 | Prodigal: 2.6 | CDS | 2.7.13.3 | — | — | — | Q99027 | comP | — | — | Sensor histidine kinase ComP |
| Contig1 | 2441698 | 2441874 | — | GENE_02362 | Prodigal: 2.6 | CDS | — | — | — | — | P0CY51 | comX | — | — | Competence pheromone precursor |
| Contig1 | 2441889 | 2442764 | — | GENE_02363 | Prodigal: 2.6 | CDS | — | — | PF00348.11 | — | — | — | — | — | Polyprenyl synthetase |
| Contig1 | 2442916 | 2443056 | — | GENE_02364 | Prodigal: 2.6 | CDS | — | — | — | — | Q99039 | degQ | — | — | Degradation enzyme regulation protein DegQ |
| Contig1 | 2443521 | 2443862 | + | GENE_02365 | Prodigal: 2.6 | CDS | — | — | — | — | — | — | — | — | hypothetical protein |
| Contig1 | 2443869 | 2445089 | — | GENE_02366 | Prodigal: 2.6 | CDS | — | — | PF08668.6 | — | — | — | — | — | HDOD domain protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2445219 | 2446685 | − | GENE_02367 | Prodigal: 2.6 | CDS | 6.3.4.21 | — | — | — | O53770 | pncB2 | — | — | Nicotinate phosphoribosyltransferase pncB2 |
| Contig1 | 2446703 | 2447254 | − | GENE_02368 | Prodigal: 2.6 | CDS | 3.-.-.- | — | — | — | P0ADI7 | yecD_1 | — | — | Isochorismatase family protein YecD |
| Contig1 | 2447351 | 2447749 | − | GENE_02369 | Prodigal: 2.6 | CDS | — | — | — | — | — | — | — | — | hypothetical protein |
| Contig1 | 2447815 | 2448063 | − | GENE_02370 | Prodigal: 2.6 | CDS | — | — | — | — | — | — | — | — | hypothetical protein |
| Contig1 | 2448136 | 2448357 | − | GENE_02371 | Prodigal: 2.6 | CDS | — | — | — | — | O06716 | gerPF_4 | — | — | putative spore germination protein GerPF |
| Contig1 | 2448419 | 2449522 | − | GENE_02372 | Prodigal: 2.6 | CDS | — | PRK12287 | — | — | — | — | — | — | pheromone autoinducer 2 transporter |
| Contig1 | 2449661 | 2449897 | − | GENE_02373 | Prodigal: 2.6 | CDS | — | — | — | — | — | — | — | — | hypothetical protein |
| Contig1 | 2450035 | 2450565 | − | GENE_02374 | Prodigal: 2.6 | CDS | — | — | PF01966.16 | — | — | — | — | — | HD domain protein |
| Contig1 | 2450730 | 2451461 | − | GENE_02375 | Prodigal: 2.6 | CDS | 1.1.1.320 | — | — | — | Q8RJB2 | yueD | — | — | Benzil reductase ((S)-benzoin forming) |
| Contig1 | 2451522 | 2451995 | − | GENE_02376 | Prodigal: 2.6 | CDS | — | — | — | — | — | — | — | — | hypothetical protein |
| Contig1 | 2452003 | 2455143 | − | GENE_02377 | Prodigal: 2.6 | CDS | — | — | PF12698.1 | — | — | — | — | — | ABC-2 family transporter protein |
| Contig1 | 2455140 | 2459615 | − | GENE_02378 | Prodigal: 2.6 | CDS | — | — | — | — | O69735 | eccCa1 | — | — | ESX-1 secretion system protein EccCa1 |
| Contig1 | 2459670 | 2460956 | − | GENE_02379 | Prodigal: 2.6 | CDS | — | — | PF10140.3 | — | — | — | — | — | putative membrane protein essB |
| Contig1 | 2460971 | 2461216 | − | GENE_02380 | Prodigal: 2.6 | CDS | — | — | — | — | P71071 | yukD | — | — | putative ubiquitin-like protein YukD |
| Contig1 | 2461286 | 2461579 | + | GENE_02381 | Prodigal: 2.6 | CDS | — | — | — | — | Q7A7S4 | esxA | — | — | Virulence factor EsxA |
| Contig1 | 2461895 | 2463124 | + | GENE_02382 | Prodigal: 2.6 | CDS | — | — | — | — | P37047 | cdaR_2 | — | — | Carbohydrate diacid regulator |
| Contig1 | 2463228 | 2464358 | + | GENE_02383 | Prodigal: 2.6 | CDS | 1.4.1.1 | — | — | — | Q08352 | ald | — | — | Alanine dehydrogenase |
| Contig1 | 2464475 | 2465152 | + | GENE_02384 | Prodigal: 2.6 | CDS | — | — | — | — | — | — | — | — | hypothetical protein |
| Contig1 | 2465197 | 2465412 | − | GENE_02385 | Prodigal: 2.6 | CDS | — | — | PF03621.7 | — | — | — | — | — | MbtH-like protein |
| Contig1 | 2465431 | 2472558 | − | GENE_02386 | Prodigal: 2.6 | CDS | — | — | — | — | P45745 | dhbF | — | — | Dimodular nonribosomal peptide synthase |
| Contig1 | 2472573 | 2473499 | − | GENE_02387 | Prodigal: 2.6 | CDS | 3.3.2.1 | — | — | — | P45743 | dhbB | — | — | Isochorismatase |
| Contig1 | 2473518 | 2475143 | − | GENE_02388 | Prodigal: 2.6 | CDS | 6.3.2.- | — | — | — | P40871 | dhbE | — | — | 2,3-dihydroxybenzoate-AMP ligase |
| Contig1 | 2475162 | 2476358 | − | GENE_02389 | Prodigal: 2.6 | CDS | 5.4.4.2 | — | — | — | P45744 | dhbC | — | — | Isochorismate synthase DhbC |
| Contig1 | 2476382 | 2477167 | − | GENE_02390 | Prodigal: 2.6 | CDS | 1.3.1.28 | — | — | — | P39071 | dhbA | — | — | 2,3-dihydro-2,3-dihydroxybenzoate dehydrogenase |
| Contig1 | 2477303 | 2478172 | − | GENE_02391 | Prodigal: 2.6 | CDS | 3.1.-.- | — | — | — | O32102 | besA | — | — | Ferri-bacillibactin esterase BesA |
| Contig1 | 2478348 | 2478944 | − | GENE_02392 | Prodigal: 2.6 | CDS | 1.8.-.- | — | — | — | P76342 | yedY | — | — | Sulfoxide reductase catalytic subunit YedY precursor |
| Contig1 | 2479044 | 2479637 | + | GENE_02393 | Prodigal: 2.6 | CDS | — | — | PF03553.8 | — | Q9WZ06 | bioY_2 | — | — | Biotin transporter BioY |
| Contig1 | 2479683 | 2481011 | − | GENE_02394 | Prodigal: 2.6 | CDS | — | — | — | — | — | — | — | — | Na+/H+ antiporter family protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2481144 | 2482634 | − | GENE_02395 | Prodigal: 2.6 | CDS | 3.4.11.1 | — | — | — | Q5H4N2 | pepA | — | — | putative cytosol aminopeptidase |
| Contig1 | 2482782 | 2483258 | + | GENE_02396 | Prodigal: 2.6 | CDS | — | — | PF02681.8 | — | — | — | — | — | Divergent PAP2 family protein |
| Contig1 | 2483287 | 2483928 | − | GENE_02397 | Prodigal: 2.6 | CDS | — | — | — | — | O34669 | yocH_2 | — | — | Cell wall-binding protein YocH precursor |
| Contig1 | 2484029 | 2484349 | − | GENE_02398 | Prodigal: 2.6 | CDS | — | — | — | — | — | — | — | — | hypothetical protein |
| Contig1 | 2484718 | 2485938 | − | GENE_02399 | Prodigal: 2.6 | CDS | 1.6.99.- | — | — | — | Q99VE0 | — | — | — | NADH dehydrogenase-like protein |
| Contig1 | 2486250 | 2487245 | + | GENE_02400 | Prodigal: 2.6 | CDS | 1.18.1.2 | — | — | — | O05268 | yumC_1 | — | — | Ferredoxin—NADP reductase 2 |
| Contig1 | 2487286 | 2487429 | − | GENE_02401 | Prodigal: 2.6 | CDS | — | — | — | — | — | — | — | — | hypothetical protein |
| Contig1 | 2487647 | 2488627 | + | GENE_02402 | Prodigal: 2.6 | CDS | 1.7.1.7 | — | — | — | O05269 | guaC | — | — | GMP reductase |
| Contig1 | 2488690 | 2488911 | − | GENE_02403 | Prodigal: 2.6 | CDS | — | — | — | — | — | — | — | — | hypothetical protein |
| Contig1 | 2488928 | 2489452 | − | GENE_02404 | Prodigal: 2.6 | CDS | — | — | — | — | — | — | — | — | hypothetical protein |
| Contig1 | 2489452 | 2490156 | − | GENE_02405 | Prodigal: 2.6 | CDS | 3.6.3.- | — | — | — | P94374 | yxlF_3 | — | — | putative ABC transporter ATP-binding protein YxlF |
| Contig1 | 2490149 | 2491804 | − | GENE_02406 | Prodigal: 2.6 | CDS | — | — | — | — | — | — | — | — | hypothetical protein |
| Contig1 | 2491887 | 2492225 | − | GENE_02407 | Prodigal: 2.6 | CDS | — | — | PF09221.4 | — | — | — | — | — | Bacteriocin class lid cyclical uberolysin-like protein |
| Contig1 | 2492289 | 2492861 | − | GENE_02408 | Prodigal: 2.6 | CDS | — | — | — | — | — | — | — | — | hypothetical protein |
| Contig1 | 2493610 | 2494371 | + | GENE_02409 | Prodigal: 2.6 | CDS | 1.1.1.- | — | — | — | P39831 | ydfG | — | — | NADP-dependent 3-hydroxy acid dehydrogenase YdfG |
| Contig1 | 2494634 | 2494999 | − | GENE_02410 | Prodigal: 2.6 | CDS | — | — | — | — | — | — | — | — | hypothetical protein |
| Contig1 | 2495449 | 2495811 | − | GENE_02411 | Prodigal: 2.6 | CDS | — | — | — | — | P45344 | erpA | — | — | Iron-sulfur cluster insertion protein ErpA |
| Contig1 | 2495889 | 2496743 | − | GENE_02412 | Prodigal: 2.6 | CDS | 5.1.1.7 | — | — | — | A7Z8D3 | dapF | — | — | Diaminopimelate epimerase |
| Contig1 | 2496867 | 2498084 | − | GENE_02413 | Prodigal: 2.6 | CDS | — | — | — | — | P33021 | nupX | — | — | Nucleoside permease NupX |
| Contig1 | 2498219 | 2498455 | − | GENE_02414 | Prodigal: 2.6 | CDS | — | — | — | — | — | — | — | — | hypothetical protein |
| Contig1 | 2498722 | 2499789 | + | GENE_02415 | Prodigal: 2.6 | CDS | 1.6.99.3 | — | — | — | P00393 | ndh | — | — | NADH dehydrogenase |
| Contig1 | 2499827 | 2500153 | − | GENE_02416 | Prodigal: 2.6 | CDS | — | — | — | — | — | — | — | — | hypothetical protein |
| Contig1 | 2500332 | 2500568 | + | GENE_02417 | Prodigal: 2.6 | CDS | — | — | — | MF_01637 | — | nfuA | — | — | Fe/S biogenesis protein NfuA |
| Contig1 | 2500609 | 2502579 | − | GENE_02418 | Prodigal: 2.6 | CDS | 3.4.14.12 | — | — | — | Q7MUW6 | PtpA | — | — | Prolyl tripeptidyl peptidase precursor |
| Contig1 | 2502683 | 2503612 | − | GENE_02419 | Prodigal: 2.6 | CDS | 2.7.1.39 | — | — | — | Q8Y4A6 | thrB_2 | — | — | Homoserine kinase |
| Contig1 | 2503609 | 2504676 | − | GENE_02420 | Prodigal: 2.6 | CDS | 4.2.3.1 | — | — | — | A0R220 | thrC | — | — | Threonine synthase |
| Contig1 | 2504667 | 2505968 | − | GENE_02421 | Prodigal: 2.6 | CDS | 1.1.1.3 | — | — | — | P08499 | hom | — | — | Homoserine dehydrogenase |
| Contig1 | 2506170 | 2507186 | − | GENE_02422 | Prodigal: 2.6 | CDS | — | — | — | — | — | — | — | — | hypothetical protein |
| Contig1 | 2507305 | 2507841 | + | GENE_02423 | Prodigal: 2.6 | CDS | — | — | PF04608.7 | — | — | — | — | — | Phosphatidylglycero-phosphatase A |
| Contig1 | 2507868 | 2508638 | − | GENE_02424 | Prodigal: 2.6 | CDS | 3.-.-.- | — | — | — | O32125 | yutF_1 | — | — | putative hydrolase YutF |
| Contig1 | 2508672 | 2509106 | − | GENE_02425 | Prodigal: 2.6 | CDS | — | — | — | — | — | — | — | — | hypothetical protein |
| Contig1 | 2509132 | 2509407 | − | GENE_02426 | Prodigal: 2.6 | CDS | — | — | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2509626 | 2510522 | − | GENE_02427 | Prodigal: 2.6 | CDS | 2.8.1.8 | — | — | — | O32129 | lipA | — | — | Lipoyl synthase |
| Contig1 | 2510724 | 2511701 | + | GENE_02428 | Prodigal: 2.6 | CDS | 3.4.-.- | — | — | — | O32130 | lytH | — | — | L-Ala-D-Glu endopeptidase precursor |
| Contig1 | 2511739 | 2512497 | − | GENE_02429 | Prodigal: 2.6 | CDS | — | — | — | — | O32131 | yunB | — | — | Sporulation protein YunB |
| Contig1 | 2512623 | 2514017 | − | GENE_02430 | Prodigal: 2.6 | CDS | 3.1.31.- | — | — | — | P54602 | yhcR_2 | — | — | Endonuclease YhcR precursor |
| Contig1 | 2514035 | 2514856 | − | GENE_02431 | Prodigal: 2.6 | CDS | — | PRK10621 | — | — | — | — | — | — | hypothetical protein |
| Contig1 | 2514876 | 2515727 | − | GENE_02432 | Prodigal: 2.6 | CDS | — | PRK10302 | — | — | — | — | — | — | hypothetical protein |
| Contig1 | 2515754 | 2516107 | − | GENE_02433 | Prodigal: 2.6 | CDS | — | — | — | — | — | — | — | — | hypothetical protein |
| Contig1 | 2516180 | 2517541 | − | GENE_02434 | Prodigal: 2.6 | CDS | 3.5.2.5 | — | — | — | O32137 | allB | — | — | Allantoinase |
| Contig1 | 2517721 | 2519316 | + | GENE_02435 | Prodigal: 2.6 | CDS | — | — | — | — | O32138 | pucR | — | — | Purine catabolism regulatory protein |
| Contig1 | 2519404 | 2519559 | − | GENE_02436 | Prodigal: 2.6 | CDS | — | — | — | — | — | — | — | — | hypothetical protein |
| Contig1 | 2520028 | 2520144 | − | GENE_02437 | Prodigal: 2.6 | CDS | — | — | — | — | — | — | — | — | hypothetical protein |
| Contig1 | 2521183 | 2522379 | − | GENE_02438 | Prodigal: 2.6 | CDS | — | — | — | — | P02980 | tetA_2 | — | — | Tetracycline resistance protein, class B |
| Contig1 | 2522501 | 2523754 | − | GENE_02439 | Prodigal: 2.6 | CDS | 2.-.-.- | — | — | — | O32148 | pucG | — | — | Purine catabolism protein PucG |
| Contig1 | 2523773 | 2525014 | − | GENE_02440 | Prodigal: 2.6 | CDS | 3.5.3.- | — | — | — | O32149 | pucF | — | — | Allantoate amidohydrolase |
| Contig1 | 2525234 | 2526103 | + | GENE_02441 | Prodigal: 2.6 | CDS | 3.1.-.- | — | — | — | Q03091 | bsn | — | — | Extracellular ribonuclease precursor |
| Contig1 | 2526152 | 2527258 | − | GENE_02442 | Prodigal: 2.6 | CDS | 3.6.3.20 | — | — | — | Q8ZLF4 | ugpC | — | — | sn-glycerol-3-phosphate import ATP-binding protein UgpC |
| Contig1 | 2527414 | 2528142 | + | GENE_02443 | Prodigal: 2.6 | CDS | — | — | — | — | O32152 | yurK | — | — | putative HTH-type transcriptional regulator YurK |
| Contig1 | 2528167 | 2529021 | − | GENE_02444 | Prodigal: 2.6 | CDS | 2.7.1.- | — | — | — | O32153 | frlD | — | — | Fructosamine kinase FrlD |
| Contig1 | 2529035 | 2529919 | − | GENE_02445 | Prodigal: 2.6 | CDS | — | — | — | — | P94530 | araQ_3 | — | — | L-arabinose transport system permease protein AraQ |
| Contig1 | 2529923 | 2530813 | − | GENE_02446 | Prodigal: 2.6 | CDS | — | — | — | — | P94529 | araP_2 | — | — | L-arabinose transport system permease protein AraP |
| Contig1 | 2530838 | 2531569 | − | GENE_02447 | Prodigal: 2.6 | CDS | — | — | PF01547.19 | — | — | — | — | — | Bacterial extracellular solute-binding protein |
| Contig1 | 2531587 | 2532123 | − | GENE_02448 | Prodigal: 2.6 | CDS | — | — | — | — | Q00749 | msmE_2 | — | — | Multiple sugar-binding protein precursor |
| Contig1 | 2532176 | 2533162 | − | GENE_02449 | Prodigal: 2.6 | CDS | 3.5.-.- | — | — | — | O32157 | frlB | — | — | Fructosamine deglycase FrlB |
| Contig1 | 2533359 | 2534285 | + | GENE_02450 | Prodigal: 2.6 | CDS | — | — | — | — | P0A9G4 | cueR | — | — | HTH-type transcriptional regulator CueR |
| Contig1 | 2534319 | 2534909 | − | GENE_02451 | Prodigal: 2.6 | CDS | — | — | — | — | O34344 | sdpC | — | — | Killing factor SdpC precursor |
| Contig1 | 2534902 | 2535846 | − | GENE_02452 | Prodigal: 2.6 | CDS | — | — | — | — | O34616 | sdpB | — | — | Sporulation-delaying protein SdpB |
| Contig1 | 2535843 | 2536373 | − | GENE_02453 | Prodigal: 2.6 | CDS | — | — | — | — | O34889 | sdpA | — | — | Sporulation-delaying protein SdpA |

TABLE 5-continued

| # ContigID | Start | End | Strand | Prediction Tool | GeneID | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2536499 | 2536771 | + | Prodigal: 2.6 | GENE_02454 | CDS | — | — | — | — | O31460 | ybgB | — | — | putative membrane protein YbgB |
| Contig1 | 2536810 | 2537184 | — | Prodigal: 2.6 | GENE_02455 | CDS | — | — | — | MF_00203 | — | uvrC_2 | — | — | UvrABC system protein C |
| Contig1 | 2537251 | 2538366 | — | Prodigal: 2.6 | GENE_02456 | CDS | 1.4.99.5 | — | — | — | O85228 | hcnC | — | — | Hydrogen cyanide synthase subunit HcnC precursor |
| Contig1 | 2538404 | 2539105 | — | Prodigal: 2.6 | GENE_02457 | CDS | 2.1.1.- | — | — | — | O31474 | ycgJ | — | — | putative methyltransferase YcgJ |
| Contig1 | 2539183 | 2539644 | + | Prodigal: 2.6 | GENE_02458 | CDS | — | — | — | — | — | — | — | — | hypothetical protein |
| Contig1 | 2539780 | 2540616 | + | Prodigal: 2.6 | GENE_02459 | CDS | 3.2.1.132 | — | — | — | O07921 | csn | — | — | Chitosanase precursor |
| Contig1 | 2540652 | 2542049 | — | Prodigal: 2.6 | GENE_02460 | CDS | — | — | — | — | P77522 | sufB_1 | — | — | FeS cluster assembly protein SufB |
| Contig1 | 2542069 | 2542512 | — | Prodigal: 2.6 | GENE_02461 | CDS | — | — | — | — | O32163 | nifU | — | — | NifU-like protein |
| Contig1 | 2542502 | 2543722 | — | Prodigal: 2.6 | GENE_02462 | CDS | 2.8.1.7 | — | — | — | O32164 | csd_1 | — | — | putative cysteine desulfurase |
| Contig1 | 2543722 | 2545035 | — | Prodigal: 2.6 | GENE_02463 | CDS | — | — | — | — | P77522 | sufB_2 | — | — | FeS cluster assembly protein SufB |
| Contig1 | 2545053 | 2545838 | — | Prodigal: 2.6 | GENE_02464 | CDS | — | — | PF02627.1 | — | P80866 | yurY | — | — | Vegetative protein 296 |
| Contig1 | 2546360 | 2546731 | — | Prodigal: 2.6 | GENE_02465 | CDS | — | — | — | — | — | — | — | — | Carboxymuconolactone decarboxylase family protein |
| Contig1 | 2546831 | 2547646 | — | Prodigal: 2.6 | GENE_02466 | CDS | — | — | — | — | O32167 | metQ_2 | — | — | Methionine-binding lipoprotein MetQ precursor |
| Contig1 | 2547660 | 2548328 | — | Prodigal: 2.6 | GENE_02467 | CDS | — | — | — | — | O32168 | metP | — | — | Methionine import system permease protein MetP |
| Contig1 | 2548321 | 2549346 | — | Prodigal: 2.6 | GENE_02468 | CDS | 3.6.3.- | — | — | — | O32169 | metN | — | — | Methionine import ATP-binding protein MetN |
| Contig1 | 2549669 | 2550019 | — | Prodigal: 2.6 | GENE_02469 | CDS | — | — | PF02036.11 | — | — | — | — | — | SCP-2 sterol transfer family protein |
| Contig1 | 2550116 | 2550436 | — | Prodigal: 2.6 | GENE_02470 | CDS | — | — | — | — | P14949 | trxA_2 | — | — | Thioredoxin |
| Contig1 | 2550439 | 2550804 | — | Prodigal: 2.6 | GENE_02471 | CDS | 3.1.26.8 | — | — | MF_01469 | — | rnmV_1 | — | — | Ribonuclease M5 |
| Contig1 | 2550874 | 2551110 | — | Prodigal: 2.6 | GENE_02472 | CDS | — | — | — | — | — | — | — | — | hypothetical protein |
| Contig1 | 2551165 | 2551548 | — | Prodigal: 2.6 | GENE_02473 | CDS | — | — | — | — | O32174 | gcvH | — | — | Glycine cleavage system H protein |
| Contig1 | 2551608 | 2551964 | — | Prodigal: 2.6 | GENE_02474 | CDS | — | — | — | — | P54503 | mgsR_2 | — | — | Regulatory protein MgsR |
| Contig1 | 2552078 | 2553862 | — | Prodigal: 2.6 | GENE_02475 | CDS | 1.3.99.- | — | — | — | O32176 | fadE | — | — | putative acyl-CoA dehydrogenase |
| Contig1 | 2553881 | 2555056 | — | Prodigal: 2.6 | GENE_02476 | CDS | 2.3.1.16 | — | — | — | O32177 | fadA | — | — | 3-ketoacyl-CoA thiolase |
| Contig1 | 2555067 | 2557436 | — | Prodigal: 2.6 | GENE_02477 | CDS | 1.1.1.35 | — | — | — | O32178 | fadN | — | — | putative 3-hydroxyacyl-CoA dehydrogenase |
| Contig1 | 2557797 | 2558705 | — | Prodigal: 2.6 | GENE_02478 | CDS | 1.5.5.2 | — | — | — | O32179 | fadM_1 | — | — | Proline dehydrogenase 1 |
| Contig1 | 2559315 | 2560919 | + | Prodigal: 2.6 | GENE_02479 | CDS | — | — | — | — | P96712 | bmr3_2 | — | — | Multidrug resistance protein 3 |
| Contig1 | 2561115 | 2561372 | + | Prodigal: 2.6 | GENE_02480 | CDS | — | — | — | — | — | — | — | — | hypothetical protein |
| Contig1 | 2561384 | 2561716 | + | Prodigal: 2.6 | GENE_02481 | CDS | — | — | PF07875.6 | — | — | — | — | — | Coat F domain protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2561854 | 2562315 | + | GENE_02482 | Prodigal: 2.6 | CDS | — | — | — | — | O32181 | yusO_5 | — | — | putative HTH-type transcriptional regulator YusO |
| Contig1 | 2562335 | 2563930 | + | GENE_02483 | Prodigal: 2.6 | CDS | — | — | — | — | P96712 | bmr3_3 | — | — | Multidrug resistance protein 3 |
| Contig1 | 2564039 | 2564926 | − | GENE_02484 | Prodigal: 2.6 | CDS | — | — | — | — | P20668 | gltC_3 | — | — | HTH-type transcriptional regulator GltC |
| Contig1 | 2565048 | 2565794 | + | GENE_02485 | Prodigal: 2.6 | CDS | 4.1.1.4 | — | — | — | P23670 | adc | — | — | Acetoacetate decarboxylase |
| Contig1 | 2565808 | 2566848 | + | GENE_02486 | Prodigal: 2.6 | CDS | — | PRK06522 | — | — | — | — | — | — | 2-dehydropantoate 2-reductase |
| Contig1 | 2567025 | 2567270 | − | GENE_02487 | Prodigal: 2.6 | CDS | — | — | — | — | — | — | — | — | hypothetical protein |
| Contig1 | 2567295 | 2568119 | − | GENE_02488 | Prodigal: 2.6 | CDS | — | — | — | — | O32188 | yusV_1 | — | — | putative siderophore transport system ATP-binding protein YusV |
| Contig1 | 2568275 | 2568712 | − | GENE_02489 | Prodigal: 2.6 | CDS | — | — | — | — | — | — | — | — | hypothetical protein |
| Contig1 | 2568832 | 2570613 | − | GENE_02490 | Prodigal: 2.6 | CDS | 3.4.24.- | — | — | — | P54124 | pepF1_2 | — | — | Oligoendopeptidase F, plasmid |
| Contig1 | 2570746 | 2571588 | + | GENE_02491 | Prodigal: 2.6 | CDS | 1.3.1.- | — | — | — | P16544 | actIII | — | — | Putative ketoacyl reductase |
| Contig1 | 2571677 | 2572141 | − | GENE_02492 | Prodigal: 2.6 | CDS | — | — | — | — | P37960 | mrgA | — | — | Metalloregulation DNA-binding stress protein |
| Contig1 | 2572188 | 2573549 | − | GENE_02493 | Prodigal: 2.6 | CDS | 3.4.21.107 | — | — | — | Q9R9I1 | htrB | — | — | Serine protease Do-like HtrB |
| Contig1 | 2573826 | 2574503 | + | GENE_02494 | Prodigal: 2.6 | CDS | — | — | — | — | O32192 | cssR | — | — | Transcriptional regulatory protein CssR |
| Contig1 | 2574500 | 2575855 | + | GENE_02495 | Prodigal: 2.6 | CDS | 2.7.13.3 | — | — | — | O32193 | cssS | — | — | Sensor histidine kinase CssS |
| Contig1 | 2575883 | 2576047 | − | GENE_02496 | Prodigal: 2.6 | CDS | — | — | — | — | — | — | — | — | hypothetical protein |
| Contig1 | 2576181 | 2577101 | + | GENE_02497 | Prodigal: 2.6 | CDS | — | — | — | — | Q0SV2 | kstR2 | — | — | HTH-type transcriptional repressor KstR2 |
| Contig1 | 2577138 | 2578526 | − | GENE_02498 | Prodigal: 2.6 | CDS | 4.2.1.2 | — | — | — | P64173 | fumC | — | — | Fumarate hydratase class II |
| Contig1 | 2578594 | 2578779 | − | GENE_02499 | Prodigal: 2.6 | CDS | — | — | — | — | — | — | — | — | hypothetical protein |
| Contig1 | 2578896 | 2580338 | + | GENE_02500 | Prodigal: 2.6 | CDS | — | — | — | — | P07868 | gerAA | — | — | Spore germination protein A1 |
| Contig1 | 2580313 | 2581413 | + | GENE_02501 | Prodigal: 2.6 | CDS | — | — | — | — | P07869 | gerAB | — | — | Spore germination protein A2 |
| Contig1 | 2581410 | 2582522 | + | GENE_02502 | Prodigal: 2.6 | CDS | — | — | — | — | P07870 | gerAC | — | — | Spore germination protein A3 precursor |
| Contig1 | 2582565 | 2583197 | − | GENE_02503 | Prodigal: 2.6 | CDS | — | — | — | — | O32197 | liaR_2 | — | — | Transcriptional regulatory protein LiaR |
| Contig1 | 2583175 | 2584257 | − | GENE_02504 | Prodigal: 2.6 | CDS | 2.7.13.3 | — | — | — | O32198 | liaS_2 | — | — | Sensor histidine kinase LiaS |
| Contig1 | 2584254 | 2584985 | − | GENE_02505 | Prodigal: 2.6 | CDS | — | — | — | — | — | — | — | — | hypothetical protein |
| Contig1 | 2585012 | 2585881 | − | GENE_02506 | Prodigal: 2.6 | CDS | — | — | — | — | P54617 | — | — | Phage shock protein A homolog | hypothetical protein |
| Contig1 | 2585987 | 2586664 | − | GENE_02507 | Prodigal: 2.6 | CDS | — | — | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2586678 | 2587058 | − | GENE_02508 | Prodigal: 2.6 | CDS | — | — | — | — | — | — | — | — | hypothetical protein |
| Contig1 | 2587225 | 2588493 | − | GENE_02509 | Prodigal: 2.6 | CDS | — | — | — | — | — | — | — | — | 2-acyl-glycerophospho-ethanolamine acyltransferase |
| Contig1 | 2588657 | 2589226 | − | GENE_02510 | Prodigal: 2.6 | CDS | 2.5.1.17 | PRK08633 | — | — | O34899 | yvqK | — | — | Cob(I)yrinic acid a,c-diamide adenosyltransferase |
| Contig1 | 2589223 | 2590449 | − | GENE_02511 | Prodigal: 2.6 | CDS | 3.6.3.34 | — | — | — | P07821 | fhuC | — | — | Iron(3+)-hydroxamate import ATP-binding protein FhuC |
| Contig1 | 2590446 | 2591513 | − | GENE_02512 | Prodigal: 2.6 | CDS | — | — | — | — | Q56992 | hmuU_1 | — | — | Hemin transport system permease protein HmuU |
| Contig1 | 2591455 | 2592399 | − | GENE_02513 | Prodigal: 2.6 | CDS | — | — | — | — | P37028 | btuF | — | — | Vitamin B12-binding protein precursor |
| Contig1 | 2592587 | 2593378 | + | GENE_02514 | Prodigal: 2.6 | CDS | 1.1.1.100 | — | — | — | O67610 | fabG_6 | — | — | 3-oxoacyl-[acyl-carrier-protein] reductase FabG |
| Contig1 | 2593430 | 2594308 | − | GENE_02515 | Prodigal: 2.6 | CDS | 3.1.1.15 | — | — | — | Q1JUP5 | araB_2 | — | — | L-arabinolactonase |
| Contig1 | 2594372 | 2596114 | − | GENE_02516 | Prodigal: 2.6 | CDS | 2.7.13.3 | — | — | — | O69729 | tcrY_1 | — | — | putative sensor histidine kinase TcrY |
| Contig1 | 2596111 | 2596830 | − | GENE_02517 | Prodigal: 2.6 | CDS | — | — | — | — | Q9RDT5 | walR | — | — | Transcriptional regulatory protein WalR |
| Contig1 | 2597004 | 2597240 | − | GENE_02518 | Prodigal: 2.6 | CDS | — | — | — | — | C0H3R4 | rsoA | — | — | Sigma-O factor regulatory protein RsoA |
| Contig1 | 2597237 | 2597815 | − | GENE_02519 | Prodigal: 2.6 | CDS | — | — | — | — | O34843 | sigO | — | — | RNA polymerase sigma factor SigO |
| Contig1 | 2598016 | 2598171 | + | GENE_02520 | Prodigal: 2.6 | CDS | — | — | PF12841.1 | — | — | — | — | — | YvrJ protein family protein |
| Contig1 | 2598289 | 2599449 | + | GENE_02521 | Prodigal: 2.6 | CDS | 4.1.1.2 | — | — | — | O34714 | oxdC_2 | — | — | Oxalate decarboxylase OxdC |
| Contig1 | 2599516 | 2599938 | + | GENE_02522 | Prodigal: 2.6 | CDS | — | — | — | — | O34686 | yvrL | — | — | Membrane-bound negative regulator YvrL |
| Contig1 | 2599973 | 2600779 | − | GENE_02523 | Prodigal: 2.6 | CDS | — | — | — | — | O32188 | yusV_2 | — | — | putative siderophore transport system ATP-binding protein YusV |
| Contig1 | 2600798 | 2601808 | − | GENE_02524 | Prodigal: 2.6 | CDS | — | — | — | — | P40411 | feuC_1 | — | — | Iron-uptake system permease protein FeuC |
| Contig1 | 2601808 | 2602875 | − | GENE_02525 | Prodigal: 2.6 | CDS | — | — | — | — | P40410 | feuB_1 | — | — | Iron-uptake system permease protein FeuB |
| Contig1 | 2603093 | 2604031 | + | GENE_02526 | Prodigal: 2.6 | CDS | — | — | — | — | P37580 | fhuD | — | — | Iron(3+)-hydroxamate-binding protein FhuD precursor |
| Contig1 | 2604177 | 2605091 | + | GENE_02527 | Prodigal: 2.6 | CDS | — | — | PF04072.8 | — | — | — | — | — | Leucine carboxyl methyltransferase |
| Contig1 | 2605144 | 2606556 | − | GENE_02528 | Prodigal: 2.6 | CDS | — | — | — | — | P0AAE5 | ydgI | — | — | Putative arginine/ornithine antiporter |
| Contig1 | 2606972 | 2607112 | − | GENE_02529 | Prodigal: 2.6 | CDS | — | — | — | — | Q7WY58 | sspJ | — | — | Small, acid-soluble spore protein J |
| Contig1 | 2607296 | 2607778 | + | GENE_02530 | Prodigal: 2.6 | CDS | — | — | — | — | P64481 | ydjM | — | — | Inner membrane protein YdjM |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2607821 | 2609677 | + | GENE_02531 | Prodigal: 2.6 | CDS | — | — | — | — | O34952 | ltaS2_2 | — | — | Lipoteichoic acid synthase 2 |
| Contig1 | 2609708 | 2610634 | − | GENE_02532 | Prodigal: 2.6 | CDS | — | — | PF12727.1 | — | — | — | — | — | PBP superfamily domain protein |
| Contig1 | 2610752 | 2611549 | + | GENE_02533 | Prodigal: 2.6 | CDS | — | — | — | — | P45323 | modA | — | — | Molybdate-binding periplasmic protein precursor |
| Contig1 | 2611530 | 2612213 | + | GENE_02534 | Prodigal: 2.6 | CDS | — | — | — | — | P0AF01 | modB | — | — | Molybdenum transport system permease protein ModB |
| Contig1 | 2612277 | 2612954 | + | GENE_02535 | Prodigal: 2.6 | CDS | — | — | — | — | P13800 | degU_1 | — | — | Transcriptional regulatory protein DegU |
| Contig1 | 2612951 | 2614063 | + | GENE_02536 | Prodigal: 2.6 | CDS | 2.7.13.3 | — | — | — | O34757 | desK_1 | — | — | Sensor histidine kinase DesK |
| Contig1 | 2614183 | 2615118 | + | GENE_02537 | Prodigal: 2.6 | CDS | — | — | — | — | P0A9U1 | ybhF | — | — | putative ABC transporter ATP-binding protein YbhF |
| Contig1 | 2615142 | 2616236 | + | GENE_02538 | Prodigal: 2.6 | CDS | — | — | — | — | P0AFP9 | ybhR_2 | — | — | Inner membrane transport permease YbhR |
| Contig1 | 2616238 | 2617383 | + | GENE_02539 | Prodigal: 2.6 | CDS | — | — | — | — | P0AFQ2 | ybhS | — | — | Inner membrane transport permease YbhS |
| Contig1 | 2617416 | 2618246 | + | GENE_02540 | Prodigal: 2.6 | CDS | 1.1.1.- | — | — | — | O32210 | yvgN_2 | — | — | Glyoxal reductase |
| Contig1 | 2618469 | 2618954 | + | GENE_02541 | Prodigal: 2.6 | CDS | — | — | — | — | O32211 | yvgO_2 | — | — | Stress response protein YvgO precursor |
| Contig1 | 2618991 | 2621006 | − | GENE_02542 | Prodigal: 2.6 | CDS | — | — | — | — | O32212 | nhaK | — | — | Sodium, potassium, lithium and rubidium/H(+) antiporter |
| Contig1 | 2621354 | 2623069 | − | GENE_02543 | Prodigal: 2.6 | CDS | 1.8.1.2 | — | — | — | O32213 | cysI | — | — | Sulfite reductase [NADPH] hemoprotein beta-component |
| Contig1 | 2623097 | 2624905 | − | GENE_02544 | Prodigal: 2.6 | CDS | 1.8.1.2 | — | — | — | O32214 | cysJ | — | — | Sulfite reductase [NADPH] flavoprotein alpha-component |
| Contig1 | 2625080 | 2627395 | − | GENE_02545 | Prodigal: 2.6 | CDS | 3.6.4.12 | PRK10578 | — | — | O32215 | helD | — | — | Helicase IV |
| Contig1 | 2627568 | 2628176 | − | GENE_02547 | Prodigal: 2.6 | CDS | — | — | — | — | — | — | — | — | hypothetical protein |
| Contig1 | 2628399 | 2629199 | + | GENE_02548 | Prodigal: 2.6 | CDS | — | — | — | — | — | — | — | — | hypothetical protein |
| Contig1 | 2629234 | 2629653 | − | GENE_02549 | Prodigal: 2.6 | CDS | — | — | — | — | O32217 | bdbC | — | — | Disulfide bond formation protein C |
| Contig1 | 2629643 | 2630314 | − | GENE_02550 | Prodigal: 2.6 | CDS | — | — | — | — | O32218 | bdbD | — | — | Disulfide bond formation protein D precursor |
| Contig1 | 2630432 | 2632543 | − | GENE_02551 | Prodigal: 2.6 | CDS | 3.63.3 | — | — | — | O32219 | cadA | — | — | Cadmium, zinc and cobalt-transporting ATPase |
| Contig1 | 2632693 | 2635122 | − | GENE_02552 | Prodigal: 2.6 | CDS | 3.6.3.54 | — | — | — | O32220 | copA | — | — | Copper-exporting P-type ATPase A |
| Contig1 | 2635206 | 2635412 | − | GENE_02553 | Prodigal: 2.6 | CDS | — | — | — | — | O32221 | copZ | — | — | Copper chaperone CopZ |
| Contig1 | 2635488 | 2635793 | − | GENE_02553 | Prodigal: 2.6 | CDS | — | — | — | — | O32222 | csoR | — | — | Copper-sensing transcriptional repressor CsoR |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2635932 | 2636972 | + | GENE_02554 | Prodigal: 2.6 | CDS | 1.-.-.- | — | — | — | O32223 | yvaA | — | — | putative oxidoreductase YvaA |
| Contig1 | 2637017 | 2637676 | − | GENE_02555 | Prodigal: 2.6 | CDS | 1.7.-.- | — | — | — | O32224 | azoR2 | — | — | FMN-dependent NADH-azoreductase 2 |
| Contig1 | 2637847 | 2639175 | − | GENE_02556 | Prodigal: 2.6 | CDS | 1.14.-.- | — | — | — | O34974 | moxC | — | — | Putative monooxygenase MoxC |
| Contig1 | 2639172 | 2639459 | − | GENE_02557 | Prodigal: 2.6 | CDS | — | — | PF00462.18 | — | — | — | — | — | Gluta redoxin |
| Contig1 | 2639462 | 2640478 | − | GENE_02558 | Prodigal: 2.6 | CDS | 1.14.13.107 | — | — | — | Q9EUT9 | limB_2 | — | — | Limonene 1,2-monooxygenase |
| Contig1 | 2640475 | 2641254 | − | GENE_02559 | Prodigal: 2.6 | CDS | 3.6.3.- | — | — | — | O34900 | tcyN | — | — | L-cystine import ATP-binding protein TcyN |
| Contig1 | 2641251 | 2641958 | − | GENE_02560 | Prodigal: 2.6 | CDS | — | — | — | — | O34931 | tcyM | — | — | L-cystine transport system permease protein TcyM |
| Contig1 | 2641974 | 2642696 | − | GENE_02561 | Prodigal: 2.6 | CDS | — | — | — | — | O34315 | tcyL | — | — | L-cystine transport system permease protein TcyL |
| Contig1 | 2642719 | 2643531 | − | GENE_02562 | Prodigal: 2.6 | CDS | — | — | — | — | O34852 | tcyK | — | — | L-cystine-binding protein TcyK precursor |
| Contig1 | 2643557 | 2644369 | − | GENE_02563 | Prodigal: 2.6 | CDS | — | — | — | — | O34406 | tcyJ | — | — | L-cystine-binding protein TcyJ precursor |
| Contig1 | 2644366 | 2644905 | − | GENE_02564 | Prodigal: 2.6 | CDS | 2.3.1.- | — | — | — | O34350 | ytmI_1 | — | — | putative N-acetyl-transferase YtmI |
| Contig1 | 2645059 | 2645949 | + | GENE_02565 | Prodigal: 2.6 | CDS | — | — | — | — | Q9F1R2 | cmpR_2 | — | — | HTH-type transcriptional activator CmpR |
| Contig1 | 2645988 | 2646782 | − | GENE_02566 | Prodigal: 2.6 | CDS | 1.1.1.100 | — | — | — | O67610 | fabG_7 | — | — | 3-oxoacyl-[acyl-carrier-protein] reductase FabG |
| Contig1 | 2646897 | 2647202 | − | GENE_02567 | Prodigal: 2.6 | CDS | — | — | — | — | P11540 | — | — | — | Barstar |
| Contig1 | 2647380 | 2648033 | + | GENE_02568 | Prodigal: 2.6 | CDS | — | — | — | — | — | — | — | — | hypothetical protein |
| Contig1 | 2648052 | 2648279 | − | GENE_02569 | Prodigal: 2.6 | CDS | — | — | — | — | — | — | — | — | hypothetical protein |
| Contig1 | 2648980 | 2649339 | − | GENE_02570 | Aragorn: 1.2 | tmRNA | — | — | — | — | — | ssrA | — | — | transfer-messenger RNA, SsrA |
| Contig1 | 2649507 | 2649977 | − | GENE_02571 | Prodigal: 2.6 | CDS | — | — | — | — | O66640 | smpB | — | — | SsrA-binding protein |
| Contig1 | 2650117 | 2652450 | − | GENE_02572 | Prodigal: 2.6 | CDS | 3.1.13.1 | — | — | — | P21499 | rnr | — | — | Ribonuclease R |
| Contig1 | 2652469 | 2653209 | − | GENE_02573 | Prodigal: 2.6 | CDS | 3.1.1.1 | — | — | — | Q06174 | est | — | — | Carboxylesterase |
| Contig1 | 2653328 | 2655558 | − | GENE_02574 | Prodigal: 2.6 | CDS | — | PRK06870 | — | — | — | — | — | — | preprotein translocase subunit SecG |
| Contig1 | 2653682 | 2653912 | − | GENE_02575 | Prodigal: 2.6 | CDS | — | — | PF01381.16 | — | — | — | — | — | Helix-turn-helix |
| Contig1 | 2654063 | 2654443 | + | GENE_02576 | Prodigal: 2.6 | CDS | — | — | — | — | O34844 | yodB_2 | — | — | HTH-type transcriptional regulator YodB |
| Contig1 | 2654528 | 2655931 | − | GENE_02577 | Prodigal: 2.6 | CDS | 2.7.13.3 | — | — | — | P08401 | creC | — | — | Sensor protein CreC |
| Contig1 | 2655922 | 2656584 | − | GENE_02578 | Prodigal: 2.6 | CDS | — | — | — | — | P0C000 | arlR | — | — | Response regulator ArlR |
| Contig1 | 2656606 | 2657376 | − | GENE_02579 | Prodigal: 2.6 | CDS | — | — | PF12730.1 | — | — | — | — | — | ABC-2 family transporter protein |
| Contig1 | 2657373 | 2658107 | − | GENE_02580 | Prodigal: 2.6 | CDS | — | — | PF12730.1 | — | — | — | — | — | ABC-2 family transporter protein |
| Contig1 | 2658104 | 2658817 | − | GENE_02581 | Prodigal: 2.6 | CDS | 3.6.3.- | — | — | — | P94374 | yxlF_4 | — | — | putative ABC transporter ATP-binding protein YxlF |

TABLE 5-continued

| #ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2658928 | 2659605 | − | GENE_02582 | Prodigal: 2.6 | CDS | — | — | — | — | O34742 | opuCD_1 | — | — | Glycine betaine/carnitine/choline transport system permease protein OpuCD |
| Contig1 | 2659624 | 2660541 | − | GENE_02583 | Prodigal: 2.6 | CDS | — | — | — | — | Q45462 | opuBC | — | — | Choline-binding protein precursor |
| Contig1 | 2660556 | 2661209 | − | GENE_02584 | Prodigal: 2.6 | CDS | — | — | — | — | O34878 | opuCB_1 | — | — | Glycine betaine/carnitine/choline transport system permease protein OpuCB |
| Contig1 | 2661226 | 2662371 | − | GENE_02585 | Prodigal: 2.6 | CDS | — | — | — | — | Q45460 | opuBA | — | — | Choline transport ATP-binding protein OpuBA |
| Contig1 | 2662657 | 2663190 | + | GENE_02586 | Prodigal: 2.6 | CDS | — | — | — | — | O34709 | opcR_2 | — | — | HTH-type transcriptional repressor OpcR |
| Contig1 | 2663224 | 2663898 | − | GENE_02587 | Prodigal: 2.6 | CDS | — | — | — | — | O34742 | opuCD_2 | — | — | Glycine betaine/carnitine/choline transport system permease protein OpuCD |
| Contig1 | 2663916 | 2664833 | − | GENE_02588 | Prodigal: 2.6 | CDS | — | — | — | — | O32243 | opuCC | — | — | Glycine betaine/carnitine/choline-binding protein OpuCC precursor |
| Contig1 | 2664847 | 2665500 | − | GENE_02589 | Prodigal: 2.6 | CDS | — | — | — | — | O34878 | opuCB_2 | — | — | Glycine betaine/carnitine/choline transport system permease protein OpuCB |
| Contig1 | 2665521 | 2666660 | − | GENE_02590 | Prodigal: 2.6 | CDS | — | — | — | — | O34992 | opuCA | — | — | Glycine betaine/carnitine/choline transport ATP-binding protein OpuCA |
| Contig1 | 2666921 | 2667478 | + | GENE_02591 | Prodigal: 2.6 | CDS | — | — | — | — | O34709 | opcR_3 | — | — | HTH-type transcriptional repressor OpcR |
| Contig1 | 2667499 | 2668131 | + | GENE_02592 | Prodigal: 2.6 | CDS | — | PRK11111 | — | — | — | — | — | — | hypothetical protein |
| Contig1 | 2668570 | 2669280 | + | GENE_02593 | Prodigal: 2.6 | CDS | — | — | — | — | — | — | — | — | hypothetical protein |
| Contig1 | 2669319 | 2671097 | + | GENE_02594 | Prodigal: 2.6 | CDS | — | — | — | — | — | — | — | — | hypothetical protein |
| Contig1 | 2671230 | 2671691 | + | GENE_02595 | Prodigal: 2.6 | CDS | 2.3.1.- | — | — | — | O32248 | yvbK | — | — | putative N-acetyl-transferase YvbK |
| Contig1 | 2671734 | 2672969 | − | GENE_02596 | Prodigal: 2.6 | CDS | — | — | — | — | P39642 | bacE_1 | — | — | Putative bacilysin exporter BacE |
| Contig1 | 2672944 | 2673864 | − | GENE_02597 | Prodigal: 2.6 | CDS | — | — | PF01261.18 | — | — | — | — | — | Xylose isomerase-like TIM barrel |
| Contig1 | 2673872 | 2674549 | − | GENE_02598 | Prodigal: 2.6 | CDS | 3.5.1.103 | — | — | MF_01696 | — | mshB_3 | — | — | 1D-myo-inositol 2-acetamido-2-deoxy-alpha-D-glucopyranoside deacetylase |
| Contig1 | 2674512 | 2675246 | − | GENE_02599 | Prodigal: 2.6 | CDS | — | — | PF08889.5 | — | — | — | — | — | WbqC-like protein family protein |
| Contig1 | 2675243 | 2676136 | − | GENE_02600 | Prodigal: 2.6 | CDS | — | — | — | — | — | — | — | — | FemAB family protein |
| Contig1 | 2676136 | 2677392 | − | GENE_02601 | Prodigal: 2.6 | CDS | 2.6.1.100 | — | PF02388.10 | — | Q8G8Y2 | btrR | — | — | L-glutamine:2-deoxy-scyllo-inosose aminotransferase |
| Contig1 | 2677358 | 2678287 | − | GENE_02602 | Prodigal: 2.6 | CDS | 4.2.1.46 | — | — | — | P29782 | strE | — | — | dTDP-glucose 4,6-dehydratase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2678284 | 2679414 | − | GENE_02603 | Prodigal: 2.6 | CDS | 2.6.1.87 | — | — | — | Q8ZNF3 | arnB_1 | — | — | UDP-4-amino-4-deoxy-L-arabinose--oxoglutarate aminotransferase |
| Contig1 | 2679463 | 2680797 | − | GENE_02604 | Prodigal: 2.6 | CDS | 1.1.1.136 | — | — | — | G3XD94 | wbpA | — | — | UDP-N-acetyl-D-glucosamine 6-dehydrogenase |
| Contig1 | 2681064 | 2682344 | − | GENE_02605 | Prodigal: 2.6 | CDS | 3.4.11.6 | — | — | — | P25152 | ywaD | — | — | Aminopeptidase YwaD precursor |
| Contig1 | 2682513 | 2683805 | − | GENE_02606 | Prodigal: 2.6 | CDS | 4.2.1.11 | — | — | — | P37869 | eno | — | — | Enolase |
| Contig1 | 2683833 | 2685368 | − | GENE_02607 | Prodigal: 2.6 | CDS | 5.4.2.12 | — | — | — | P39773 | gpmI | — | — | 2,3-bisphosphoglycerate-independent phosphoglycerate mutase |
| Contig1 | 2685361 | 2686122 | − | GENE_02608 | Prodigal: 2.6 | CDS | 5.3.1.1 | — | — | — | P27876 | tpiA | — | — | Triosephosphate isomerase |
| Contig1 | 2686148 | 2687332 | − | GENE_02609 | Prodigal: 2.6 | CDS | 27.2.3 | — | — | — | P40924 | pgk | — | — | Phosphoglycerate kinase |
| Contig1 | 2687654 | 2688661 | − | GENE_02610 | Prodigal: 2.6 | CDS | 1.2.1.12 | — | — | — | P09124 | gapA | — | — | Glyceraldehyde-3-phosphate dehydrogenase 1 |
| Contig1 | 2688695 | 2689729 | − | GENE_02611 | Prodigal: 2.6 | CDS | — | — | — | — | O32253 | cggR | — | — | Central glycolytic genes regulator |
| Contig1 | 2689857 | 2689997 | − | GENE_02612 | Prodigal: 2.6 | CDS | — | — | — | — | — | — | — | — | hypothetical protein |
| Contig1 | 2689994 | 2691388 | − | GENE_02613 | Prodigal: 2.6 | CDS | — | — | — | — | P96710 | araE | — | — | Arabinose-proton symporter |
| Contig1 | 2691645 | 2692733 | + | GENE_02614 | Prodigal: 2.6 | CDS | — | — | — | — | P96711 | araR | — | — | Arabinose metabolism transcriptional repressor |
| Contig1 | 2692763 | 2694046 | − | GENE_02615 | Prodigal: 2.6 | CDS | — | — | — | — | — | — | — | — | hypothetical protein |
| Contig1 | 2694169 | 2695173 | − | GENE_02616 | Prodigal: 2.6 | CDS | 1.14.14.3 | — | — | — | P07740 | luxA_1 | — | — | Alkanal monooxygenase alpha chain |
| Contig1 | 2695449 | 2695856 | + | GENE_02617 | Prodigal: 2.6 | CDS | — | — | — | — | — | — | — | — | hypothetical protein |
| Contig1 | 2695888 | 2696766 | − | GENE_02618 | Prodigal: 2.6 | CDS | — | — | — | — | P06614 | cysB_2 | — | — | HTH-type transcriptional regulator CysB |
| Contig1 | 2696864 | 2697781 | + | GENE_02619 | Prodigal: 2.6 | CDS | — | — | — | — | P31125 | eamA | — | — | putative amino-acid metabolite efflux pump |
| Contig1 | 2697816 | 2699156 | + | GENE_02620 | Prodigal: 2.6 | CDS | — | — | — | — | P46349 | gabP_2 | — | — | GABA permease |
| Contig1 | 2700090 | 2701397 | + | GENE_02621 | Prodigal: 2.6 | CDS | — | — | — | — | — | — | — | — | hypothetical protein |
| Contig1 | 2701427 | 2702401 | − | GENE_02622 | Prodigal: 2.6 | CDS | — | — | — | — | P25144 | ccpA_3 | — | — | Catabolite control protein A |
| Contig1 | 2702469 | 2703137 | − | GENE_02623 | Prodigal: 2.6 | CDS | — | — | — | — | — | — | — | — | hypothetical protein |
| Contig1 | 2703134 | 2704021 | − | GENE_02624 | Prodigal: 2.6 | CDS | 3.1.3.- | — | — | — | P94592 | ywpJ_1 | — | — | Putative phosphatase YwpJ |
| Contig1 | 2704458 | 2705315 | + | GENE_02625 | Prodigal: 2.6 | CDS | — | — | — | — | Q45581 | ybbH2 | — | — | putative HTH-type transcriptional regulator YbbH |
| Contig1 | 2705488 | 2707032 | + | GENE_02626 | Prodigal: 2.6 | CDS | 2.7.1.17 | — | — | — | P35850 | xylB_2 | — | — | Xylulose kinase |
| Contig1 | 2707059 | 2708387 | + | GENE_02627 | Prodigal: 2.6 | CDS | — | — | — | — | P39344 | idnT | — | — | Gnt-II system L-idonate transporter |
| Contig1 | 2708423 | 2709142 | − | GENE_02628 | Prodigal: 2.6 | CDS | — | — | — | — | O32259 | lutC | — | — | Lactate utilization protein C |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2709145 | 2710575 | − | GENE_02629 | Prodigal: 2.6 | CDS | — | — | — | — | O07021 | lutB | — | — | Lactate utilization protein B |
| Contig1 | 2710603 | 2711319 | − | GENE_02630 | Prodigal: 2.6 | CDS | — | — | — | — | O07020 | lutA_2 | — | — | Lactate utilization protein A |
| Contig1 | 2711500 | 2712690 | − | GENE_02631 | Prodigal: 2.6 | CDS | 2.6.1.39 | — | — | — | Q72LL6 | lysN | — | — | 2-aminoadipate transaminase |
| Contig1 | 2712721 | 2713449 | − | GENE_02632 | Prodigal: 2.6 | CDS | — | — | — | — | O07007 | lutR | — | — | HTH-type transcriptional regulator LutR |
| Contig1 | 2713646 | 2715322 | + | GENE_02633 | Prodigal: 2.6 | CDS | — | — | — | — | P71067 | lutP | — | — | L-lactate permease |
| Contig1 | 2715360 | 2716670 | − | GENE_02634 | Prodigal: 2.6 | CDS | — | — | — | — | P0A171 | rpoN | — | — | RNA polymerase sigma-54 factor |
| Contig1 | 2716748 | 2716966 | + | GENE_02635 | Prodigal: 2.6 | CDS | — | — | PF09628.4 | — | — | — | — | — | YvrG protein |
| Contig1 | 2716980 | 2717945 | − | GENE_02636 | Prodigal: 2.6 | CDS | 2.-.-.- | — | — | — | P71065 | epsO | — | — | Putative pyruvyl transferase EpsO |
| Contig1 | 2717924 | 2719096 | − | GENE_02637 | Prodigal: 2.6 | CDS | 2.6.1.- | — | — | — | Q79SJ3 | epsN | — | — | Putative pyridoxal phosphate-dependent aminotransferase EpsN |
| Contig1 | 2719101 | 2719748 | − | GENE_02638 | Prodigal: 2.6 | CDS | 2.3.1.- | — | — | — | P71063 | epsM | — | — | Putative acetyltransferase EpsM |
| Contig1 | 2719745 | 2720353 | − | GENE_02639 | Prodigal: 2.6 | CDS | 2.-.-.- | — | — | — | P71062 | epsL | — | — | putative sugar transferase EpsL |
| Contig1 | 2720350 | 2721867 | − | GENE_02640 | Prodigal: 2.6 | CDS | — | — | — | — | P71060 | epsK | — | — | putative membrane protein EpsK |
| Contig1 | 2721864 | 2722898 | − | GENE_02641 | Prodigal: 2.6 | CDS | 2.4.-.- | — | — | — | P71059 | epsJ | — | — | putative glycosyltransferase EpsJ |
| Contig1 | 2722895 | 2723971 | − | GENE_02642 | Prodigal: 2.6 | CDS | 2.-.-.- | — | — | — | P71058 | epsI | — | — | Putative pyruvyl transferase EpsI |
| Contig1 | 2723976 | 2725013 | − | GENE_02643 | Prodigal: 2.6 | CDS | 2.4.-.- | — | — | — | P71057 | epsH | — | — | Putative glycosyltransferase EpsH |
| Contig1 | 2725032 | 2726135 | − | GENE_02644 | Prodigal: 2.6 | CDS | — | — | — | — | P71056 | epsG | — | — | Transmembrane protein EpsG |
| Contig1 | 2726139 | 2727275 | − | GENE_02645 | Prodigal: 2.6 | CDS | 2.4.-.- | — | — | — | P71055 | epsF_2 | — | — | Putative glycosyltransferase EpsF |
| Contig1 | 2727268 | 2728110 | − | GENE_02646 | Prodigal: 2.6 | CDS | 2.4.-.- | — | — | — | P71054 | epsE | — | — | Putative glycosyltransferase EpsE |
| Contig1 | 2728107 | 2729246 | − | GENE_02647 | Prodigal: 2.6 | CDS | 2.4.-.- | — | — | — | P71053 | epsD | — | — | Putative glycosyltransferase EpsD |
| Contig1 | 2729262 | 2731079 | − | GENE_02648 | Prodigal: 2.6 | CDS | 4.2.1.135 | — | — | — | Q0P9D4 | pglF | — | — | UDP-N-acetyl-alpha-D-glucosamine C6 dehydratase |
| Contig1 | 2731300 | 2731980 | − | GENE_02649 | Prodigal: 2.6 | CDS | 2.7.10.2 | — | — | — | P96716 | ywqD_1 | — | — | Tyrosine-protein kinase YwqD |
| Contig1 | 2731986 | 2732693 | − | GENE_02650 | Prodigal: 2.6 | CDS | — | — | — | — | P72367 | cap8A_1 | — | — | Capsular polysaccharide type 8 biosynthesis protein cap8A |
| Contig1 | 2732936 | 2733391 | + | GENE_02651 | Prodigal: 2.6 | CDS | — | — | — | — | P06533 | sinR_2 | — | — | HTH-type transcriptional regulator SinR |
| Contig1 | 2733472 | 2734920 | + | GENE_02652 | Prodigal: 2.6 | CDS | 3.1.1.- | — | — | — | P37967 | pnbA | — | — | Para-nitrobenzyl esterase |
| Contig1 | 2735072 | 2735272 | + | GENE_02653 | Prodigal: 2.6 | CDS | — | — | — | — | — | — | — | — | hypothetical protein |
| Contig1 | 2735304 | 2735834 | − | GENE_02654 | Prodigal: 2.6 | CDS | 1.5.1.3 | — | — | — | Q60034 | folA | — | — | Dihydrofolate reductase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2735913 | 2736542 | − | GENE_02655 | Prodigal: 2.6 | CDS | — | — | — | — | — | — | — | — | hypothetical protein |
| Contig1 | 2736677 | 2737195 | + | GENE_02656 | Prodigal: 2.6 | CDS | 2.3.1.- | — | — | — | P21340 | paiA_2 | — | — | Protease synthase and sporulation negative regulatory protein PAI 1 |
| Contig1 | 2737235 | 2737723 | − | GENE_02657 | Prodigal: 2.6 | CDS | 4.1.1.- | — | — | — | O07006 | padC | — | — | Phenolic acid decarboxylase PadC |
| Contig1 | 2738143 | 2738427 | − | GENE_02658 | Prodigal: 2.6 | CDS | — | — | — | — | — | — | — | — | hypothetical protein |
| Contig1 | 2738559 | 2738816 | − | GENE_02659 | Prodigal: 2.6 | CDS | — | — | — | — | — | — | — | — | hypothetical protein |
| Contig1 | 2738966 | 2739277 | + | GENE_02660 | Prodigal: 2.6 | CDS | — | — | — | — | — | — | — | — | hypothetical protein |
| Contig1 | 2739671 | 2739928 | − | GENE_02661 | Prodigal: 2.6 | CDS | — | — | — | — | — | — | — | — | hypothetical protein |
| Contig1 | 2740643 | 2740930 | − | GENE_02662 | Prodigal: 2.6 | CDS | — | — | — | — | — | — | — | — | hypothetical protein |
| Contig1 | 2741133 | 2741330 | + | GENE_02663 | Prodigal: 2.6 | CDS | — | — | — | — | — | — | — | — | hypothetical protein |
| Contig1 | 2741355 | 2741699 | − | GENE_02664 | Prodigal: 2.6 | CDS | — | — | — | — | — | — | — | — | hypothetical protein |
| Contig1 | 2741753 | 2743174 | + | GENE_02665 | Prodigal: 2.6 | CDS | — | — | — | — | — | — | — | — | hypothetical protein |
| Contig1 | 2743191 | 2743502 | + | GENE_02666 | Prodigal: 2.6 | CDS | — | — | — | — | — | — | — | — | hypothetical protein |
| Contig1 | 2743559 | 2743637 | − | GENE_02667 | Aragorn: 1.2 | tRNA | — | — | — | — | — | — | — | — | tRNA-Arg(ccg) |
| Contig1 | 2743851 | 2745320 | − | GENE_02668 | Prodigal: 2.6 | CDS | 3.2.1.26 | — | — | — | P0DJA7 | sacA | — | — | Sucrose-6-phosphate hydrolase |
| Contig1 | 2745335 | 2746567 | − | GENE_02669 | Prodigal: 2.6 | CDS | — | — | — | — | P02920 | lacY | — | — | Lactose permease |
| Contig1 | 2746958 | 2747932 | + | GENE_02670 | Prodigal: 2.6 | CDS | — | — | — | — | P37947 | degA_2 | — | — | HTH-type transcriptional regulator DegA |
| Contig1 | 2748180 | 2748776 | + | GENE_02671 | Prodigal: 2.6 | CDS | 3.4.21.92 | — | — | — | P80244 | dpP | — | — | ATP-dependent Clp protease proteolytic subunit |
| Contig1 | 2748820 | 2749680 | − | GENE_02672 | Prodigal: 2.6 | CDS | — | — | — | — | O34685 | yofA_2 | — | — | HTH-type transcriptional regulator YofA |
| Contig1 | 2749854 | 2750984 | + | GENE_02673 | Prodigal: 2.6 | CDS | 5.3.3.6 | — | — | — | Q0QLE6 | mii | — | — | 3-methylitaconate isomerase |
| Contig1 | 2751027 | 2752403 | + | GENE_02674 | Prodigal: 2.6 | CDS | — | — | — | — | P38055 | ydjE_1 | — | — | Inner membrane metabolite transport protein YdjE |
| Contig1 | 2752615 | 2753190 | − | GENE_02675 | Prodigal: 2.6 | CDS | — | — | — | — | O06986 | yvdD | — | — | LOG family protein YvdD |
| Contig1 | 2753306 | 2753626 | + | GENE_02676 | Prodigal: 2.6 | CDS | — | — | PF03819.11 | — | — | — | — | — | MazG nucleotide pyrophosphohydrolase domain protein |
| Contig1 | 2753671 | 2755260 | − | GENE_02677 | Prodigal: 2.6 | CDS | — | — | — | — | P0AFR2 | dauA_1 | — | — | C4-dicarboxylic acid transporter DauA |
| Contig1 | 2755263 | 2755844 | − | GENE_02678 | Prodigal: 2.6 | CDS | 4.2.1.1 | — | — | — | P64797 | mtcA1_2 | — | — | Beta-carbonic anhydrase 1 |
| Contig1 | 2756245 | 2757210 | + | GENE_02679 | Prodigal: 2.6 | CDS | 1.1.1.79 | — | — | — | P37666 | ghrB | — | — | Glyoxylate/hydroxy-pyruvate reductase B |
| Contig1 | 2757331 | 2757804 | + | GENE_02680 | Prodigal: 2.6 | CDS | 3.1.27.- | — | — | — | P00648 | — | — | — | Ribonuclease precursor |
| Contig1 | 2757864 | 2758055 | − | GENE_02681 | Prodigal: 2.6 | CDS | — | — | — | — | — | — | — | — | hypothetical protein |
| Contig1 | 2758325 | 2759101 | − | GENE_02682 | Prodigal: 2.6 | CDS | — | — | — | — | — | — | — | — | hypothetical protein |
| Contig1 | 2759367 | 2760113 | − | GENE_02683 | Prodigal: 2.6 | CDS | 2.3.1.118 | — | — | — | Q00267 | nhoA | — | — | N-hydroxyarylamine O-acetyltransferase |
| Contig1 | 2760138 | 2760395 | − | GENE_02684 | Prodigal: 2.6 | CDS | — | — | — | — | O06976 | crh | — | — | HPr-like protein Crh |
| Contig1 | 2760419 | 2761369 | − | GENE_02685 | Prodigal: 2.6 | CDS | — | — | — | — | Q9Z515 | whiA | — | — | Sporulation transcription regulator WhiA |
| Contig1 | 2761396 | 2762349 | − | GENE_02686 | Prodigal: 2.6 | CDS | — | — | — | — | Q9K706 | — | — | — | Gluconeogenesis factor |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2762346 | 2763233 | − | GENE_02687 | Prodigal: 2.6 | CDS | — | PRK05416 | — | — | — | — | — | — | glmZ(sRNA)-inactivating NTPase |
| Contig1 | 2763259 | 2763753 | − | GENE_02688 | Prodigal: 2.6 | CDS | 3.6.1.55 | — | — | — | P41354 | mutX | — | — | 8-oxo-dGTP diphosphatase |
| Contig1 | 2764000 | 2764953 | − | GENE_02689 | Prodigal: 2.6 | CDS | 1.8.1.9 | — | — | — | P80880 | trxB | — | — | Thioredoxin reductase |
| Contig1 | 2765157 | 2766569 | − | GENE_02690 | Prodigal: 2.6 | CDS | 3.4.-.- | — | — | — | P40767 | cwlO | — | — | Peptidoglycan DL-endopeptidase CwlO precursor |
| Contig1 | 2766967 | 2768421 | − | GENE_02691 | Prodigal: 2.6 | CDS | — | — | PF07719.11 | — | — | — | — | — | Tetratricopeptide repeat protein |
| Contig1 | 2768537 | 2769598 | − | GENE_02692 | Prodigal: 2.6 | CDS | 2.7.13.3 | — | — | — | P23545 | phoR_2 | — | — | Alkaline phosphatase synthesis sensor protein PhoR |
| Contig1 | 2769595 | 2770272 | − | GENE_02693 | Prodigal: 2.6 | CDS | — | — | — | — | A6QJK3 | hssR | — | — | Heme response regulator HssR |
| Contig1 | 2770309 | 2770926 | − | GENE_02694 | Prodigal: 2.6 | CDS | — | — | — | — | — | — | — | — | hypothetical protein |
| Contig1 | 2771015 | 2772784 | − | GENE_02695 | Prodigal: 2.6 | CDS | 3.6.3.- | — | — | — | O06967 | bmrA | — | — | Multidrug resistance ABC transporter ATP-binding/permease protein BmrA |
| Contig1 | 2772995 | 2773615 | − | GENE_02696 | Prodigal: 2.6 | CDS | 3.6.1.31 | — | — | — | Q81G00 | hisE | — | — | Phosphoribosyl-ATP pyrophosphatase |
| Contig1 | 2773612 | 2774370 | − | GENE_02697 | Prodigal: 2.6 | CDS | 4.1.3.- | — | — | — | Q7SIB9 | hisF | — | — | Imidazole glycerol phosphate synthase subunit HisF |
| Contig1 | 2774367 | 2775104 | − | GENE_02698 | Prodigal: 2.6 | CDS | 5.3.1.16 | — | — | — | Q4KJS5 | hisA | — | — | 1-(5-phosphoribosyl)-5-[(5-phosphoribosylamino) methylideneamino] imidazole-4-carboxamide isomerase |
| Contig1 | 2775101 | 2775739 | − | GENE_02699 | Prodigal: 2.6 | CDS | 2.4.2.- | — | — | — | Q0P8U2 | hisH1 | — | — | Imidazole glycerol phosphate synthase subunit HisH 1 |
| Contig1 | 2775740 | 2776324 | − | GENE_02700 | Prodigal: 2.6 | CDS | 4.2.1.19 | — | — | — | Q98CT7 | hisB | — | — | Imidazoleglycerol-phosphate dehydratase |
| Contig1 | 2776290 | 2777603 | − | GENE_02701 | Prodigal: 2.6 | CDS | 1.1.1.23 | — | — | — | Q4KI73 | hisD | — | — | Histidinol dehydrogenase |
| Contig1 | 2777600 | 2778241 | − | GENE_02702 | Prodigal: 2.6 | CDS | 2.4.2.17 | — | — | — | O34520 | hisG | — | — | ATP phosphoribosyltransferase |
| Contig1 | 2778234 | 2779406 | − | GENE_02703 | Prodigal: 2.6 | CDS | — | — | — | — | Q9K6Z0 | hisZ | — | — | ATP phosphoribosyltransferase regulatory subunit |
| Contig1 | 2779648 | 2780373 | + | GENE_02704 | Prodigal: 2.6 | CDS | — | — | — | — | — | — | — | — | hypothetical protein |
| Contig1 | 2780391 | 2780909 | − | GENE_02705 | Prodigal: 2.6 | CDS | 2.3.1.89 | — | — | — | Q7A2S0 | dapH_3 | — | — | 2,3,4,5-tetrahydro-pyridine-2,6-dicarboxylate N-acetyltransferase |
| Contig1 | 2780913 | 2781563 | − | GENE_02706 | Prodigal: 2.6 | CDS | 3.6.1.1 | — | — | — | Q9JMQ2 | ppaX | — | — | Pyrophosphatase PpaX |
| Contig1 | 2781589 | 2782404 | − | GENE_02707 | Prodigal: 2.6 | CDS | 2.4.99.- | — | — | — | O34752 | lgt | — | — | Prolipoprotein diacylglyceryl transferase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2782419 | 2783351 | − | GENE_02708 | Prodigal: 2.6 | CDS | 2.7.11.- | | | | O34483 | hprK | | | HPr kinase/phosphorylase |
| Contig1 | 2783521 | 2784711 | + | GENE_02709 | Prodigal: 2.6 | CDS | 3.5.1.25 | | | | O34450 | nagA | | | N-acetylglucosamine-6-phosphate deacetylase |
| Contig1 | 2784708 | 2785433 | + | GENE_02710 | Prodigal: 2.6 | CDS | 3.5.99.6 | | | | O35000 | nagB | | | Glucosamine-6-phosphate deaminase 1 |
| Contig1 | 2785447 | 2786178 | + | GENE_02711 | Prodigal: 2.6 | CDS | | | | | O34817 | yvoA_2 | | | HTH-type transcriptional repressor YvoA |
| Contig1 | 2786323 | 2786898 | − | GENE_02712 | Prodigal: 2.6 | CDS | | | | | P42105 | yxaF_1 | | | putative HTH-type transcriptional regulator YxaF |
| Contig1 | 2787056 | 2790925 | − | GENE_02713 | Prodigal: 2.6 | CDS | | | PF00149.22 | | | | | | Calcineurin-like phosphoesterase |
| Contig1 | 2791019 | 2791378 | − | GENE_02714 | Prodigal: 2.6 | CDS | | PRK10697 | PF04020.7 | | | | | | Membrane protein of unknown function |
| Contig1 | 2791379 | 2791573 | − | GENE_02715 | Prodigal: 2.6 | CDS | | | | | | | | | DNA-binding transcriptional activator PspC |
| Contig1 | 2791578 | 2792675 | − | GENE_02716 | Prodigal: 2.6 | CDS | | | | | | | | | hypothetical protein |
| Contig1 | 2792700 | 2793026 | − | GENE_02717 | Prodigal: 2.6 | CDS | | | | | | | | | hypothetical protein |
| Contig1 | 2793225 | 2793464 | + | GENE_02718 | Prodigal: 2.6 | CDS | | | | | | | | | hypothetical protein |
| Contig1 | 2793513 | 2796386 | − | GENE_02719 | Prodigal: 2.6 | CDS | | | | | P63383 | uvrA | | | UvrABC system protein A |
| Contig1 | 2796394 | 2798379 | − | GENE_02720 | Prodigal: 2.6 | CDS | | | | | P37954 | uvrB_1 | | | UvrABC system protein B |
| Contig1 | 2798555 | 2798791 | − | GENE_02721 | Prodigal: 2.6 | CDS | | | | | | | | | hypothetical protein |
| Contig1 | 2799091 | 2801592 | + | GENE_02722 | Prodigal: 2.6 | CDS | | | | | Q0VZ70 | cmdD_2 | | | Chondramide synthase cmdD |
| Contig1 | 2801661 | 2802287 | + | GENE_02723 | Prodigal: 2.6 | CDS | | | | | P28815 | tetC1 | | | Transposon Tn10 TetC protein |
| Contig1 | 2802260 | 2803597 | + | GENE_02724 | Prodigal: 2.6 | CDS | | | | | P0A0J9 | qacA_2 | | | Antiseptic resistance protein |
| Contig1 | 2804265 | 2804888 | − | GENE_02725 | Prodigal: 2.6 | CDS | 1.1.-.- | | | | Q70LM8 | lgrE_1 | | | Linear gramicidin dehydrogenase LgrE |
| Contig1 | 2805053 | 2806120 | − | GENE_02726 | Prodigal: 2.6 | CDS | | | | | | | | | hypothetical protein |
| Contig1 | 2806399 | 2807589 | − | GENE_02727 | Prodigal: 2.6 | CDS | | | | | O34375 | minJ | | | Cell division topological determinant MinJ |
| Contig1 | 2807664 | 2807999 | − | GENE_02728 | Prodigal: 2.6 | CDS | | | | | | | | | hypothetical protein |
| Contig1 | 2808390 | 2809790 | − | GENE_02729 | Prodigal: 2.6 | CDS | 3.4.21.102 | | | | O35002 | ctpB | | | Carboxy-terminal processing protease CtpB precursor |
| Contig1 | 2809958 | 2811364 | + | GENE_02730 | Prodigal: 2.6 | CDS | | | | | | | | | hypothetical protein |
| Contig1 | 2811411 | 2812301 | − | GENE_02731 | Prodigal: 2.6 | CDS | | | | | O34876 | ftsX | | | Cell division protein FtsX |
| Contig1 | 2812294 | 2812980 | − | GENE_02732 | Prodigal: 2.6 | CDS | | | | | O34814 | ftsE | | | Cell division ATP-binding protein FtsE |
| Contig1 | 2813199 | 2813540 | − | GENE_02733 | Prodigal: 2.6 | CDS | | | | | O34594 | cccB | | | Cytochrome c-551 precursor |
| Contig1 | 2813576 | 2814424 | − | GENE_02734 | Prodigal: 2.6 | CDS | | | | | | | | | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2814593 | 2815576 | − | GENE_02735 | Prodigal: 2.6 | CDS | — | — | — | — | Q7A6R4 | prfB | — | — | Peptide chain release factor 2 |
| Contig1 | 2815768 | 2818293 | − | GENE_02736 | Prodigal: 2.6 | CDS | — | — | — | MF_01382 | — | secA | — | — | Protein translocase subunit SecA |
| Contig1 | 2818460 | 2819026 | − | GENE_02737 | Prodigal: 2.6 | CDS | — | — | — | — | P28368 | yvyD | — | — | Putative sigma-54 modulation protein |
| Contig1 | 2819221 | 2819598 | − | GENE_02738 | Prodigal: 2.6 | CDS | — | — | — | — | — | — | — | — | hypothetical protein |
| Contig1 | 2819608 | 2819952 | − | GENE_02739 | Prodigal: 2.6 | CDS | — | — | PF05400.7 | — | — | — | — | — | Flagellar protein FliT |
| Contig1 | 2819952 | 2820353 | − | GENE_02740 | Prodigal: 2.6 | CDS | — | — | — | — | P39739 | fliS | — | — | Flagellar protein FliS |
| Contig1 | 2820373 | 2821893 | − | GENE_02741 | Prodigal: 2.6 | CDS | — | — | — | — | P24216 | fliD | — | — | Flagellar hook-associated protein 2 |
| Contig1 | 2822143 | 2822973 | − | GENE_02742 | Prodigal: 2.6 | CDS | — | — | — | — | P02968 | hag | — | — | Flagellin |
| Contig1 | 2823118 | 2823342 | − | GENE_02743 | Prodigal: 2.6 | CDS | — | — | — | — | P33911 | — | — | Carbon storage regulator homolog | hypothetical protein |
| Contig1 | 2823336 | 2823767 | − | GENE_02744 | Prodigal: 2.6 | CDS | — | — | — | — | — | — | — | — | Flagellar assembly factor FliW |
| Contig1 | 2823797 | 2824366 | − | GENE_02745 | Prodigal: 2.6 | CDS | — | — | — | — | — | — | — | — | hypothetical protein |
| Contig1 | 2824457 | 2825374 | − | GENE_02746 | Prodigal: 2.6 | CDS | — | — | — | — | P96503 | fliW | — | — | Flagellar hook-associated protein 3 |
| Contig1 | 2825386 | 2826903 | − | GENE_02747 | Prodigal: 2.6 | CDS | — | — | — | — | P29744 | flgL | — | — | Flagellar hook-associated protein 1 |
| Contig1 | 2826919 | 2827401 | − | GENE_02748 | Prodigal: 2.6 | CDS | — | — | PF05130.6 | — | P0A1J5 | flgK | — | — | FlgN protein |
| Contig1 | 2827416 | 2827682 | − | GENE_02749 | Prodigal: 2.6 | CDS | — | — | PF04316.7 | — | — | — | — | — | Anti-sigma-28 factor, FlgM |
| Contig1 | 2827752 | 2828171 | − | GENE_02750 | Prodigal: 2.6 | CDS | — | — | — | — | — | — | — | — | hypothetical protein |
| Contig1 | 2828245 | 2828721 | − | GENE_02751 | Prodigal: 2.6 | CDS | — | — | — | MF_00583_A | — | prs_1 | — | — | Ribose-phosphate pyrophosphokinase |
| Contig1 | 2828940 | 2829224 | − | GENE_02752 | Prodigal: 2.6 | CDS | — | — | PF10719.3 | — | — | — | — | — | Late competence development protein ComFB |
| Contig1 | 2829282 | 2830667 | − | GENE_02753 | Prodigal: 2.6 | CDS | — | — | — | MF_00204 | — | uvrB_2 | — | — | UvrABC system protein B |
| Contig1 | 2830775 | 2831623 | − | GENE_02754 | Prodigal: 2.6 | CDS | — | — | — | — | P0A0N0 | — | — | — | DegV domain-containing protein |
| Contig1 | 2831721 | 2832410 | − | GENE_02755 | Prodigal: 2.6 | CDS | — | — | — | — | P13800 | degU_2 | — | — | Transcriptional regulatory protein DegU |
| Contig1 | 2832487 | 2833650 | − | GENE_02756 | Prodigal: 2.6 | CDS | 2.7.13.3 | — | — | — | P13799 | degS | — | — | Signal transduction histidine-protein kinase/phosphatase DegS |
| Contig1 | 2833873 | 2834520 | + | GENE_02757 | Prodigal: 2.6 | CDS | — | — | — | — | P27862 | yigZ | — | — | IMPACT family member YigZ |
| Contig1 | 2834525 | 2835700 | + | GENE_02758 | Prodigal: 2.6 | CDS | — | — | — | — | P96499 | yvhJ | — | — | Putative transcriptional regulator YvhJ |
| Contig1 | 2835790 | 2836866 | − | GENE_02759 | Prodigal: 2.6 | CDS | 2.7.8.33 | — | — | — | O34753 | tagO | — | — | putative undecaprenyl-phosphate N-acetylglucosaminyl 1-phosphate transferase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2836999 | 2838195 | − | GENE_02760 | Prodigal: 2.6 | CDS | 2.4.-.- | — | — | — | O32267 | tuaH | — | — | Putative teichuronic acid biosynthesis glycosyltransferase TuaH |
| Contig1 | 2838215 | 2838973 | − | GENE_02761 | Prodigal: 2.6 | CDS | 2.4.-.- | — | — | — | O32268 | tuaG | — | — | Putative teichuronic acid biosynthesis glycosyltransferase TuaG |
| Contig1 | 2838997 | 2839677 | − | GENE_02762 | Prodigal: 2.6 | CDS | — | — | — | — | O32269 | tuaF | — | — | Teichuronic acid biosynthesis protein TuaF |
| Contig1 | 2839674 | 2841092 | − | GENE_02763 | Prodigal: 2.6 | CDS | — | — | — | — | O32270 | tuaE | — | — | Teichuronic acid biosynthesis protein TuaE |
| Contig1 | 2841229 | 2842569 | − | GENE_02764 | Prodigal: 2.6 | CDS | 1.1.1.22 | — | — | — | O32271 | tuaD | — | — | UDP-glucose 6-dehydrogenase TuaD |
| Contig1 | 2842574 | 2843770 | − | GENE_02765 | Prodigal: 2.6 | CDS | 2.4.-.- | — | — | — | O32272 | tuaC | — | — | Putative teichuronic acid biosynthesis glycosyltransferase TuaC |
| Contig1 | 2843767 | 2845215 | − | GENE_02766 | Prodigal: 2.6 | CDS | — | — | — | — | O32273 | tuaB | — | — | Teichuronic acid biosynthesis protein TuaB |
| Contig1 | 2845252 | 2845911 | − | GENE_02767 | Prodigal: 2.6 | CDS | 2.7.8.- | — | — | — | O32274 | tuaA | — | — | Putative undecaprenyl-phosphate N-acetylgalactosaminyl 1-phosphate transferase |
| Contig1 | 2846165 | 2847655 | − | GENE_02768 | Prodigal: 2.6 | CDS | 3.5.1.28 | — | — | — | Q02114 | lytC_3 | — | — | N-acetylmuramoyl-L-alanine amidase LytC precursor |
| Contig1 | 2847681 | 2849798 | − | GENE_02769 | Prodigal: 2.6 | CDS | — | — | — | — | Q02113 | lytB_1 | — | — | Amidase enhancer precursor |
| Contig1 | 2849821 | 2850123 | − | GENE_02770 | Prodigal: 2.6 | CDS | — | — | — | — | Q02112 | lytA | — | — | Membrane-bound protein LytA precursor |
| Contig1 | 2850229 | 2851221 | + | GENE_02771 | Prodigal: 2.6 | CDS | — | — | — | — | Q02115 | lytR_2 | — | — | Transcriptional regulator LytR |
| Contig1 | 2851273 | 2852412 | − | GENE_02772 | Prodigal: 2.6 | CDS | 5.1.3.14 | — | — | — | P39131 | mnaA | — | — | UDP-N-acetylglucosamine 2-epimerase |
| Contig1 | 2852690 | 2853568 | + | GENE_02773 | Prodigal: 2.6 | CDS | 2.7.7.9 | — | — | — | Q05852 | gtaB_2 | — | — | UTP-glucose-1-phosphate uridylyltransferase |
| Contig1 | 2853602 | 2855155 | − | GENE_02774 | Prodigal: 2.6 | CDS | 3.6.3.40 | — | — | — | P42954 | tagH | — | — | Teichoic acids export ATP-binding protein TagH |
| Contig1 | 2855175 | 2856002 | − | GENE_02775 | Prodigal: 2.6 | CDS | — | — | — | — | P42953 | tagG | — | — | Teichoic acid translocation permease protein TagG |
| Contig1 | 2856157 | 2858322 | − | GENE_02776 | Prodigal: 2.6 | CDS | 2.7.8.12 | — | — | — | P13485 | tagF | — | — | CDP-glycerol-poly (glycerophosphate) glycerophosphotransferase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2858372 | 2860390 | − | GENE_02777 | Prodigal: 2.6 | CDS | 2.4.1.52 | — | — | — | P13484 | tagE | — | — | putative poly(glycerol-phosphate) alpha-glucosyltransferase |
| Contig1 | 2860553 | 2860942 | − | GENE_02778 | Prodigal: 2.6 | CDS | 2.7.7.39 | — | — | — | P27623 | tagD | — | — | Glycerol-3-phosphate cytidylyltransferase |
| Contig1 | 2861298 | 2862068 | + | GENE_02779 | Prodigal: 2.6 | CDS | 2.4.1.187 | — | — | — | P27620 | tagA | — | — | Putative N-acetylmannosaminyl-transferase |
| Contig1 | 2862101 | 2863267 | + | GENE_02780 | Prodigal: 2.6 | CDS | 2.7.8.- | — | — | — | P27621 | tagB | — | — | Putative CDP-glycerol:glycerophosphate glycerophosphotransferase |
| Contig1 | 2863328 | 2865973 | − | GENE_02781 | Prodigal: 2.6 | CDS | 3.2.1.96 | — | — | — | P39848 | lytD | — | — | Beta-N-acetylglucosaminidase precursor |
| Contig1 | 2866114 | 2867064 | − | GENE_02782 | Prodigal: 2.6 | CDS | 5.3.1.8 | — | — | — | P39841 | yvyI_2 | — | — | Putative mannose-6-phosphate isomerase YvyI |
| Contig1 | 2867282 | 2868733 | + | GENE_02783 | Prodigal: 2.6 | CDS | — | — | — | — | P39569 | gerBA_1 | — | — | Spore germination protein B1 |
| Contig1 | 2868739 | 2869845 | + | GENE_02784 | Prodigal: 2.6 | CDS | — | — | — | — | P39570 | gerBB | — | — | Spore germination protein B2 |
| Contig1 | 2869842 | 2870099 | + | GENE_02785 | Prodigal: 2.6 | CDS | — | — | — | — | P39571 | gerBC_1 | — | — | Spore germination protein B3 precursor |
| Contig1 | 2870132 | 2870971 | + | GENE_02786 | Prodigal: 2.6 | CDS | — | — | — | — | P39571 | gerBC_2 | — | — | Spore germination protein B3 precursor |
| Contig1 | 2870975 | 2872354 | − | GENE_02787 | Prodigal: 2.6 | CDS | 2.4.1.289 | — | — | — | Q7D5T2 | wbbL | — | — | N-acetylglucosaminyl-diphospho-decaprenol L-rhamnosyltransferase |
| Contig1 | 2872484 | 2873860 | − | GENE_02788 | Prodigal: 2.6 | CDS | — | — | — | — | P46333 | csbC_1 | — | — | putative metabolite transport protein CsbC |
| Contig1 | 2874165 | 2875151 | + | GENE_02789 | Prodigal: 2.6 | CDS | — | — | — | — | Q7WY78 | ywtF | — | — | Putative transcriptional regulator YwtF |
| Contig1 | 2875306 | 2876163 | + | GENE_02790 | Prodigal: 2.6 | CDS | 3.1.3.- | — | — | — | P94592 | ywpJ_2 | — | — | Putative phosphatase YwpJ |
| Contig1 | 2876270 | 2876362 | + | GENE_02791 | Prodigal: 2.6 | CDS | — | — | — | — | — | — | — | — | hypothetical protein |
| Contig1 | 2876462 | 2876992 | + | GENE_02792 | Prodigal: 2.6 | CDS | — | — | — | — | Q795Q5 | yttA | — | — | putative membrane protein YttA |
| Contig1 | 2877031 | 2878266 | − | GENE_02793 | Prodigal: 2.6 | CDS | 3.4.19.- | — | — | — | P96740 | pgdS | — | — | Gamma-DL-glutamyl hydrolase precursor |
| Contig1 | 2878416 | 2878577 | − | GENE_02794 | Prodigal: 2.6 | CDS | — | — | — | — | — | — | — | — | hypothetical protein |
| Contig1 | 2878585 | 2879733 | − | GENE_02795 | Prodigal: 2.6 | CDS | — | — | — | — | P19579 | capA | — | — | Capsule biosynthesis protein CapA |
| Contig1 | 2879752 | 2880201 | − | GENE_02796 | Prodigal: 2.6 | CDS | — | — | — | — | P19581 | capC | — | — | Capsule biosynthesis protein CapC |
| Contig1 | 2880216 | 2881397 | − | GENE_02797 | Prodigal: 2.6 | CDS | — | — | — | — | P19580 | capB | — | — | Capsule biosynthesis protein CapB |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2882137 | 2883606 | + | GENE_02798 | Prodigal: 2.6 | CDS | — | — | — | — | P39569 | gerBA_2 | — | — | Spore germination protein B1 |
| Contig1 | 2883596 | 2884687 | + | GENE_02799 | Prodigal: 2.6 | CDS | — | — | — | — | O31809 | yndE_1 | — | — | Spore germination protein YndE |
| Contig1 | 2884677 | 2885810 | + | GENE_02800 | Prodigal: 2.6 | CDS | — | — | PF05504.5 | — | — | — | — | Spore germination B3/GerAC like, C-terminal | hypothetical protein |
| Contig1 | 2885904 | 2886893 | + | GENE_02801 | Prodigal: 2.6 | CDS | — | — | — | — | P25144 | ccpA_4 | — | — | Catabolite control protein A |
| Contig1 | 2886886 | 2887767 | + | GENE_02802 | Prodigal: 2.6 | CDS | 2.7.1.15 | — | — | — | P0A9J6 | rbsK | — | — | Ribokinase |
| Contig1 | 2887764 | 2888159 | + | GENE_02803 | Prodigal: 2.6 | CDS | 5.5.1.- | — | — | — | P36946 | rbsD | — | — | D-ribose pyranase |
| Contig1 | 2888176 | 2889669 | + | GENE_02804 | Prodigal: 2.6 | CDS | 3.6.3.17 | — | — | — | P04983 | rbsA | — | — | Ribose import ATP-binding protein RbsA |
| Contig1 | 2889659 | 2890630 | + | GENE_02805 | Prodigal: 2.6 | CDS | — | — | — | — | P0AGI1 | rbsC | — | — | Ribose transport system permease protein RbsC |
| Contig1 | 2890644 | 2891561 | + | GENE_02806 | Prodigal: 2.6 | CDS | — | — | — | — | P0A2C5 | rbsB | — | — | D-ribose-binding periplasmic protein precursor |
| Contig1 | 2891622 | 2892155 | + | GENE_02807 | Prodigal: 2.6 | CDS | — | — | — | — | P96729 | ywsB_2 | — | — | Cell wall-binding protein YwsB precursor |
| Contig1 | 2892280 | 2892804 | - | GENE_02808 | Prodigal: 2.6 | CDS | 1.6.99.- | — | — | — | P80871 | ywrO | — | — | General stress protein 14 |
| Contig1 | 2892907 | 2893674 | - | GENE_02809 | Prodigal: 2.6 | CDS | 4.1.1.5 | — | — | — | Q04777 | alsD | — | — | Alpha-acetolactate decarboxylase |
| Contig1 | 2893735 | 2895450 | - | GENE_02810 | Prodigal: 2.6 | CDS | 2.2.1.6 | — | — | — | Q04789 | alsS | — | — | Acetolactate synthase |
| Contig1 | 2895604 | 2896512 | + | GENE_02811 | Prodigal: 2.6 | CDS | — | — | — | — | Q47141 | hcaR | — | — | Hca operon transcriptional activator |
| Contig1 | 2896707 | 2898038 | + | GENE_02812 | Prodigal: 2.6 | CDS | — | — | — | — | P0AB93 | arsB_1 | — | — | Arsenical pump membrane protein |
| Contig1 | 2898088 | 2898762 | - | GENE_02813 | Prodigal: 2.6 | CDS | — | — | — | — | — | — | — | — | hypothetical protein |
| Contig1 | 2898804 | 2899697 | - | GENE_02814 | Prodigal: 2.6 | CDS | — | — | — | — | — | — | — | — | hypothetical protein |
| Contig1 | 2899820 | 2900914 | - | GENE_02815 | Prodigal: 2.6 | CDS | — | — | — | — | Q45535 | cotH | — | — | Inner spore coat protein H |
| Contig1 | 2901055 | 2901621 | + | GENE_02816 | Prodigal: 2.6 | CDS | — | — | — | — | P39801 | cotG | — | — | Spore coat protein G |
| Contig1 | 2901778 | 2902398 | + | GENE_02817 | Prodigal: 2.6 | CDS | — | — | PF01613.12 | — | — | — | — | — | Flavin reductase like domain protein |
| Contig1 | 2902563 | 2902907 | + | GENE_02818 | Prodigal: 2.6 | CDS | — | — | — | — | — | — | — | — | hypothetical protein |
| Contig1 | 2902919 | 2904496 | - | GENE_02819 | Prodigal: 2.6 | CDS | 2.3.2.2 | — | — | — | O05218 | ywrD | — | — | Putative gamma-glutamyltransferase YwrD |
| Contig1 | 2904704 | 2905180 | + | GENE_02820 | Prodigal: 2.6 | CDS | — | — | — | — | P0ACJ0 | lrp_1 | — | — | Leucine-responsive regulatory protein |
| Contig1 | 2905196 | 2905786 | + | GENE_02821 | Prodigal: 2.6 | CDS | — | — | — | — | P14285 | chrA_1 | — | — | Chromate transport protein |
| Contig1 | 2905783 | 2906319 | + | GENE_02822 | Prodigal: 2.6 | CDS | — | — | — | — | P14285 | chrA_2 | — | — | Chromate transport protein |
| Contig1 | 2906346 | 2906564 | - | GENE_02823 | Prodigal: 2.6 | CDS | — | — | — | — | — | — | — | — | hypothetical protein |

TABLE 5-continued

| #ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2906561 | 2907106 | − | GENE_02824 | Prodigal: 2.6 | CDS | 1.-.-.- | — | — | — | P96726 | ywqN | — | — | Putative NAD(P)H-dependent FMN-containing oxido-reductase YwqN |
| Contig1 | 2907229 | 2908110 | + | GENE_02825 | Prodigal: 2.6 | CDS | — | — | — | — | — | gltR | — | — | HTH-type transcriptional regulator GltR |
| Contig1 | 2908197 | 2908913 | − | GENE_02826 | Prodigal: 2.6 | CDS | 3.1.21.7 | — | — | — | P94501 | nfi | — | — | Endonuclease V |
| Contig1 | 2909081 | 2909659 | − | GENE_02827 | Prodigal: 2.6 | CDS | — | — | — | — | P96724 | — | — | — | hypothetical protein |
| Contig1 | 2909948 | 2910253 | − | GENE_02828 | Prodigal: 2.6 | CDS | — | — | — | — | — | — | — | — | hypothetical protein |
| Contig1 | 2910270 | 2912015 | − | GENE_02829 | Prodigal: 2.6 | CDS | 3.1.-.- | — | — | — | P96722 | ywqJ | — | — | Putative ribonuclease YwqJ |
| Contig1 | 2912035 | 2912295 | − | GENE_02830 | Prodigal: 2.6 | CDS | — | — | — | — | — | — | — | — | hypothetical protein |
| Contig1 | 2912295 | 2912729 | − | GENE_02831 | Prodigal: 2.6 | CDS | — | — | — | — | — | — | — | — | hypothetical protein |
| Contig1 | 2912801 | 2912914 | − | GENE_02832 | Prodigal: 2.6 | CDS | — | — | — | — | — | — | — | — | hypothetical protein |
| Contig1 | 2913009 | 2913797 | − | GENE_02833 | Prodigal: 2.6 | CDS | — | — | — | — | — | — | — | — | hypothetical protein |
| Contig1 | 2913861 | 2915186 | − | GENE_02834 | Prodigal: 2.6 | CDS | 1.1.1.22 | — | — | — | P96718 | ywqF | — | — | UDP-glucose 6-dehydrogenase YwqF |
| Contig1 | 2915386 | 2916150 | − | GENE_02835 | Prodigal: 2.6 | CDS | 3.1.3.48 | — | — | — | P96717 | ywqE | — | — | Tyrosine-protein phosphatase YwqE |
| Contig1 | 2916196 | 2916885 | − | GENE_02836 | Prodigal: 2.6 | CDS | 2.7.10.2 | — | — | — | P96716 | ywqD_2 | — | — | Tyrosine-protein kinase YwqD |
| Contig1 | 2916872 | 2917618 | − | GENE_02837 | Prodigal: 2.6 | CDS | — | — | — | — | P72367 | cap8A_2 | — | — | Capsular polysaccharide type 8 biosynthesis protein cap8A |
| Contig1 | 2917834 | 2917980 | − | GENE_02838 | Prodigal: 2.6 | CDS | — | — | — | — | — | — | — | — | hypothetical protein |
| Contig1 | 2918181 | 2919791 | + | GENE_02839 | Prodigal: 2.6 | CDS | — | — | — | — | — | — | — | — | hypothetical protein |
| Contig1 | 2919778 | 2922552 | + | GENE_02840 | Prodigal: 2.6 | CDS | — | — | — | MF_01821 | — | rapA_4 | — | — | RNA polymerase-associated protein RapA |
| Contig1 | 2922666 | 2923523 | − | GENE_02841 | Prodigal: 2.6 | CDS | 3.1.3.- | — | — | — | P94592 | ywpJ_3 | — | — | Putative phosphatase YwpJ |
| Contig1 | 2923520 | 2924302 | − | GENE_02842 | Prodigal: 2.6 | CDS | — | — | — | — | P94591 | glcR | — | — | HTH-type transcriptional repressor GlcR |
| Contig1 | 2924512 | 2924853 | − | GENE_02843 | Prodigal: 2.6 | CDS | — | — | — | — | C0SPB6 | ssbB | — | — | Single-stranded DNA-binding protein SsbB |
| Contig1 | 2924951 | 2925304 | − | GENE_02844 | Prodigal: 2.6 | CDS | — | — | — | — | — | — | — | — | hypothetical protein |
| Contig1 | 2925477 | 2925887 | + | GENE_02845 | Prodigal: 2.6 | CDS | — | — | — | — | — | — | — | — | hypothetical protein |
| Contig1 | 2925932 | 2926327 | − | GENE_02846 | Prodigal: 2.6 | CDS | — | — | — | — | P0A742 | mscL | — | — | Large-conductance mechanosensitive channel |
| Contig1 | 2926384 | 2926809 | − | GENE_02847 | Prodigal: 2.6 | CDS | 4.2.1.59 | — | — | — | P64107 | fabZ_1 | — | — | 3-hydroxyacyl-[acyl-carrier-protein] dehydratase FabZ |
| Contig1 | 2927005 | 2928069 | + | GENE_02848 | Prodigal: 2.6 | CDS | 3.1.-.- | — | — | — | P71002 | rapF_1 | — | — | Response regulator aspartate phosphatase F |
| Contig1 | 2928087 | 2928911 | − | GENE_02849 | Prodigal: 2.6 | CDS | — | — | — | — | P0A1J3 | flgG_2 | — | — | Flagellar basal-body rod protein FlgG |
| Contig1 | 2928933 | 2929730 | − | GENE_02850 | Prodigal: 2.6 | CDS | — | — | — | — | P16323 | flgF | — | — | Flagellar basal-body rod protein FlgF |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2929889 | 2930890 | − | GENE_02851 | Prodigal: 2.6 | CDS | — | — | — | — | P0A9X4 | mreB_3 | — | — | Rod shape-determining protein MreB |
| Contig1 | 2931120 | 2931350 | − | GENE_02852 | Prodigal: 2.6 | CDS | — | — | — | — | P15281 | spoIIID | — | — | Stage III sporulation protein D |
| Contig1 | 2931682 | 2932095 | + | GENE_02853 | Prodigal: 2.6 | CDS | — | — | — | — | Q81RU6 | — | — | — | putative HTH-type transcriptional regulator/GBAA_1941/BAS1801 |
| Contig1 | 2932120 | 2933316 | + | GENE_02854 | Prodigal: 2.6 | CDS | — | — | — | — | Q0GQS6 | pbuE_3 | — | — | Purine efflux pump PbuE |
| Contig1 | 2933353 | 2934807 | − | GENE_02855 | Prodigal: 2.6 | CDS | — | — | — | — | P94575 | pucI_1 | — | — | putative allantoin permease |
| Contig1 | 2934971 | 2936335 | − | GENE_02856 | Prodigal: 2.6 | CDS | — | — | — | — | P71879 | stp_2 | — | — | Multidrug resistance protein stp |
| Contig1 | 2936332 | 2936898 | − | GENE_02857 | Prodigal: 2.6 | CDS | 3.-.-.- | — | — | — | P0ADI7 | yecD_2 | — | — | Isochorismatase family protein YecD |
| Contig1 | 2937151 | 2938362 | + | GENE_02858 | Prodigal: 2.6 | CDS | — | — | — | — | Q07429 | nrgA | — | — | Ammonium transporter NrgA |
| Contig1 | 2938380 | 2938730 | + | GENE_02859 | Prodigal: 2.6 | CDS | — | — | — | — | Q07428 | nrgB | — | — | Nitrogen regulatory PII-like protein |
| Contig1 | 2938783 | 2939937 | − | GENE_02860 | Prodigal: 2.6 | CDS | — | — | — | — | O07639 | ftsW_3 | — | — | Lipid II flippase FtsW |
| Contig1 | 2940102 | 2940677 | + | GENE_02861 | Prodigal: 2.6 | CDS | 3.6.1.27 | — | — | — | P94571 | bcrC | — | — | Undecaprenyl-diphosphatase BcrC |
| Contig1 | 2940912 | 2941280 | + | GENE_02862 | Prodigal: 2.6 | CDS | — | — | — | — | — | — | — | — | hypothetical protein |
| Contig1 | 2941252 | 2941731 | − | GENE_02863 | Prodigal: 2.6 | CDS | — | — | — | — | P71045 | ywnJ | — | — | putative membrane protein YwnJ |
| Contig1 | 2941823 | 2942692 | − | GENE_02864 | Prodigal: 2.6 | CDS | — | — | — | — | P71044 | spoIIQ | — | — | Stage II sporulation protein Q |
| Contig1 | 2942825 | 2943322 | + | GENE_02865 | Prodigal: 2.6 | CDS | 2.3.1.183 | — | — | — | P71043 | ywnH | — | — | Putative phosphinothricin acetyltransferase YwnH |
| Contig1 | 2943319 | 2943768 | + | GENE_02866 | Prodigal: 2.6 | CDS | — | — | — | — | — | — | — | — | hypothetical protein |
| Contig1 | 2943800 | 2944237 | + | GENE_02867 | Prodigal: 2.6 | CDS | — | — | — | — | — | — | — | — | hypothetical protein |
| Contig1 | 2944458 | 2945906 | + | GENE_02868 | Prodigal: 2.6 | CDS | 2.7.8.- | — | — | — | P71040 | clsA | — | — | Major cardiolipin synthase ClsA |
| Contig1 | 2946042 | 2946428 | + | GENE_02869 | Prodigal: 2.6 | CDS | — | — | — | — | — | — | — | — | hypothetical protein |
| Contig1 | 2946821 | 2947462 | + | GENE_02870 | Prodigal: 2.6 | CDS | 3.2.1.8 | — | — | — | P18429 | xynA | — | — | Endo-1,4-beta-xylanase A precursor |
| Contig1 | 2947487 | 2947798 | − | GENE_02871 | Prodigal: 2.6 | CDS | — | — | — | — | — | — | — | — | hypothetical protein |
| Contig1 | 2947836 | 2948240 | − | GENE_02872 | Prodigal: 2.6 | CDS | — | — | — | — | P71036 | ywnA_1 | — | — | Putative HTH-type transcriptional regulator YwnA |
| Contig1 | 2948381 | 2950090 | − | GENE_02873 | Prodigal: 2.6 | CDS | 3.5.1.5 | — | — | — | P77837 | ureC | — | — | Urease subunit alpha |
| Contig1 | 2950087 | 2950461 | − | GENE_02874 | Prodigal: 2.6 | CDS | 3.5.1.5 | — | — | — | P71035 | ureB | — | — | Urease subunit beta |
| Contig1 | 2950458 | 2950775 | − | GENE_02875 | Prodigal: 2.6 | CDS | 3.5.1.5 | — | — | — | P75030 | ureA | — | — | Urease subunit gamma |
| Contig1 | 2951129 | 2951317 | − | GENE_02876 | Prodigal: 2.6 | CDS | — | — | — | — | P70964 | csbD | — | — | Stress response protein CsbD |
| Contig1 | 2951391 | 2951870 | − | GENE_02877 | Prodigal: 2.6 | CDS | — | — | — | — | — | — | — | — | hypothetical protein |
| Contig1 | 2951992 | 2953122 | − | GENE_02878 | Prodigal: 2.6 | CDS | 3.1.-.- | — | — | — | Q00828 | rapA_5 | — | — | Response regulator aspartate phosphatase A |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2953313 | 2954338 | − | GENE_02879 | Prodigal: 2.6 | CDS | 4.1.99.18 | — | — | — | P69848 | moaA | — | — | Cyclic pyranopterin monophosphate synthase |
| Contig1 | 2954356 | 2955144 | − | GENE_02880 | Prodigal: 2.6 | CDS | — | — | — | MF_00187 | — | fdhD | — | — | Protein FdhD |
| Contig1 | 2955239 | 2955403 | − | GENE_02881 | Prodigal: 2.6 | CDS | — | — | — | — | — | — | — | — | hypothetical protein |
| Contig1 | 2955490 | 2956170 | − | GENE_02882 | Prodigal: 2.6 | CDS | — | — | PF00092.22 | — | — | — | — | — | von Willebrand factor type A domain protein |
| Contig1 | 2956481 | 2957167 | − | GENE_02883 | Prodigal: 2.6 | CDS | — | — | PF00092.22 | — | — | — | — | — | von Willebrand factor type A domain protein |
| Contig1 | 2957433 | 2958464 | − | GENE_02884 | Prodigal: 2.6 | CDS | — | — | — | — | Q02113 | lytB_2 | — | — | Amidase enhancer precursor |
| Contig1 | 2958664 | 2959974 | − | GENE_02885 | Prodigal: 2.6 | CDS | 2.5.1.7 | — | — | — | P70965 | murAA | — | — | UDP-N-acetylglucosamine 1-carboxyvinyltransferase 1 |
| Contig1 | 2960008 | 2960748 | − | GENE_02886 | Prodigal: 2.6 | CDS | — | — | — | — | — | — | — | — | hypothetical protein |
| Contig1 | 2960890 | 2961120 | − | GENE_02887 | Prodigal: 2.6 | CDS | — | — | — | — | — | — | — | — | hypothetical protein |
| Contig1 | 2961293 | 2961763 | + | GENE_02888 | Prodigal: 2.6 | CDS | — | — | — | — | — | — | — | — | hypothetical protein |
| Contig1 | 2961808 | 2962206 | − | GENE_02889 | Prodigal: 2.6 | CDS | — | — | — | — | P37812 | atpC | — | — | ATP synthase epsilon chain |
| Contig1 | 2962230 | 2963651 | − | GENE_02890 | Prodigal: 2.6 | CDS | 3.6.3.14 | — | — | — | P37809 | atpD | — | — | ATP synthase subunit beta |
| Contig1 | 2963677 | 2964540 | − | GENE_02891 | Prodigal: 2.6 | CDS | — | — | — | — | P37810 | atpG | — | — | ATP synthase gamma chain |
| Contig1 | 2964616 | 2966124 | − | GENE_02892 | Prodigal: 2.6 | CDS | 3.6.3.14 | — | — | — | P37808 | atpA | — | — | ATP synthase subunit alpha |
| Contig1 | 2966141 | 2966686 | − | GENE_02893 | Prodigal: 2.6 | CDS | — | — | — | — | P37811 | atpH | — | — | ATP synthase subunit delta |
| Contig1 | 2966683 | 2967195 | − | GENE_02894 | Prodigal: 2.6 | CDS | — | — | — | — | P37814 | atpF | — | — | ATP synthase subunit b |
| Contig1 | 2967338 | 2967550 | − | GENE_02895 | Prodigal: 2.6 | CDS | — | — | — | — | P37815 | atpE | — | — | ATP synthase subunit c |
| Contig1 | 2967596 | 2968330 | − | GENE_02896 | Prodigal: 2.6 | CDS | — | — | — | — | P37813 | atpB | — | — | ATP synthase subunit a |
| Contig1 | 2968338 | 2968721 | − | GENE_02897 | Prodigal: 2.6 | CDS | — | — | PF03899.9 | — | — | — | — | — | ATP synthase I chain |
| Contig1 | 2969141 | 2969770 | − | GENE_02898 | Prodigal: 2.6 | CDS | 2.4.2.9 | — | — | — | P70881 | upp | — | — | Uracil phosphoribosyltransferase |
| Contig1 | 2969905 | 2971152 | − | GENE_02899 | Prodigal: 2.6 | CDS | 2.1.2.1 | — | — | — | P39148 | glyA | — | — | Serine hydroxymethyltransferase |
| Contig1 | 2971300 | 2971842 | − | GENE_02900 | Prodigal: 2.6 | CDS | — | — | — | — | — | — | — | — | hypothetical protein |
| Contig1 | 2971856 | 2972305 | − | GENE_02901 | Prodigal: 2.6 | CDS | 5.3.1.- | — | — | — | P39156 | ywlF | — | — | Putative sugar phosphate isomerase YwlF |
| Contig1 | 2972439 | 2972894 | − | GENE_02902 | Prodigal: 2.6 | CDS | 3.1.3.48 | — | — | — | P39155 | ywlE | — | — | Low molecular weight protein-tyrosine-phosphatase YwlE |
| Contig1 | 2972968 | 2973525 | − | GENE_02903 | Prodigal: 2.6 | CDS | — | — | — | — | P76264 | mntP_3 | — | — | putative manganese efflux pump MntP |
| Contig1 | 2973593 | 2974633 | − | GENE_02904 | Prodigal: 2.6 | CDS | 2.7.7.87 | — | — | — | P39153 | ywlC | — | — | Threonylcarbamoyl-AMP synthase |
| Contig1 | 2974790 | 2975233 | − | GENE_02905 | Prodigal: 2.6 | CDS | — | — | PF09551.4 | — | — | — | — | — | hypothetical protein |
| Contig1 | 2975304 | 2975984 | − | GENE_02906 | Prodigal: 2.6 | CDS | — | — | — | — | — | — | — | — | Stage II sporulation protein R (spore_II_R) |
| Contig1 | 2976145 | 2976519 | + | GENE_02907 | Prodigal: 2.6 | CDS | — | — | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 2976506 | 2976784 | − | GENE_02908 | Prodigal: 2.6 | CDS | — | — | — | — | — | — | — | — | hypothetical protein |
| Contig1 | 2976855 | 2977715 | − | GENE_02909 | Prodigal: 2.6 | CDS | 2.1.1.- | — | — | — | B0B9D1 | prmC | — | — | Release factor glutamine methyltransferase |
| Contig1 | 2977717 | 2978787 | − | GENE_02910 | Prodigal: 2.6 | CDS | — | — | — | — | P66018 | prfA | — | — | Peptide chain release factor 1 |
| Contig1 | 2978899 | 2979282 | + | GENE_02911 | Prodigal: 2.6 | CDS | — | — | — | — | — | — | — | — | putative lyase |
| Contig1 | 2979393 | 2979956 | + | GENE_02912 | Prodigal: 2.6 | CDS | — | PRK11478 | — | — | P45870 | racA | — | — | Chromosome-anchoring protein RacA |
| Contig1 | 2979990 | 2980946 | − | GENE_02913 | Prodigal: 2.6 | CDS | — | — | — | — | — | — | — | — | putative transporter YfdV |
| Contig1 | 2981032 | 2982729 | − | GENE_02914 | Prodigal: 2.6 | CDS | 1.1.1.38 | PRK09903 | — | — | P45868 | maeA_2 | — | — | putative NAD-dependent malic enzyme 2 |
| Contig1 | 2983006 | 2983596 | − | GENE_02915 | Prodigal: 2.6 | CDS | 2.7.1.21 | — | — | — | Q81JX0 | tdk | — | — | Thymidine kinase |
| Contig1 | 2983681 | 2983881 | − | GENE_02916 | Prodigal: 2.6 | CDS | — | — | — | — | Q03223 | rpmE | — | — | 50S ribosomal protein L31 |
| Contig1 | 2984004 | 2985290 | − | GENE_02917 | Prodigal: 2.6 | CDS | — | — | — | — | P0AG30 | — | — | Transcription termination factor Rho | hypothetical protein |
| Contig1 | 2985697 | 2986662 | − | GENE_02918 | Prodigal: 2.6 | CDS | 3.1.3.11 | — | — | — | Q03224 | glpX | — | — | Fructose-1,6-bisphosphatase class 2 |
| Contig1 | 2986696 | 2987985 | − | GENE_02919 | Prodigal: 2.6 | CDS | 2.5.1.7 | — | — | — | P19670 | murAB | — | — | UDP-N-acetylglucosamine 1-carboxyvinyltransferase 2 |
| Contig1 | 2988295 | 2988933 | − | GENE_02920 | Prodigal: 2.6 | CDS | 2.2.1.2 | — | — | — | P19669 | tal | — | — | Transaldolase |
| Contig1 | 2989052 | 2989909 | − | GENE_02921 | Prodigal: 2.6 | CDS | 4.1.2.13 | — | — | — | P13243 | fbaA | — | — | putative fructose-bisphosphate aldolase |
| Contig1 | 2990085 | 2990459 | − | GENE_02922 | Prodigal: 2.6 | CDS | 2.7.-.- | — | — | — | P06628 | spo0F | — | — | Sporulation initiation phosphotransferase F |
| Contig1 | 2990624 | 2991145 | + | GENE_02923 | Prodigal: 2.6 | CDS | — | — | — | — | — | — | — | — | hypothetical protein |
| Contig1 | 2991193 | 2992800 | − | GENE_02924 | Prodigal: 2.6 | CDS | 6.3.4.2 | — | — | — | P99072 | pyrG | — | — | CTP synthase |
| Contig1 | 2993041 | 2993568 | − | GENE_02925 | Prodigal: 2.6 | CDS | — | — | — | — | P12464 | rpoE | — | — | DNA-directed RNA polymerase subunit delta |
| Contig1 | 2993796 | 2995904 | − | GENE_02926 | Prodigal: 2.6 | CDS | — | — | — | MF_02105 | — | lutA_3 | — | — | Lactate utilization protein A |
| Contig1 | 2996043 | 2997242 | + | GENE_02927 | Prodigal: 2.6 | CDS | — | — | — | — | P45865 | clsB | — | — | Minor cardiolipin synthase ClsB |
| Contig1 | 2997255 | 2998217 | + | GENE_02928 | Prodigal: 2.6 | CDS | 3.-.-.- | — | — | — | Q9RTE6 | uvsE | — | — | UV DNA damage endonuclease |
| Contig1 | 2998286 | 2998558 | + | GENE_02929 | Prodigal: 2.6 | CDS | — | — | — | — | — | — | — | — | hypothetical protein |
| Contig1 | 2998625 | 3000352 | − | GENE_02930 | Prodigal: 2.6 | CDS | 3.6.3.- | — | — | — | Q99T13 | — | — | — | Putative multidrug export ATP-binding/permease protein |
| Contig1 | 3000433 | 3001998 | − | GENE_02931 | Prodigal: 2.6 | CDS | 2.7.8.- | — | — | — | P45860 | ywiE | — | — | putative cardiolipin synthase YwiE |
| Contig1 | 3002032 | 3002661 | − | GENE_02932 | Prodigal: 2.6 | CDS | — | — | — | — | — | — | — | — | hypothetical protein |
| Contig1 | 3002800 | 3003471 | − | GENE_02933 | Prodigal: 2.6 | CDS | 1.7.99.4 | — | — | — | P71994 | narX_1 | — | — | Nitrate reductase-like protein NarX |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3003468 | 3004025 | − | GENE_02934 | Prodigal: 2.6 | CDS | 1.7.99.4 | — | — | — | P71994 | narX_2 | — | — | Nitrate reductase-like protein NarX |
| Contig1 | 3004051 | 3005514 | − | GENE_02935 | Prodigal: 2.6 | CDS | 1.7.99.4 | — | — | — | P11349 | narH | — | — | Respiratory nitrate reductase 1 beta chain |
| Contig1 | 3005504 | 3009190 | − | GENE_02936 | Prodigal: 2.6 | CDS | 1.7.99.4 | — | — | — | P09152 | narG | — | — | Respiratory nitrate reductase 1 alpha chain |
| Contig1 | 3009366 | 3009842 | − | GENE_02937 | Prodigal: 2.6 | CDS | — | — | — | — | P46910 | arfM | — | — | putative transcription regulator ArfM |
| Contig1 | 3009985 | 3010704 | + | GENE_02938 | Prodigal: 2.6 | CDS | — | — | — | — | — | — | — | — | hypothetical protein |
| Contig1 | 3010735 | 3011451 | − | GENE_02939 | Prodigal: 2.6 | CDS | — | — | — | — | P46908 | fnr | — | — | Anaerobic regulatory protein |
| Contig1 | 3011549 | 3012739 | − | GENE_02940 | Prodigal: 2.6 | CDS | — | — | — | — | O33854 | narT | — | — | putative nitrate transporter NarT |
| Contig1 | 3012874 | 3014544 | − | GENE_02941 | Prodigal: 2.6 | CDS | 6.1.1.19 | — | — | — | Q99W05 | argS | — | — | Arginine--tRNA ligase |
| Contig1 | 3014541 | 3014969 | − | GENE_02942 | Prodigal: 2.6 | CDS | — | — | — | — | O07624 | ywiB | — | — | putative beta-barrel protein YwiB |
| Contig1 | 3015261 | 3016406 | + | GENE_02943 | Prodigal: 2.6 | CDS | 3.1.-.- | — | — | — | P71002 | rapF_2 | — | — | Response regulator aspartate phosphatase F |
| Contig1 | 3016390 | 3016509 | + | GENE_02944 | Prodigal: 2.6 | CDS | — | PRK04140 | PF1131.2 | — | — | — | — | — | Rap-phr extracellular signalling |
| Contig1 | 3016710 | 3016913 | + | GENE_02945 | Prodigal: 2.6 | CDS | — | — | — | — | — | — | — | — | hypothetical protein |
| Contig1 | 3016927 | 3017130 | + | GENE_02946 | Prodigal: 2.6 | CDS | — | — | — | — | — | — | — | — | hypothetical protein |
| Contig1 | 3017537 | 3017818 | + | GENE_02947 | Prodigal: 2.6 | CDS | — | — | — | — | — | — | — | — | hypothetical protein |
| Contig1 | 3017877 | 3018374 | + | GENE_02948 | Prodigal: 2.6 | CDS | — | — | — | — | — | — | — | — | hypothetical protein |
| Contig1 | 3018379 | 3018918 | + | GENE_02949 | Prodigal: 2.6 | CDS | — | — | — | — | — | — | — | — | hypothetical protein |
| Contig1 | 3018965 | 3019183 | − | GENE_02950 | Prodigal: 2.6 | CDS | — | — | PF00196.13 | — | — | — | — | — | Bacterial regulatory proteins, luxR family |
| Contig1 | 3019353 | 3020225 | − | GENE_02951 | Prodigal: 2.6 | CDS | 3.5.3.11 | — | — | — | P70999 | speB | — | — | Agmatinase |
| Contig1 | 3020285 | 3021115 | − | GENE_02952 | Prodigal: 2.6 | CDS | 2.5.1.16 | — | — | — | P70998 | speE | — | — | Spermidine synthase |
| Contig1 | 3021315 | 3023387 | + | GENE_02953 | Prodigal: 2.6 | CDS | — | — | — | — | P70997 | pbpG | — | — | Penicillin-binding protein 2D |
| Contig1 | 3023412 | 3023843 | − | GENE_02954 | Prodigal: 2.6 | CDS | — | — | — | — | — | — | — | — | hypothetical protein |
| Contig1 | 3023987 | 3024505 | − | GENE_02955 | Prodigal: 2.6 | CDS | — | — | PF08741.4 | — | — | — | — | — | YwhD family protein |
| Contig1 | 3024518 | 3025177 | − | GENE_02956 | Prodigal: 2.6 | CDS | — | — | PF02163.16 | — | — | — | — | — | Peptidase family M50 |
| Contig1 | 3025283 | 3025471 | + | GENE_02957 | Prodigal: 2.6 | CDS | 5.3.2.6 | — | — | — | P70994 | ywhB | — | — | 2-hydroxymuconate tautomerase |
| Contig1 | 3025509 | 3025928 | − | GENE_02958 | Prodigal: 2.6 | CDS | — | — | — | — | O32181 | yusO_6 | — | — | putative HTH-type transcriptional regulator YusO |
| Contig1 | 3026316 | 3027698 | + | GENE_02959 | Prodigal: 2.6 | CDS | — | — | — | — | O07576 | yhdG_3 | — | — | putative amino acid permease YhdG |
| Contig1 | 3027763 | 3028263 | − | GENE_02960 | Prodigal: 2.6 | CDS | — | — | — | — | — | — | — | — | hypothetical protein |
| Contig1 | 3028303 | 3029604 | − | GENE_02961 | Prodigal: 2.6 | CDS | — | — | — | MF_01212 | — | — | — | — | Deoxyguanosine-triphosphate triphosphohydrolase-like protein |
| Contig1 | 3029765 | 3029989 | − | GENE_02962 | Prodigal: 2.6 | CDS | — | — | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3030194 | 3030967 | + | GENE_02963 | Prodigal: 2.6 | CDS | — | — | — | — | P39650 | rsfA_2 | — | — | Prespore-specific transcriptional regulator RsfA |
| Contig1 | 3031229 | 3031543 | + | GENE_02964 | Prodigal: 2.6 | CDS | — | — | PF03551.8 | — | — | — | — | — | Transcriptional regulator PadR-like family protein |
| Contig1 | 3031544 | 3032098 | + | GENE_02965 | Prodigal: 2.6 | CDS | — | — | — | — | — | — | — | — | hypothetical protein |
| Contig1 | 3032196 | 3033116 | + | GENE_02966 | Prodigal: 2.6 | CDS | 3.6.3.- | — | — | — | O07190 | — | — | — | Fluoroquinolones export ATP-binding protein/MT2762 |
| Contig1 | 3033113 | 3034066 | + | GENE_02967 | Prodigal: 2.6 | CDS | — | — | PF12730.1 | — | — | — | — | — | ABC-2 family transporter protein |
| Contig1 | 3034056 | 3034892 | − | GENE_02968 | Prodigal: 2.6 | CDS | — | — | — | — | — | — | — | — | hypothetical protein |
| Contig1 | 3034883 | 3035647 | − | GENE_02969 | Prodigal: 2.6 | CDS | — | — | — | — | — | — | — | — | hypothetical protein |
| Contig1 | 3035649 | 3036572 | − | GENE_02970 | Prodigal: 2.6 | CDS | — | — | — | — | — | — | — | — | hypothetical protein |
| Contig1 | 3036621 | 3036800 | − | GENE_02971 | Prodigal: 2.6 | CDS | — | — | — | — | — | — | — | — | hypothetical protein |
| Contig1 | 3036953 | 3037816 | − | GENE_02972 | Prodigal: 2.6 | CDS | 2.3.1.204 | — | — | — | P39648 | lipL | — | — | Octanoyl-[GcvH]:protein N-octanoyltransferase |
| Contig1 | 3037863 | 3038762 | − | GENE_02973 | Prodigal: 2.6 | CDS | — | — | — | — | P39647 | cysL_2 | — | — | HTH-type transcriptional regulator CysL |
| Contig1 | 3038884 | 3039855 | + | GENE_02974 | Prodigal: 2.6 | CDS | — | — | — | — | — | — | — | — | hypothetical protein |
| Contig1 | 3039893 | 3040864 | − | GENE_02975 | Prodigal: 2.6 | CDS | 2.3.1.8 | — | — | — | P39646 | pta_2 | — | — | Phosphate acetyltransferase |
| Contig1 | 3041127 | 3041891 | + | GENE_02976 | Prodigal: 2.6 | CDS | 1.-.-.- | PRK12276 | — | — | — | — | — | — | putative heme peroxidase |
| Contig1 | 3041990 | 3042790 | + | GENE_02977 | Prodigal: 2.6 | CDS | — | — | — | — | P39644 | ywfH | — | — | Bacilysin biosynthesis oxidoreductase YwfH |
| Contig1 | 3042807 | 3044006 | − | GENE_02978 | Prodigal: 2.6 | CDS | 2.6.1.83 | — | — | — | A0LEA5 | dapL_2 | — | — | LL-diaminopimelate aminotransferase |
| Contig1 | 3044019 | 3045200 | − | GENE_02979 | Prodigal: 2.6 | CDS | — | — | — | — | P39642 | bacE_2 | — | — | Putative bacilysin exporter BacE |
| Contig1 | 3045197 | 3046615 | − | GENE_02980 | Prodigal: 2.6 | CDS | 6.3.2.28 | — | — | — | P39641 | bacD | — | — | Alanine-anticapsin ligase BacD |
| Contig1 | 3046633 | 3047394 | − | GENE_02981 | Prodigal: 2.6 | CDS | 1.1.1.47 | — | — | — | P12310 | gdh_2 | — | — | Glucose 1-dehydrogenase |
| Contig1 | 3047391 | 3048101 | − | GENE_02982 | Prodigal: 2.6 | CDS | — | — | — | — | P39639 | bacB | — | — | Bacilysin biosynthesis protein BacB |
| Contig1 | 3048091 | 3048705 | − | GENE_02983 | Prodigal: 2.6 | CDS | — | — | — | — | — | — | — | — | prephenate dehydratase |
| Contig1 | 3048867 | 3049316 | − | GENE_02984 | Prodigal: 2.6 | CDS | — | PRK11898 | — | MF_00517 | — | sotB | — | — | sugar efflux transporter |
| Contig1 | 3049319 | 3050104 | − | GENE_02985 | Prodigal: 2.6 | CDS | — | — | — | — | P77389 | ydhP_3 | — | — | Inner membrane transport protein YdhP |
| Contig1 | 3050327 | 3051529 | + | GENE_02986 | Prodigal: 2.6 | CDS | — | — | — | — | P28246 | bcr_2 | — | — | Bicyclomycin resistance protein |
| Contig1 | 3051562 | 3052980 | − | GENE_02987 | Prodigal: 2.6 | CDS | — | — | — | — | P39636 | rocC_1 | — | — | Amino-acid permease RocC |
| Contig1 | 3053005 | 3054687 | − | GENE_02988 | Prodigal: 2.6 | CDS | 3.5.1.18 | — | — | MF_01690 | — | dapE | — | — | Succinyl-diaminopimelate desuccinylase |
| Contig1 | 3054758 | 3056305 | − | GENE_02989 | Prodigal: 2.6 | CDS | 1.2.1.88 | — | — | — | P39634 | rocA_1 | — | — | 1-pyrroline-5-carboxylate dehydrogenase |
| Contig1 | 3056503 | 3057789 | − | GENE_02990 | Prodigal: 2.6 | CDS | 1.4.1.2 | — | — | — | P39633 | rocG | — | — | Catabolic NAD-specific glutamate dehydrogenase RocG |
| Contig1 | 3057079 | 3058439 | − | GENE_02991 | Prodigal: 2.6 | CDS | — | — | — | — | — | — | — | — | hypothetical protein |

TABLE 5-continued

| #ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3058653 | 3059108 | − | GENE_02992 | Prodigal: 2.6 | CDS | 5.1.3.13 | — | — | — | P37745 | rfbC | — | — | dTDP-4-dehydrorhamnose 3,5-epimerase |
| Contig1 | 3059105 | 3059953 | − | GENE_02993 | Prodigal: 2.6 | CDS | 1.1.1.133 | — | — | — | A0QTF8 | rmlD | — | — | dTDP-4-dehydrorhamnose reductase |
| Contig1 | 3059974 | 3060921 | − | GENE_02994 | Prodigal: 2.6 | CDS | 4.2.1.46 | — | — | — | P39630 | rfbB | — | — | dTDP-glucose 4,6-dehydratase |
| Contig1 | 3060924 | 3061661 | − | GENE_02995 | Prodigal: 2.6 | CDS | 2.7.7.24 | — | — | — | P39629 | rmlA | — | — | Glucose-1-phosphate thymidylyltransferase |
| Contig1 | 3061689 | 3062693 | − | GENE_02996 | Prodigal: 2.6 | CDS | 2.4.1.227 | — | — | MF_00033 | — | murG_2 | — | — | UDP-N-acetylglucosamine--N-acetylmuramyl-(penta peptide) pyrophosphoryl-undecaprenol N-acetylglucosamine transferase |
| Contig1 | 3062695 | 3063438 | − | GENE_02997 | Prodigal: 2.6 | CDS | 2.7.7.38 | — | — | — | P42216 | kpsU | — | — | 3-deoxy-manno-octulosonate cytidylyltransferase |
| Contig1 | 3063428 | 3064549 | − | GENE_02998 | Prodigal: 2.6 | CDS | — | — | — | — | P39625 | spsE | — | — | Spore coat polysaccharide biosynthesis protein SpsE |
| Contig1 | 3064549 | 3065412 | − | GENE_02999 | Prodigal: 2.6 | CDS | — | PRK10975 | — | — | — | — | — | — | TDP-fucosamine acetyltransferase |
| Contig1 | 3065413 | 3066582 | − | GENE_03000 | Prodigal: 2.6 | CDS | 2.6.1.87 | — | — | — | Q8ZNF3 | arnB_2 | — | — | UDP-4-amino-4-deoxy-L-arabinose--oxoglutarate aminotransferase |
| Contig1 | 3066604 | 3068028 | − | GENE_03001 | Prodigal: 2.6 | CDS | — | — | PF05159.8 | — | — | — | — | — | Capsule polysaccharide biosynthesis protein |
| Contig1 | 3068033 | 3068803 | − | GENE_03002 | Prodigal: 2.6 | CDS | — | — | — | — | P39621 | spsA_2 | — | — | Spore coat polysaccharide biosynthesis protein SpsA |
| Contig1 | 3069085 | 3069630 | + | GENE_03003 | Prodigal: 2.6 | CDS | — | PRK10873 | — | — | P39620 | gerQ | — | — | Spore coat protein GerQ |
| Contig1 | 3069677 | 3070048 | − | GENE_03004 | Prodigal: 2.6 | CDS | — | — | — | — | — | — | — | — | hypothetical protein |
| Contig1 | 3070112 | 3071431 | − | GENE_03005 | Prodigal: 2.6 | CDS | — | — | — | — | P39618 | ywdJ | — | — | Putative purine permease YwdJ |
| Contig1 | 3071450 | 3071776 | − | GENE_03006 | Prodigal: 2.6 | CDS | — | — | — | — | — | — | — | — | hypothetical protein |
| Contig1 | 3071931 | 3072614 | − | GENE_03007 | Prodigal: 2.6 | CDS | 3.2.2.27 | — | — | — | P39615 | ung | — | — | Uracil-DNA glycosylase |
| Contig1 | 3072629 | 3073435 | − | GENE_03008 | Prodigal: 2.6 | CDS | 2.4.1.- | — | — | — | P0A599 | — | — | — | PGL/p-HBAD biosynthesis glycosyltransferase/MT3031 |
| Contig1 | 3073520 | 3074047 | − | GENE_03009 | Prodigal: 2.6 | CDS | — | — | — | — | — | — | — | — | hypothetical protein |
| Contig1 | 3074092 | 3074727 | − | GENE_03010 | Prodigal: 2.6 | CDS | — | — | — | — | — | — | — | — | hypothetical protein |
| Contig1 | 3074720 | 3075058 | − | GENE_03011 | Prodigal: 2.6 | CDS | — | PRK09416 | — | — | — | — | — | — | lineage-specific thermal regulator protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3075208 | 3076020 | + | GENE_03012 | Prodigal: 2.6 | CDS | 2.7.1.35 | — | — | — | P39610 | pdxK | — | — | Pyridoxine kinase |
| Contig1 | 3076051 | 3076290 | − | GENE_03013 | Prodigal: 2.6 | CDS | — | — | — | — | — | — | — | — | hypothetical protein |
| Contig1 | 3076390 | 3077829 | − | GENE_03014 | Prodigal: 2.6 | CDS | 3.2.1.26 | — | — | — | P27217 | scrB | — | — | Sucrose-6-phosphate hydrolase |
| Contig1 | 3077826 | 3079208 | − | GENE_03015 | Prodigal: 2.6 | CDS | — | — | — | — | P15400 | sacX | — | — | Negative regulator of SacY activity |
| Contig1 | 3079426 | 3080256 | − | GENE_03016 | Prodigal: 2.6 | CDS | — | — | — | — | P15401 | sacY | — | — | Levansucrase and sucrase synthesis operon antiterminator |
| Contig1 | 3080280 | 3080594 | − | GENE_03017 | Prodigal: 2.6 | CDS | — | — | — | — | — | — | — | — | hypothetical protein |
| Contig1 | 3081120 | 3083531 | + | GENE_03018 | Prodigal: 2.6 | CDS | 3.4.21.- | — | — | — | P29141 | vpr | — | — | Minor extracellular protease vpr precursor |
| Contig1 | 3083573 | 3084574 | − | GENE_03019 | Prodigal: 2.6 | CDS | 1.14.14.3 | — | — | — | P07740 | luxA_2 | — | — | Alkanal monooxygenase alpha chain |
| Contig1 | 3084738 | 3085487 | − | GENE_03020 | Prodigal: 2.6 | CDS | 1.5.1.38 | — | — | — | P39605 | nfrA1 | — | — | FMN reductase (NADPH) |
| Contig1 | 3085591 | 3086778 | − | GENE_03021 | Prodigal: 2.6 | CDS | — | — | — | — | P39604 | rodA | — | — | Rod shape-determining protein RodA |
| Contig1 | 3086980 | 3087438 | − | GENE_03022 | Prodigal: 2.6 | CDS | 2.3.1.- | — | — | — | P94562 | ysnE_1 | — | — | putative N-acetyltransferase YsnE |
| Contig1 | 3087732 | 3087992 | + | GENE_03023 | Prodigal: 2.6 | CDS | — | — | — | — | P39603 | ywcE | — | — | Spore morphogenesis and germination protein YwcE |
| Contig1 | 3088036 | 3088404 | − | GENE_03024 | Prodigal: 2.6 | CDS | 1.10.3.- | — | — | — | E0TW64 | qoxD | — | — | Quinol oxidase subunit 4 |
| Contig1 | 3088406 | 3089020 | − | GENE_03025 | Prodigal: 2.6 | CDS | 1.10.3.- | — | — | — | E0TW65 | qoxC | — | — | Quinol oxidase subunit 3 |
| Contig1 | 3089035 | 3090984 | − | GENE_03026 | Prodigal: 2.6 | CDS | 1.10.3.- | — | — | — | E0TW66 | qoxB | — | — | Quinol oxidase subunit 1 |
| Contig1 | 3091012 | 3091977 | − | GENE_03027 | Prodigal: 2.6 | CDS | 1.10.3.- | — | — | — | E0TW67 | qoxA | — | — | Quinol oxidase subunit 2 precursor |
| Contig1 | 3092480 | 3092725 | + | GENE_03028 | Prodigal: 2.6 | CDS | — | — | PF04226.7 | — | — | — | — | — | Transglycosylase associated protein |
| Contig1 | 3092742 | 3094283 | − | GENE_03029 | Prodigal: 2.6 | CDS | 2.7.7.12 | — | — | — | E8MF11 | galT_2 | — | — | Galactose-1-phosphate uridylyltransferase |
| Contig1 | 3094525 | 3094932 | − | GENE_03030 | Prodigal: 2.6 | CDS | — | — | PF04138.8 | — | — | — | — | — | GtrA-like protein |
| Contig1 | 3094991 | 3095614 | − | GENE_03031 | Prodigal: 2.6 | CDS | — | — | — | — | P28815 | tetC_2 | — | — | Transposon Tn10 TetC protein |
| Contig1 | 3095950 | 3096111 | + | GENE_03032 | Prodigal: 2.6 | CDS | — | — | — | — | P0C8M5 | slrA | — | — | Transcriptional regulator SlrA |
| Contig1 | 3096329 | 3097009 | + | GENE_03033 | Prodigal: 2.6 | CDS | 2.1.1.222 | — | — | — | Q4K8M4 | ubiG | — | — | Ubiquinone biosynthesis O-methyltransferase |
| Contig1 | 3097009 | 3097683 | + | GENE_03034 | Prodigal: 2.6 | CDS | — | — | — | — | — | — | — | — | hypothetical protein |
| Contig1 | 3097704 | 3098306 | − | GENE_03035 | Prodigal: 2.6 | CDS | — | — | PF01323.14 | — | — | — | — | — | DSBA-like thioredoxin domain protein |
| Contig1 | 3098393 | 3099649 | − | GENE_03036 | Prodigal: 2.6 | CDS | 1.11.1.- | — | — | — | P39597 | efeN | — | — | putative deferrochelatase/peroxidase EfeN precursor |
| Contig1 | 3100061 | 3100735 | − | GENE_03037 | Prodigal: 2.6 | CDS | 2.5.1.3 | — | — | — | P39594 | thiE | — | — | Thiamine-phosphate synthase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3100732 | 3101550 | − | GENE_03038 | Prodigal: 2.6 | CDS | 2.7.1.50 | | | | P39593 | thiM | | | Hydroxyethylthiazole kinase |
| Contig1 | 3101553 | 3102461 | − | GENE_03039 | Prodigal: 2.6 | CDS | | | | | P27111 | cynR | | | HTH-type transcriptional regulator CynR |
| Contig1 | 3102568 | 3102954 | + | GENE_03040 | Prodigal: 2.6 | CDS | | | | | P60647 | cidA_1 | | | Holin-like protein CidA |
| Contig1 | 3102936 | 3103616 | + | GENE_03041 | Prodigal: 2.6 | CDS | | | | | P0AD19 | yohK | | | Inner membrane protein YohK |
| Contig1 | 3103746 | 3103940 | + | GENE_03042 | Prodigal: 2.6 | CDS | | | | | | | | | hypothetical protein |
| Contig1 | 3104095 | 3104856 | + | GENE_03043 | Prodigal: 2.6 | CDS | | | | | P71039 | mta | | | HTH-type transcriptional activator mta |
| Contig1 | 3105040 | 3106227 | − | GENE_03044 | Prodigal: 2.6 | CDS | 2.1.1.191 | | | | P75876 | rlmI | | | Ribosomal RNA large subunit methyltransferase I |
| Contig1 | 3106322 | 3106705 | + | GENE_03045 | Prodigal: 2.6 | CDS | 4.4.1.5 | | | | P44638 | gloA | | | Lactoylglutathione lyase |
| Contig1 | 3106734 | 3108068 | − | GENE_03046 | Prodigal: 2.6 | CDS | | | | | P46317 | licC_1 | | | Lichenan permease IIC component |
| Contig1 | 3108230 | 3109975 | + | GENE_03047 | Prodigal: 2.6 | CDS | 3.4.21.- | | | | P16396 | epr | | | Minor extracellular protease Epr precursor |
| Contig1 | 3110032 | 3110892 | − | GENE_03048 | Prodigal: 2.6 | CDS | | | | | P25148 | gspA | | | General stress protein A |
| Contig1 | 3111152 | 3111784 | − | GENE_03049 | Prodigal: 2.6 | CDS | 2.7.6.5 | | | | P39583 | ywaC | | | GTP pyrophosphokinase YwaC |
| Contig1 | 3111916 | 3112851 | − | GENE_03050 | Prodigal: 2.6 | CDS | 2.5.1.74 | | | | P32166 | menA | | | 1,4-dihydroxy-2-naphthoate octaprenyltransferase |
| Contig1 | 3113295 | 3113444 | + | GENE_03051 | Prodigal: 2.6 | CDS | | | PF12459.2 | | | | | | D-Ala-teichoic acid biosynthesis protein |
| Contig1 | 3113460 | 3114971 | + | GENE_03052 | Prodigal: 2.6 | CDS | 6.1.1.13 | | | | P39581 | dltA | | | D-alanine--poly(phosphoribitol) ligase subunit 1 |
| Contig1 | 3114968 | 3116149 | + | GENE_03053 | Prodigal: 2.6 | CDS | 2.3.1.- | | | | O25526 | patA_3 | | | Peptidoglycan O-acetyltransferase |
| Contig1 | 3116166 | 3116402 | + | GENE_03054 | Prodigal: 2.6 | CDS | 6.1.1.13 | | | | P39579 | dltC | | | D-alanine--poly(phosphoribitol) ligase subunit 2 |
| Contig1 | 3116403 | 3117587 | + | GENE_03055 | Prodigal: 2.6 | CDS | | | PF0491406 | | | | | DltD C-terminal region | hypothetical protein |
| Contig1 | 3117774 | 3118862 | + | GENE_03056 | Prodigal: 2.6 | CDS | 2.6.1.42 | | | | P39576 | ilvK | | | Branched-chain-amino-acid aminotransferase 2 |
| Contig1 | 3118903 | 3120231 | − | GENE_03057 | Prodigal: 2.6 | CDS | 3.2.1.86 | | | | P46320 | licH | | | putative 6-phospho-beta-glucosidase |
| Contig1 | 3120228 | 3120560 | − | GENE_03058 | Prodigal: 2.6 | CDS | 2.7.1.- | | | | P46319 | licA | | | Lichenan-specific phosphotransferase enzyme IIA component |
| Contig1 | 3120579 | 3121937 | − | GENE_03059 | Prodigal: 2.6 | CDS | | | | | P46317 | licC_2 | | | Lichenan permease IIC component |
| Contig1 | 3121953 | 3122261 | − | GENE_03060 | Prodigal: 2.6 | CDS | 2.7.1.69 | | | | P46318 | licB | | | Lichenan-specific phosphotransferase enzyme IIB component |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3122360 | 3124300 | − | GENE_03061 | Prodigal: 2.6 | CDS | — | — | — | — | P46321 | licR_2 | — | — | putative licABCH operon regulator |
| Contig1 | 3124633 | 3125223 | − | GENE_03062 | Prodigal: 2.6 | CDS | — | — | — | MF_00527 | — | — | — | — | Putative 3-methyladenine DNA glyosylase |
| Contig1 | 3125435 | 3126463 | + | GENE_03063 | Prodigal: 2.6 | CDS | — | — | — | — | P40410 | feuB_2 | — | — | Iron-uptake system permease protein FeuB |
| Contig1 | 3126464 | 3127477 | + | GENE_03064 | Prodigal: 2.6 | CDS | — | — | — | — | P40411 | feuC2 | — | — | Iron-uptake system permease protein FeuC |
| Contig1 | 3127494 | 3128390 | + | GENE_03065 | Prodigal: 2.6 | CDS | — | — | — | — | O31567 | yfiY | — | — | putative siderophore-binding lipoprotein YfiY precursor |
| Contig1 | 3128493 | 3128843 | + | GENE_03066 | Prodigal: 2.6 | CDS | — | — | — | — | P96677 | aseR | — | — | HTH-type transcriptional repressor AseR |
| Contig1 | 3128857 | 3130155 | + | GENE_03067 | Prodigal: 2.6 | CDS | — | — | — | — | P0AB93 | arsB_2 | — | — | Arsenical pump membrane protein |
| Contig1 | 3130308 | 3130619 | + | GENE_03068 | Prodigal: 2.6 | CDS | 2.7.1.69 | — | — | — | O05505 | gmuB | — | — | Oligo-beta-mannoside-specific phosphotransferase enzyme IIB component |
| Contig1 | 3130634 | 3130951 | + | GENE_03069 | Prodigal: 2.6 | CDS | 2.7.1.- | — | — | — | O05506 | gmuA | — | — | Oligo-beta-mannoside-specific phosphotransferase enzyme IIA component |
| Contig1 | 3130970 | 3132289 | + | GENE_03070 | Prodigal: 2.6 | CDS | — | — | — | — | O05507 | gmuC | — | — | Oligo-beta-mannoside permease IIC component |
| Contig1 | 3132319 | 3133719 | + | GENE_03071 | Prodigal: 2.6 | CDS | 3.2.1.86 | — | — | — | O05508 | gmuD | — | — | 6-phospho-beta-glucosidase GmuD |
| Contig1 | 3133739 | 3134620 | + | GENE_03072 | Prodigal: 2.6 | CDS | 2.7.1.4 | — | — | — | O05510 | gmuE | — | — | Putative fructokinase |
| Contig1 | 3134617 | 3135561 | + | GENE_03073 | Prodigal: 2.6 | CDS | 5.3.1.8 | — | — | — | O05511 | gmuF | — | — | putative mannose-6-phosphate isomerase GmuF |
| Contig1 | 3135581 | 3136663 | + | GENE_03074 | Prodigal: 2.6 | CDS | 3.2.1.78 | — | — | — | O05512 | gmuG | — | — | Mannan endo-1,4-beta-mannosidase precursor |
| Contig1 | 3136741 | 3138354 | + | GENE_03075 | Prodigal: 2.6 | CDS | 1.11.1.6 | — | — | — | Q59337 | katA_2 | — | — | Catalase |
| Contig1 | 3138394 | 3139380 | − | GENE_03076 | Prodigal: 2.6 | CDS | 3.5.1.11 | — | — | — | P12256 | — | — | — | Penicillin acylase precursor |
| Contig1 | 3139697 | 3141055 | + | GENE_03077 | Prodigal: 2.6 | CDS | — | — | — | — | P94575 | puc_2 | — | — | putative allantoin permease |
| Contig1 | 3141069 | 3141899 | − | GENE_03078 | Prodigal: 2.6 | CDS | 4.2.1.136 | — | — | — | P94368 | nnrD | — | — | ADP-dependent (S)-NAD(P)H-hydrate dehydratase |
| Contig1 | 3141990 | 3143720 | − | GENE_03079 | Prodigal: 2.6 | CDS | — | — | — | — | Q57538 | — | — | — | putative ABC transporter ATP-binding protein |
| Contig1 | 3143717 | 3145420 | − | GENE_03080 | Prodigal: 2.6 | CDS | — | — | — | — | P29018 | cydD | — | — | ATP-binding/permease protein CydD |
| Contig1 | 3145420 | 3146436 | − | GENE_03081 | Prodigal: 2.6 | CDS | 1.10.3.10 | — | — | — | P0ABK2 | cydB | — | — | Cytochrome bd-I ubiquinol oxidase subunit 2 |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3146420 | 3147826 | − | GENE_03082 | Prodigal: 2.6 | CDS | 1.10.3.- | — | — | — | Q09049 | cydA | — | — | Cytochrome bd ubiquinol oxidase subunit 1 |
| Contig1 | 3148329 | 3149672 | + | GENE_03083 | Prodigal: 2.6 | CDS | — | — | — | — | P94363 | cimH | — | — | Citrate/malate transporter |
| Contig1 | 3149708 | 3150550 | − | GENE_03084 | Prodigal: 2.6 | CDS | 3.5.1.- | — | — | — | Q6TYB1 | icaB | — | — | Poly-beta-1,6-N-acetyl-D-glucosamine N-deacetylase precursor |
| Contig1 | 3150650 | 3151750 | − | GENE_03085 | Prodigal: 2.6 | CDS | 3.6.3.- | — | — | — | O50454 | sugC | — | — | Trehalose import ATP-binding protein SugC |
| Contig1 | 3151868 | 3152761 | − | GENE_03086 | Prodigal: 2.6 | CDS | — | PRK04164 | — | — | Q54087 | lrp_2 | — | — | Leucine-rich protein |
| Contig1 | 3152928 | 3153764 | − | GENE_03087 | Prodigal: 2.6 | CDS | — | — | — | — | — | — | — | — | hypothetical protein |
| Contig1 | 3154179 | 3154817 | + | GENE_03088 | Prodigal: 2.6 | CDS | — | — | PF11611.2 | — | — | — | — | — | Telomeric repeat-binding factor 2 |
| Contig1 | 3154864 | 3155880 | − | GENE_03089 | Prodigal: 2.6 | CDS | 5.1.3.2 | — | — | — | E8MF10 | lnpD | — | — | UDP-glucose 4-epimerase |
| Contig1 | 3156091 | 3157323 | + | GENE_03090 | Prodigal: 2.6 | CDS | 3.4.11.4 | — | — | — | Q81WU4 | pepT_2 | — | — | Peptidase T |
| Contig1 | 3157422 | 3157538 | + | GENE_03091 | Prodigal: 2.6 | CDS | — | — | — | — | — | — | — | — | hypothetical protein |
| Contig1 | 3157900 | 3158067 | + | GENE_03092 | Prodigal: 2.6 | CDS | — | — | — | — | — | — | — | — | hypothetical protein |
| Contig1 | 3158170 | 3158646 | + | GENE_03093 | Prodigal: 2.6 | CDS | — | — | — | — | — | — | — | — | hypothetical protein |
| Contig1 | 3158896 | 3160032 | + | GENE_03094 | Prodigal: 2.6 | CDS | 2.1.1.14 | — | — | — | P80877 | metE_2 | — | — | 5-methyltetra-hydropteroyl-triglutamate--homocysteine methyltransferase |
| Contig1 | 3160066 | 3160947 | − | GENE_03095 | Prodigal: 2.6 | CDS | 2.1.1.187 | — | — | — | P36999 | rlmA | — | — | 23S rRNA (guanine(745)-N(1))-methyltransferase |
| Contig1 | 3161551 | 3162744 | + | GENE_03096 | Prodigal: 2.6 | CDS | — | — | — | — | P42312 | nupG | — | — | Purine nucleoside transport protein NupG |
| Contig1 | 3162792 | 3163466 | − | GENE_03097 | Prodigal: 2.6 | CDS | 3.5.1.- | — | — | — | O34798 | pdaC_2 | — | — | Peptidoglycan-N-acetylmuramic acid deacetylase PdaC |
| Contig1 | 3163607 | 3163909 | − | GENE_03098 | Prodigal: 2.6 | CDS | — | — | — | — | — | — | — | — | hypothetical protein |
| Contig1 | 3163930 | 3164613 | − | GENE_03099 | Prodigal: 2.6 | CDS | — | — | — | — | — | — | — | — | hypothetical protein |
| Contig1 | 3164799 | 3166850 | + | GENE_03100 | Prodigal: 2.6 | CDS | 1.11.1.6 | — | — | — | P21179 | katE | — | — | Catalase HPH |
| Contig1 | 3167051 | 3168331 | + | GENE_03101 | Prodigal: 2.6 | CDS | — | — | — | — | P42308 | citN | — | — | Citrate transporter |
| Contig1 | 3168373 | 3169104 | + | GENE_03102 | Prodigal: 2.6 | CDS | 3.2.1.73 | — | — | — | P04957 | bglS | — | — | Beta-glucanase precursor |
| Contig1 | 3169354 | 3170187 | − | GENE_03103 | Prodigal: 2.6 | CDS | — | — | — | — | P39805 | licT | — | — | Transcription antiterminator LicT |
| Contig1 | 3170362 | 3171609 | + | GENE_03104 | Prodigal: 2.6 | CDS | — | — | PF11700.2 | — | — | — | — | — | Vacuole effluxer Atg22 like protein |
| Contig1 | 3171641 | 3173080 | − | GENE_03105 | Prodigal: 2.6 | CDS | 3.6.4.13 | — | — | — | P42305 | dbpA_2 | — | — | ATP-dependent RNA helicase DbpA |
| Contig1 | 3173232 | 3173510 | − | GENE_03106 | Prodigal: 2.6 | CDS | — | — | — | — | — | — | — | — | hypothetical protein |
| Contig1 | 3173566 | 3173826 | − | GENE_03107 | Prodigal: 2.6 | CDS | — | — | — | — | — | — | — | — | hypothetical protein |
| Contig1 | 3173843 | 3174208 | − | GENE_03108 | Prodigal: 2.6 | CDS | — | — | — | — | D4G3R3 | wapI | — | — | Immunity protein WapI |
| Contig1 | 3174202 | 3174363 | − | GENE_03109 | Prodigal: 2.6 | CDS | — | — | — | — | — | — | — | — | hypothetical protein |
| Contig1 | 3174466 | 3175293 | − | GENE_03110 | Prodigal: 2.6 | CDS | — | — | — | — | — | — | — | — | hypothetical protein |
| Contig1 | 3175336 | 3175812 | − | GENE_03111 | Prodigal: 2.6 | CDS | — | — | — | — | — | — | — | — | hypothetical protein |
| Contig1 | 3175879 | 3176286 | − | GENE_03112 | Prodigal: 2.6 | CDS | — | — | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3177258 | 3178322 | − | GENE_03113 | Prodigal: 2.6 | CDS | 4.2.2.10 | — | — | — | P94449 | pelB | — | — | Pectin lyase precursor |
| Contig1 | 3178464 | 3179375 | − | GENE_03114 | Prodigal: 2.6 | CDS | — | — | PF00892.14 | — | — | — | — | — | EamA-like transporter family protein |
| Contig1 | 3179524 | 3179970 | − | GENE_03115 | Prodigal: 2.6 | CDS | — | — | — | — | O07552 | nhaX_2 | — | — | Stress response protein NhaX |
| Contig1 | 3180222 | 3183353 | + | GENE_03116 | Prodigal: 2.6 | CDS | — | — | — | MF_00204 | — | uvrB_3 | — | — | UvrABC system protein B |
| Contig1 | 3183342 | 3183731 | − | GENE_03117 | Prodigal: 2.6 | CDS | 3.6.1.65 | — | — | — | P77788 | nudG | — | — | CTP pyrophosphohydrolase |
| Contig1 | 3183916 | 3184734 | − | GENE_03118 | Prodigal: 2.6 | CDS | 3.2.1.99 | — | — | — | P42293 | abn2_1 | — | — | Extracellular endo-alpha-(1−>5)-L-arabinanase 2 precursor |
| Contig1 | 3184731 | 3185321 | − | GENE_03119 | Prodigal: 2.6 | CDS | 3.2.1.99 | — | — | — | P42293 | abn2_2 | — | — | Extracellular endo-alpha-(1−>5)-L-arabinanase 2 precursor |
| Contig1 | 3185563 | 3186009 | + | GENE_03120 | Prodigal: 2.6 | CDS | — | — | — | — | P10943 | hutP | — | — | Hut operon positive regulatory protein |
| Contig1 | 3186117 | 3187660 | + | GENE_03121 | Prodigal: 2.6 | CDS | 4.3.1.3 | — | — | — | P10944 | hutH | — | — | Histidine ammonia-lyase |
| Contig1 | 3187657 | 3189321 | + | GENE_03122 | Prodigal: 2.6 | CDS | 4.2.1.49 | — | — | — | P25503 | hutU | — | — | Urocanate hydratase |
| Contig1 | 3189323 | 3190588 | + | GENE_03123 | Prodigal: 2.6 | CDS | 3.5.2.7 | — | — | — | P42084 | hutI | — | — | Imidazolonepropionase |
| Contig1 | 3190581 | 3191531 | + | GENE_03124 | Prodigal: 2.6 | CDS | 3.5.3.8 | — | — | — | P42068 | hutG | — | — | Formimidoylglutamase |
| Contig1 | 3191602 | 3193020 | + | GENE_03125 | Prodigal: 2.6 | CDS | — | — | — | — | P39137 | rocE_1 | — | — | Amino-acid permease RocE |
| Contig1 | 3193061 | 3194362 | − | GENE_03126 | Prodigal: 2.6 | CDS | 2.4.2.2 | — | — | — | Q7A4D0 | pdp | — | — | Pyrimidine-nucleoside phosphorylase |
| Contig1 | 3194390 | 3195571 | − | GENE_03127 | Prodigal: 2.6 | CDS | — | — | — | — | P0AFF2 | nupC | — | — | Nucleoside permease NupC |
| Contig1 | 3195664 | 3196332 | − | GENE_03128 | Prodigal: 2.6 | CDS | 4.1.2.4 | — | — | — | P99102 | deoC1 | — | — | Deoxyribose-phosphate aldolase 1 |
| Contig1 | 3196423 | 3197364 | − | GENE_03129 | Prodigal: 2.6 | CDS | — | — | — | — | P39140 | deoR | — | — | Deoxyribonucleoside regulator |
| Contig1 | 3197435 | 3198247 | − | GENE_03130 | Prodigal: 2.6 | CDS | 3.1.3.23 | — | — | — | P0A8Y5 | yidA_2 | — | — | Sugar phosphatase YidA |
| Contig1 | 3198316 | 3198840 | − | GENE_03131 | Prodigal: 2.6 | CDS | — | — | — | — | — | — | — | — | hypothetical protein |
| Contig1 | 3198830 | 3199249 | − | GENE_03132 | Prodigal: 2.6 | CDS | — | — | — | — | — | — | — | — | hypothetical protein |
| Contig1 | 3199361 | 3199747 | + | GENE_03133 | Prodigal: 2.6 | CDS | — | — | — | — | — | — | — | — | hypothetical protein |
| Contig1 | 3199905 | 3200270 | + | GENE_03134 | Prodigal: 2.6 | CDS | — | — | — | — | — | — | — | — | hypothetical protein |
| Contig1 | 3200321 | 3200713 | + | GENE_03135 | Prodigal: 2.6 | CDS | — | — | — | — | — | — | — | — | hypothetical protein |
| Contig1 | 3200843 | 3201805 | + | GENE_03136 | Prodigal: 2.6 | CDS | — | — | — | — | P54941 | yxeB | — | — | Iron(3+)-hydroxamate-binding protein YxeB precursor |
| Contig1 | 3201846 | 3202193 | − | GENE_03137 | Prodigal: 2.6 | CDS | — | — | — | — | — | — | — | — | hypothetical protein |
| Contig1 | 3202207 | 3204075 | − | GENE_03138 | Prodigal: 2.6 | CDS | — | — | — | — | P42424 | yxdM | — | — | ABC transporter permease protein YxdM |
| Contig1 | 3204050 | 3204823 | − | GENE_03139 | Prodigal: 2.6 | CDS | — | — | — | — | P42423 | yxdL | — | — | ABC transporter ATP-binding protein YxdL |
| Contig1 | 3204968 | 3205945 | − | GENE_03140 | Prodigal: 2.6 | CDS | 2.7.13.3 | — | — | — | Q5H108 | graS_2 | — | — | Sensor histidine kinase GraS |
| Contig1 | 3205942 | 3206673 | − | GENE_03141 | Prodigal: 2.6 | CDS | — | — | — | — | Q932F1 | graR_2 | — | — | Response regulator protein GraR |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3206781 | 3208220 | − | GENE_03142 | Prodigal: 2.6 | CDS | 2.7.13.3 | — | — | — | P08400 | phoR_3 | — | — | Phosphate regulon sensor protein PhoR |
| Contig1 | 3208217 | 3208939 | − | GENE_03143 | Prodigal: 2.6 | CDS | — | — | — | — | Q9L524 | srrA_2 | — | — | Transcriptional regulatory protein SrrA |
| Contig1 | 3209182 | 3210093 | + | GENE_03144 | Prodigal: 2.6 | CDS | 3.6.3.- | — | — | — | P94374 | yxlF_5 | — | — | putative ABC transporter ATP-binding protein YxlF |
| Contig1 | 3210090 | 3210848 | + | GENE_03145 | Prodigal: 2.6 | CDS | — | — | PF12730.1 | — | — | — | — | — | ABC-2 family transporter protein |
| Contig1 | 3210865 | 3211599 | + | GENE_03146 | Prodigal: 2.6 | CDS | — | — | PF12730.1 | — | — | — | — | — | ABC-2 family transporter protein |
| Contig1 | 3211885 | 3212091 | + | GENE_03147 | Prodigal: 2.6 | CDS | — | — | — | — | P43683 | mrsA | — | — | Lantibiotic mersacidin precursor |
| Contig1 | 3212187 | 3212828 | + | GENE_03148 | Prodigal: 2.6 | CDS | — | — | — | — | P0AA16 | ompR | — | — | Transcriptional regulatory protein OmpR |
| Contig1 | 3212877 | 3213461 | − | GENE_03149 | Prodigal: 2.6 | CDS | 4.1.1.- | — | — | — | Q9RC23 | mrsD | — | — | Mersacidin decarboxylase |
| Contig1 | 3213672 | 3216860 | + | GENE_03150 | Prodigal: 2.6 | CDS | — | — | PF05147.7 | — | — | — | — | — | Lanthionine synthetase C-like protein |
| Contig1 | 3216913 | 3219113 | + | GENE_03151 | Prodigal: 2.6 | CDS | 3.4.22.- | — | — | — | P59852 | lagD | — | — | Lactococcin-G-processing and transport ATP-binding protein LagD |
| Contig1 | 3219392 | 3220264 | − | GENE_03152 | Prodigal: 2.6 | CDS | 4.1.2.29 | — | — | — | P42420 | iolJ | — | — | 6-phospho-5-dehydro-2-deoxy-D-gluconate aldolase |
| Contig1 | 3220267 | 3221163 | − | GENE_03153 | Prodigal: 2.6 | CDS | 5.3.99.- | PRK09856 | — | — | P42419 | iolI | — | — | Inosose isomerase |
| Contig1 | 3221197 | 3222066 | − | GENE_03154 | Prodigal: 2.6 | CDS | — | — | — | — | — | — | — | — | fructoselysine 3-epimerase |
| Contig1 | 3222085 | 3223119 | − | GENE_03155 | Prodigal: 2.6 | CDS | 1.1.1.18 | — | — | — | P26935 | iolG | — | — | Inositol 2-dehydrogenase/D-chiro-inositol 3-dehydrogenase |
| Contig1 | 3223142 | 3224437 | − | GENE_03156 | Prodigal: 2.6 | CDS | — | — | — | — | Q46909 | ygcS | — | — | Inner membrane metabolite transport protein YgcS |
| Contig1 | 3224450 | 3225346 | − | GENE_03157 | Prodigal: 2.6 | CDS | 4.2.1.44 | — | — | — | P42416 | iolE | — | — | Inosose dehydratase |
| Contig1 | 3225362 | 3227275 | − | GENE_03158 | Prodigal: 2.6 | CDS | 3.7.1.- | — | — | — | P42415 | iolD | — | — | 3D-(3,5/4)-trihydroxy-cyclohexane-1,2-dione hydrolase |
| Contig1 | 3227300 | 3228292 | − | GENE_03159 | Prodigal: 2.6 | CDS | 2.7.1.92 | — | — | — | P42414 | iolC_2 | — | — | 5-dehydro-2-deoxygluconokinase |
| Contig1 | 3228316 | 3229131 | − | GENE_03160 | Prodigal: 2.6 | CDS | 5.3.1.- | — | — | — | P42413 | iolB | — | — | 5-deoxy-glucuronate isomerase |
| Contig1 | 3229205 | 3230668 | − | GENE_03161 | Prodigal: 2.6 | CDS | 1.2.1.27 | — | — | — | P42412 | iolA | — | — | Methylmalonate semialdehyde dehydrogenase [acylating] |
| Contig1 | 3231112 | 3231867 | + | GENE_03162 | Prodigal: 2.6 | CDS | — | — | — | — | P15082 | srlR | — | — | Glucitol operon repressor |
| Contig1 | 3231945 | 3232877 | + | GENE_03163 | Prodigal: 2.6 | CDS | 1.1.1.- | — | — | — | P80874 | yhdN_2 | — | — | General stress protein 69 |
| Contig1 | 3232997 | 3234385 | + | GENE_03164 | Prodigal: 2.6 | CDS | — | — | — | — | P46333 | csbC2 | — | — | putative metabolite transport protein CsbC |

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3234428 | 3236308 | − | GENE_03165 | Prodigal: 2.6 | CDS | — | — | — | — | P0A6Z3 | htpG | — | — | Chaperone protein HtpG |
| Contig1 | 3236480 | 3236728 | − | GENE_03166 | Prodigal: 2.6 | CDS | — | — | — | — | — | — | — | — | hypothetical protein |
| Contig1 | 3236857 | 3237678 | + | GENE_03167 | Prodigal: 2.6 | CDS | 1.1.1.- | — | — | — | Q9LBG2 | lvr | — | — | Levodione reductase |
| Contig1 | 3237738 | 3238337 | − | GENE_03168 | Prodigal: 2.6 | CDS | — | — | — | — | P13800 | degU_3 | — | — | Transcriptional regulatory protein DegU |
| Contig1 | 3238334 | 3239470 | − | GENE_03169 | Prodigal: 2.6 | CDS | 2.7.13.3 | — | — | — | O34757 | desK_2 | — | — | Sensor histidine kinase DesK |
| Contig1 | 3239593 | 3240642 | − | GENE_03170 | Prodigal: 2.6 | CDS | 1.14.19.- | — | — | MF_01839 | O34653 | des | — | — | Fatty acid desaturase |
| Contig1 | 3240864 | 3242021 | − | GENE_03171 | Prodigal: 2.6 | CDS | — | — | — | — | — | slmA | — | — | Nucleoid occlusion factor SlmA |
| Contig1 | 3242163 | 3243500 | + | GENE_03172 | Prodigal: 2.6 | CDS | 1.2.1.3 | — | — | — | P12693 | alkH_2 | — | — | Aldehyde dehydrogenase |
| Contig1 | 3243552 | 3244779 | − | GENE_03173 | Prodigal: 2.6 | CDS | 2.7.11.1 | — | — | — | P54741 | afsK | — | — | Serine/threonine-protein kinase AfsK |
| Contig1 | 3244883 | 3245302 | − | GENE_03174 | Prodigal: 2.6 | CDS | — | — | — | — | — | — | — | — | hypothetical protein |
| Contig1 | 3245457 | 3245756 | + | GENE_03175 | Prodigal: 2.6 | CDS | — | PRK10141 | — | — | — | — | — | — | DNA-binding transcriptional repressor ArsR |
| Contig1 | 3245835 | 3247001 | + | GENE_03176 | Prodigal: 2.6 | CDS | — | — | — | — | Q0GQS6 | pbuE_4 | — | — | Purine efflux pump PbuE |
| Contig1 | 3247071 | 3247526 | + | GENE_03177 | Prodigal: 2.6 | CDS | — | — | PF06271.6 | — | — | — | — | — | RDD family protein |
| Contig1 | 3247562 | 3248248 | − | GENE_03178 | Prodigal: 2.6 | CDS | — | — | PF12681.1 | — | — | — | — | — | Glyoxalase-like domain protein |
| Contig1 | 3248371 | 3250269 | − | GENE_03179 | Prodigal: 2.6 | CDS | 3.6.4.12 | — | — | MF_01451 | — | addA_2 | — | — | ATP-dependent helicase/nuclease subunit A |
| Contig1 | 3250339 | 3251229 | − | GENE_03180 | Prodigal: 2.6 | CDS | — | — | — | MF_00188 | — | htpX_3 | — | — | Protease HtpX |
| Contig1 | 3251377 | 3252288 | − | GENE_03181 | Prodigal: 2.6 | CDS | — | — | — | — | P24202 | mrr | — | — | Mrr restriction system protein |
| Contig1 | 3252850 | 3253413 | + | GENE_03182 | Prodigal: 2.6 | CDS | 1.11.1.15 | — | — | — | P80239 | ahpC | — | — | Alkyl hydroperoxide reductase subunit C |
| Contig1 | 3253427 | 3254956 | + | GENE_03183 | Prodigal: 2.6 | CDS | 1.6.99.3 | — | — | — | P42974 | ahpF | — | — | NADH dehydrogenase |
| Contig1 | 3255047 | 3256393 | − | GENE_03184 | Prodigal: 2.6 | CDS | — | — | — | — | P0AAE0 | cycA | — | — | D-serine/D-alanine/glycine transporter |
| Contig1 | 3256917 | 3258842 | + | GENE_03185 | Prodigal: 2.6 | CDS | 3.1.3.11 | — | — | — | Q45597 | fbp | — | — | Fructose-1,6-bisphosphatase class 3 |
| Contig1 | 3258895 | 3259359 | − | GENE_03186 | Prodigal: 2.6 | CDS | 1.17.2.1 | — | — | — | Q88FX9 | nicA | — | — | Nicotinate dehydrogenase subunit A |
| Contig1 | 3259352 | 3260194 | − | GENE_03187 | Prodigal: 2.6 | CDS | 1.17.1.5 | — | — | — | Q0QLF4 | ndhF | — | — | Nicotinate dehydrogenase FAD-subunit |
| Contig1 | 3260181 | 3260492 | − | GENE_03188 | Prodigal: 2.6 | CDS | 1.17.1.4 | — | — | — | Q46799 | xdhA_1 | — | — | Xanthine dehydrogenase molybdenum-binding subunit |
| Contig1 | 3260495 | 3262510 | − | GENE_03189 | Prodigal: 2.6 | CDS | 1.17.1.4 | — | — | — | Q46799 | xdhA_2 | — | — | Xanthine dehydrogenase molybdenum-binding subunit |
| Contig1 | 3262516 | 3263136 | − | GENE_03190 | Prodigal: 2.6 | CDS | — | — | — | — | O32146 | pucB | — | — | Purine catabolism protein PucB |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3263133 | 3264149 | − | GENE_03191 | Prodigal: 2.6 | CDS | 1.17.1.4 | — | — | — | O32147 | pucA | — | — | putative xanthine dehydrogenase subunit A |
| Contig1 | 3264218 | 3265231 | − | GENE_03192 | Prodigal: 2.6 | CDS | — | — | PF04632.6 | — | — | — | — | — | Fusaric acid resistance protein family protein |
| Contig1 | 3266489 | 3267529 | + | GENE_03193 | Prodigal: 2.6 | CDS | — | — | — | — | — | — | — | — | hypothetical protein |
| Contig1 | 3267545 | 3268357 | + | GENE_03194 | Prodigal: 2.6 | CDS | — | — | — | — | — | — | — | — | hypothetical protein |
| Contig1 | 3268631 | 3269320 | − | GENE_03195 | Prodigal: 2.6 | CDS | — | — | — | — | — | — | — | — | hypothetical protein |
| Contig1 | 3269339 | 3270742 | − | GENE_03196 | Prodigal: 2.6 | CDS | 3.1.5.1 | — | — | — | P15723 | dgt | — | — | Deoxyguanosine-triphosphate triphosphohydrolase |
| Contig1 | 3270823 | 3271302 | − | GENE_03197 | Prodigal: 2.6 | CDS | 2.1.1.177 | — | — | — | Q45601 | rlmH | — | — | Ribosomal RNA large subunit methyltransferase H |
| Contig1 | 3271383 | 3271553 | − | GENE_03198 | Prodigal: 2.6 | CDS | — | — | — | — | — | — | — | — | hypothetical protein |
| Contig1 | 3271707 | 3271877 | − | GENE_03199 | Prodigal: 2.6 | CDS | — | — | — | — | — | — | — | — | hypothetical protein |
| Contig1 | 3272194 | 3272889 | − | GENE_03200 | Prodigal: 2.6 | CDS | — | — | — | — | — | — | — | — | hypothetical protein |
| Contig1 | 3273017 | 3274180 | − | GENE_03201 | Prodigal: 2.6 | CDS | — | — | — | — | — | — | — | — | hypothetical protein |
| Contig1 | 3274191 | 3274940 | − | GENE_03202 | Prodigal: 2.6 | CDS | — | — | — | — | — | — | — | — | hypothetical protein |
| Contig1 | 3275122 | 3276102 | + | GENE_03203 | Prodigal: 2.6 | CDS | 1.1.1.- | — | — | — | P80874 | yhdN_3 | — | — | General stress protein 69 |
| Contig1 | 3276132 | 3276605 | − | GENE_03204 | Prodigal: 2.6 | CDS | 2.3.1.- | — | — | — | O32292 | yycN | — | — | putative N-acetyl-transferase YycN |
| Contig1 | 3276643 | 3276777 | − | GENE_03205 | Prodigal: 2.6 | CDS | — | — | — | — | — | — | — | — | hypothetical protein |
| Contig1 | 3276764 | 3277879 | − | GENE_03206 | Prodigal: 2.6 | CDS | 3.1.-.- | — | — | — | P96649 | rapI | — | — | Response regulator aspartate phosphatase I |
| Contig1 | 3278010 | 3278900 | − | GENE_03207 | Prodigal: 2.6 | CDS | 3.5.3.1 | — | — | — | P39138 | rocF | — | — | Arginase |
| Contig1 | 3278974 | 3280374 | − | GENE_03208 | Prodigal: 2.6 | CDS | — | — | — | — | P39137 | rocE_2 | — | — | Amino-acid permease RocE |
| Contig1 | 3280598 | 3281803 | − | GENE_03209 | Prodigal: 2.6 | CDS | 2.6.1.13 | — | — | — | P38021 | rocD | — | — | Ornithine aminotransferase |
| Contig1 | 3282033 | 3282668 | − | GENE_03210 | Prodigal: 2.6 | CDS | — | — | — | — | O32241 | sdpI | — | — | Immunity protein SdpI |
| Contig1 | 3282665 | 3282952 | − | GENE_03211 | Prodigal: 2.6 | CDS | — | — | — | — | O32242 | sdpR | — | — | Transcriptional repressor SdpR |
| Contig1 | 3283125 | 3284540 | + | GENE_03212 | Prodigal: 2.6 | CDS | — | — | — | — | P38022 | rocR_2 | — | — | Arginine utilization regulatory protein RocR |
| Contig1 | 3284582 | 3285301 | − | GENE_03213 | Prodigal: 2.6 | CDS | — | — | PF02373.16 | — | — | — | — | — | JmjC domain protein |
| Contig1 | 3285315 | 3286940 | − | GENE_03214 | Prodigal: 2.6 | CDS | — | — | — | — | P0A9W3 | yjjK | — | — | putative ABC transporter ATP-binding protein YjjK |
| Contig1 | 3286968 | 3288158 | − | GENE_03215 | Prodigal: 2.6 | CDS | — | PRK11551 | — | — | — | — | — | — | putative 3-hydroxyphenylpropionic transporter MhpT |
| Contig1 | 3288177 | 3289499 | − | GENE_03216 | Prodigal: 2.6 | CDS | — | — | PF00496.16 | — | — | — | — | — | Bacterial extracellular solute-binding proteins, family 5 Middle |
| Contig1 | 3289496 | 3290503 | − | GENE_03217 | Prodigal: 2.6 | CDS | 2.7.7.80 | — | — | — | P12282 | moeB | — | — | Molybdopterin-synthase adenylyltransferase |
| Contig1 | 3290735 | 3292153 | − | GENE_03218 | Prodigal: 2.6 | CDS | 2.7.13.3 | — | — | — | O69729 | tcrY_2 | — | — | putative sensor histidine kinase TcrY |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3292150 | 3292362 | − | GENE_03219 | Prodigal: 2.6 | CDS | — | — | PF00486.22 | — | — | — | — | Transcriptional protein, C regulatory terminal | hypothetical protein |
| Contig1 | 3292854 | 3294050 | − | GENE_03220 | Prodigal: 2.6 | CDS | 3.4.21.107 | — | — | — | Q9LA06 | htrA_2 | — | — | Serine protease Do-like HtrA |
| Contig1 | 3294137 | 3294931 | − | GENE_03221 | Prodigal: 2.6 | CDS | 3.-.-.- | — | — | — | C0SP91 | yycJ | — | — | Putative metallo-hydrolase YycJ |
| Contig1 | 3294946 | 3295785 | − | GENE_03222 | Prodigal: 2.6 | CDS | — | — | — | — | Q45612 | yycI | — | — | Two-component system YycFG regulatory protein |
| Contig1 | 3295772 | 3297130 | − | GENE_03223 | Prodigal: 2.6 | CDS | — | — | — | — | Q794W0 | yycH | — | — | Two-component system YycF/YycG regulatory protein YycH |
| Contig1 | 3297120 | 3298955 | − | GENE_03224 | Prodigal: 2.6 | CDS | 2.7.13.3 | — | — | — | Q45614 | yycG_2 | — | — | Sensor histidine kinase YycG |
| Contig1 | 3298962 | 3299672 | − | GENE_03225 | Prodigal: 2.6 | CDS | — | — | — | — | P37478 | yycF | — | — | Transcriptional regulatory protein YycF |
| Contig1 | 3300004 | 3300077 | − | GENE_03226 | Aragorn: 1.2 | tRNA | — | — | — | — | — | — | — | — | tRNA-Phe(gaa) |
| Contig1 | 3300114 | 3300190 | − | GENE_03227 | Aragorn: 1.2 | tRNA | — | — | — | — | — | — | — | — | tRNA-Asp(gtc) |
| Contig1 | 3300274 | 3300347 | − | GENE_03228 | Aragorn: 1.2 | tRNA | — | — | — | — | — | — | — | — | tRNA-Glu(ttc) |
| Contig1 | 3300355 | 3300430 | − | GENE_03229 | Aragorn: 1.2 | tRNA | — | — | — | — | — | — | — | — | tRNA-Lys(ttt) |
| Contig1 | 3300632 | 3301924 | − | GENE_03230 | Prodigal: 2.6 | CDS | 6.3.4.4 | — | — | — | Q8LJI9 | purA | — | — | Adenylosuccinate synthetase |
| Contig1 | 3302163 | 3302576 | − | GENE_03231 | Prodigal: 2.6 | CDS | — | — | PF12681.1 | — | — | — | — | — | Glyoxalase-like domain protein |
| Contig1 | 3302694 | 3304067 | − | GENE_03232 | Prodigal: 2.6 | CDS | 3.6.4.12 | — | — | — | P37469 | dnaC | — | — | Replicative DNA helicase |
| Contig1 | 3304228 | 3304425 | + | GENE_03233 | Prodigal: 2.6 | CDS | — | — | — | — | — | — | — | — | hypothetical protein |
| Contig1 | 3304457 | 3304666 | + | GENE_03234 | Prodigal: 2.6 | CDS | — | — | — | — | — | — | — | — | hypothetical protein |
| Contig1 | 3304785 | 3304928 | + | GENE_03235 | Prodigal: 2.6 | CDS | — | — | — | — | — | — | — | — | hypothetical protein |
| Contig1 | 3305315 | 3306607 | − | GENE_03236 | Prodigal: 2.6 | CDS | 2.4.1.11 | — | — | — | O53279 | — | — | — | Glycogen synthase |
| Contig1 | 3306630 | 3307685 | − | GENE_03237 | Prodigal: 2.6 | CDS | — | — | PF01636.17 | — | — | — | — | — | Phosphotransferase enzyme familyprotein |
| Contig1 | 3307678 | 3308556 | − | GENE_03238 | Prodigal: 2.6 | CDS | 6.3.1.12 | — | — | — | H8L902 | — | — | — | D-aspartate ligase |
| Contig1 | 3308532 | 3308864 | − | GENE_03239 | Prodigal: 2.6 | CDS | — | — | — | — | — | — | — | — | hypothetical protein |
| Contig1 | 3308854 | 3310188 | − | GENE_03240 | Prodigal: 2.6 | CDS | 2.4.1.250 | — | — | — | Q8NTA6 | mshA_2 | — | — | D-inositol 3-phosphate glycosyltransferase |
| Contig1 | 3310185 | 3310841 | − | GENE_03241 | Prodigal: 2.6 | CDS | — | — | PF02585.11 | — | — | — | — | — | GlcNAc-PI de-N-acetylase |
| Contig1 | 3310929 | 3311594 | − | GENE_03242 | Prodigal: 2.6 | CDS | — | — | — | — | — | — | — | — | hypothetical protein |
| Contig1 | 3311633 | 3312082 | − | GENE_03243 | Prodigal: 2.6 | CDS | — | — | — | — | P02417 | rplI | — | — | 50S ribosomal protein L9 |
| Contig1 | 3312079 | 3314058 | − | GENE_03244 | Prodigal: 2.6 | CDS | 3.1.-.- | — | — | — | Q5SM25 | nrnA_2 | — | — | Bifunctional oligoribonuclease and PAP phosphatase NrnA |
| Contig1 | 3314089 | 3315024 | − | GENE_03245 | Prodigal: 2.6 | CDS | — | — | — | — | — | — | — | — | hypothetical protein |
| Contig1 | 3315268 | 3315420 | − | GENE_03246 | Prodigal: 2.6 | CDS | — | — | — | — | — | — | — | — | hypothetical protein |
| Contig1 | 3315512 | 3316039 | + | GENE_03247 | Prodigal: 2.6 | CDS | — | — | — | — | P23261 | cotF_3 | — | — | Spore coat protein F precursor |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3316076 | 3316447 | − | GENE_03248 | Prodigal: 2.6 | CDS | — | — | — | — | P37486 | yybR | — | — | putative HTH-type transcriptional regulator YybR |
| Contig1 | 3316654 | 3317583 | + | GENE_03249 | Prodigal: 2.6 | CDS | 3.6.1.1 | — | — | — | P37487 | PPaC | — | — | Manganese-dependent inorganic pyrophosphatase |
| Contig1 | 3317827 | 3318684 | + | GENE_03250 | Prodigal: 2.6 | CDS | — | — | — | — | P31437 | yicL | — | — | putative inner membrane transporter YicL |
| Contig1 | 3319032 | 3320453 | + | GENE_03251 | Prodigal: 2.6 | CDS | 2.4.1.10 | — | — | — | P21130 | sacB | — | — | Levansucrase precursor |
| Contig1 | 3320470 | 3322071 | + | GENE_03252 | Prodigal: 2.6 | CDS | 3.2.1.64 | — | — | — | O07003 | levB | — | — | Levanbiose-producing levanase |
| Contig1 | 3322151 | 3322813 | + | GENE_03253 | Prodigal: 2.6 | CDS | — | — | — | — | P0ACM2 | ydfH_2 | — | — | putative HTH-type transcriptional regulator YdfH |
| Contig1 | 3322891 | 3323400 | − | GENE_03254 | Prodigal: 2.6 | CDS | — | — | PF05163.6 | — | — | — | — | — | DinB family protein |
| Contig1 | 3323451 | 3324677 | − | GENE_03255 | Prodigal: 2.6 | CDS | — | — | PF07690.10 | — | — | — | — | — | Major Facilitator Superfamily protein |
| Contig1 | 3325016 | 3325384 | − | GENE_03256 | Prodigal: 2.6 | CDS | — | — | — | — | — | — | — | — | hypothetical protein |
| Contig1 | 3325415 | 3326053 | − | GENE_03257 | Prodigal: 2.6 | CDS | 1.-.-.- | — | — | — | P81102 | yodC_2 | — | — | Putative NAD(P)H nitroreductase YodC |
| Contig1 | 3326067 | 3326501 | − | GENE_03258 | Prodigal: 2.6 | CDS | — | — | — | — | B1JJ73 | slyA | — | — | Transcriptional regulator SlyA |
| Contig1 | 3326639 | 3327517 | − | GENE_03259 | Prodigal: 2.6 | CDS | — | PRK04164 | — | — | — | — | — | — | hypothetical protein |
| Contig1 | 3327700 | 3328152 | − | GENE_03260 | Prodigal: 2.6 | CDS | — | — | — | — | P69782 | hosA | — | — | Transcriptional regulator HosA |
| Contig1 | 3328273 | 3328707 | + | GENE_03261 | Prodigal: 2.6 | CDS | 2.3.1.- | — | — | — | O31628 | yjcF_2 | — | — | putative N-acetyltransferase YjcF |
| Contig1 | 3328907 | 3330361 | − | GENE_03262 | Prodigal: 2.6 | CDS | — | — | — | — | Q2G1P1 | norG_2 | — | — | HTH-type transcriptional regulator NorG |
| Contig1 | 3330497 | 3331408 | + | GENE_03263 | Prodigal: 2.6 | CDS | — | — | — | — | P0AA70 | yedA | — | — | putative inner membrane transporter YedA |
| Contig1 | 3331877 | 3332689 | + | GENE_03264 | Prodigal: 2.6 | CDS | — | — | — | — | P39075 | bmrR | — | — | Multidrug-efflux transporter 1 regulator |
| Contig1 | 3332758 | 3333447 | + | GENE_03265 | Prodigal: 2.6 | CDS | — | — | — | — | P96689 | ydiK | — | — | putative membrane protein YdfK |
| Contig1 | 3333594 | 3333755 | + | GENE_03266 | Prodigal: 2.6 | CDS | — | — | — | — | — | — | — | — | hypothetical protein |
| Contig1 | 3333785 | 3335674 | + | GENE_03267 | Prodigal: 2.6 | CDS | 5.1.3.11 | — | — | — | — | — | — | — | Cellobiose 2-epimerase |
| Contig1 | 3335671 | 3336567 | − | GENE_03268 | Prodigal: 2.6 | CDS | — | — | PF02517.10 | MF_00929 | — | — | — | — | CAAX amino terminal protease self-immunity |
| Contig1 | 3336782 | 3338113 | + | GENE_03269 | Prodigal: 2.6 | CDS | — | — | — | — | P38055 | ydjE_2 | — | — | Inner membrane metabolite transport protein YdjE |
| Contig1 | 3338144 | 3338524 | − | GENE_03270 | Prodigal: 2.6 | CDS | — | — | PF12681.1 | — | — | — | — | — | Glyoxalase-like domain protein |
| Contig1 | 3338580 | 3339518 | − | GENE_03271 | Prodigal: 2.6 | CDS | — | — | — | — | P37517 | ccpB_2 | — | — | Catabolite control protein B |
| Contig1 | 3339581 | 3340339 | − | GENE_03272 | Prodigal: 2.6 | CDS | 3.1.11.2 | — | — | — | P37454 | exoA | — | — | Exodeoxyribonuclease |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3340378 | 3340734 | − | GENE_03273 | Prodigal: 2.6 | CDS | 2.1.1.63 | — | — | — | P19220 | adaB_1 | — | — | Methylated-DNA--protein-cysteine methyltransferase, inducible |
| Contig1 | 3340741 | 3340893 | − | GENE_03274 | Prodigal: 2.6 | CDS | 2.1.1.63 | — | — | — | P19220 | adaB_2 | — | — | Methylated-DNA--protein-cysteine methyltransferase, inducible |
| Contig1 | 3340890 | 3341471 | − | GENE_03275 | Prodigal: 2.6 | CDS | 2.1.1.- | — | — | — | P19219 | adaA | — | — | Bifunctional transcriptional activator/DNA repair enzyme AdaA |
| Contig1 | 3341660 | 3341899 | − | GENE_03276 | Prodigal: 2.6 | CDS | — | — | — | — | P21475 | rpsR | — | — | 30S ribosomal protein S18 |
| Contig1 | 3341943 | 3342461 | − | GENE_03277 | Prodigal: 2.6 | CDS | — | — | — | — | P37455 | ssb | — | — | Single-stranded DNA-binding protein ssb |
| Contig1 | 3342501 | 3342788 | − | GENE_03278 | Prodigal: 2.6 | CDS | — | — | — | — | P21468 | rpsF | — | — | 30S ribosomal protein S6 |
| Contig1 | 3342900 | 3344000 | − | GENE_03279 | Prodigal: 2.6 | CDS | — | — | — | — | P44681 | ychF | — | — | Ribosome-binding ATPase YchF |
| Contig1 | 3344127 | 3346130 | − | GENE_03280 | Prodigal: 2.6 | CDS | 1.8.5.3 | — | — | — | P18775 | dmsA_2 | — | — | Dimethyl sulfoxide reductase DmsA precursor |
| Contig1 | 3346177 | 3346383 | − | GENE_03281 | Prodigal: 2.6 | CDS | — | — | — | — | — | — | — | — | hypothetical protein |
| Contig1 | 3346469 | 3347473 | − | GENE_03282 | Prodigal: 2.6 | CDS | — | — | — | — | — | — | — | — | hypothetical protein |
| Contig1 | 3347662 | 3348129 | + | GENE_03283 | Prodigal: 2.6 | CDS | 2.3.1.189 | — | — | MF_01698 | — | mshD_2 | — | — | Mycothiol acetyltransferase |
| Contig1 | 3348303 | 3348917 | + | GENE_03284 | Prodigal: 2.6 | CDS | — | — | — | — | — | — | — | — | hypothetical protein |
| Contig1 | 3348946 | 3349797 | − | GENE_03285 | Prodigal: 2.6 | CDS | — | — | — | — | Q72H91 | — | — | — | Chromosome-partitioning protein SpoOJ |
| Contig1 | 3349790 | 3350551 | − | GENE_03286 | Prodigal: 2.6 | CDS | 3.6.-.- | — | — | — | P37522 | soj | — | — | Sporulation initiation inhibitor protein Soj |
| Contig1 | 3350850 | 3351701 | − | GENE_03287 | Prodigal: 2.6 | CDS | — | — | — | — | P37524 | noc | — | — | Nucleoid occlusion protein |
| Contig1 | 3351823 | 3352542 | − | GENE_03288 | Prodigal: 2.6 | CDS | 2.1.1 | — | — | — | P25813 | rsmG | — | — | Ribosomal RNA small subunit methyltransferase G |
| Contig1 | 3352556 | 3354442 | − | GENE_03289 | Prodigal: 2.6 | CDS | 3.6.-.- | — | — | — | P64230 | mnmG | — | — | tRNA uridine 5-carboxymethylamino-methyl modification enzyme MnmG |
| Contig1 | 3354459 | 3355838 | − | GENE_03290 | Prodigal: 2.6 | CDS | — | — | — | — | Q8YN91 | mnmE | — | — | tRNA modification GTPase MnmE |
| Contig1 | 3356128 | 3356769 | − | GENE_03291 | Prodigal: 2.6 | CDS | — | — | PF01424.16 | — | — | — | — | — | R3H domain protein |
| Contig1 | 3356766 | 3357545 | − | GENE_03292 | Prodigal: 2.6 | CDS | — | — | — | — | Q01625 | misCA | — | — | Membrane protein insertase MisCA precursor |
| Contig1 | 3357676 | 3358026 | − | GENE_03293 | Prodigal: 2.6 | CDS | 3.1.26.5 | — | — | — | P25814 | rnpA | — | — | Ribonuclease P protein component |
| Contig1 | 3358949 | 3360277 | + | GENE_03294 | Prodigal: 2.6 | CDS | — | — | — | — | P05648 | dnaA_2 | — | — | Chromosomal replication initiator protein DnaA |
| Contig1 | 3360462 | 3361598 | + | GENE_03295 | Prodigal: 2.6 | CDS | 2.7.7.7 | — | — | — | P99103 | dnaN | — | — | DNA polymerase III subunit beta |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3361733 | 3361948 | + | GENE_03296 | Prodigal: 2.6 | CDS | — | — | — | — | — | — | — | — | hypothetical protein |
| Contig1 | 3361964 | 3363076 | + | GENE_03297 | Prodigal: 2.6 | CDS | — | — | — | — | Q9RVE0 | recF | — | — | DNA replication and repair protein RecF |
| Contig1 | 3363094 | 3363339 | + | GENE_03298 | Prodigal: 2.6 | CDS | — | — | — | — | — | — | — | — | hypothetical protein |
| Contig1 | 3363393 | 3365315 | + | GENE_03299 | Prodigal: 2.6 | CDS | 5.99.1.3 | — | — | — | P0A0K8 | gyrB | — | — | DNA gyrase subunit B |
| Contig1 | 3365530 | 3367989 | + | GENE_03300 | Prodigal: 2.6 | CDS | 5.99.1.3 | — | — | — | P05653 | gyrA | — | — | DNA gyrase subunit A |
| Contig1 | 3368354 | 3369901 | + | GENE_03301 | — | rRNA | — | — | — | — | — | — | — | — | 16S ribosomal RNA |
| Contig1 | 3370002 | 3370078 | + | GENE_03302 | Aragorn: 1.2 | tRNA | — | — | — | — | — | — | — | — | tRNA-Ile(gat) |
| Contig1 | 3370093 | 3370168 | + | GENE_03303 | Aragorn: 1.2 | tRNA | — | — | — | — | — | — | — | — | tRNA-Ala(tgc) |
| Contig1 | 3370253 | 3373178 | + | GENE_03304 | — | rRNA | — | — | — | — | — | — | — | — | 23S ribosomal RNA |
| Contig1 | 3373233 | 3373343 | + | GENE_03305 | — | rRNA | — | — | — | — | — | — | — | — | 5S ribosomal RNA |
| Contig1 | 3373391 | 3374380 | − | GENE_03306 | Prodigal: 2.6 | CDS | — | — | — | — | — | — | — | — | hypothetical protein |
| Contig1 | 3374462 | 3375928 | + | GENE_03307 | Prodigal: 2.6 | CDS | 1.1.1.205 | — | — | — | P218799 | guaB | — | — | Inosine-5'-monophosphate dehydrogenase |
| Contig1 | 3376081 | 3377412 | + | GENE_03308 | Prodigal: 2.6 | CDS | 3.4.16.4 | — | — | — | P08750 | dacA | — | — | D-alanyl-D-alanine carboxypeptidase DacA precursor |
| Contig1 | 3377610 | 3378494 | + | GENE_03309 | Prodigal: 2.6 | CDS | 4.-.-.- | — | — | — | P37527 | pdxS | — | — | Pyridoxal biosynthesis lyase PdxS |
| Contig1 | 3378516 | 3379106 | + | GENE_03310 | Prodigal: 2.6 | CDS | 2.6.-.- | — | — | — | P37528 | pdxT | — | — | Glutamine amidotransferase subunit PdxT |
| Contig1 | 3379426 | 3380703 | − | GENE_03311 | Prodigal: 2.6 | CDS | 6.1.1.11 | — | — | — | O66647 | serS | — | — | Serine—tRNA ligase |
| Contig1 | 3380715 | 3381860 | − | GENE_03312 | Prodigal: 2.6 | CDS | 2.7.1.165 | — | — | — | P23524 | garK | — | — | Glycerate 2-kinase |
| Contig1 | 3382078 | 3382170 | + | GENE_03313 | Aragorn: 1.2 | tRNA | — | — | — | — | — | — | — | — | tRNA-Ser(tga) |
| Contig1 | 3382301 | 3382954 | + | GENE_03314 | Prodigal: 2.6 | CDS | 2.7.1.74 | — | — | — | P37529 | dck | — | — | Deoxyadenosine/deoxycytidine kinase |
| Contig1 | 3382951 | 3383574 | − | GENE_03315 | Prodigal: 2.6 | CDS | 2.7.1.113 | — | — | — | P37530 | dgk | — | — | Deoxyguanosine kinase |
| Contig1 | 3383670 | 3384950 | − | GENE_03316 | Prodigal: 2.6 | CDS | — | — | — | — | P37531 | yaaH | — | — | Spore germination protein YaaH |
| Contig1 | 3385025 | 3385576 | − | GENE_03317 | Prodigal: 2.6 | CDS | 3.3.2.1 | — | — | — | P0ADI4 | entB | — | — | Isochorismatase |
| Contig1 | 3385659 | 3386141 | + | GENE_03318 | Prodigal: 2.6 | CDS | 3.5.4.33 | — | — | — | P21335 | tadA_2 | — | — | tRNA-specific adenosine deaminase |
| Contig1 | 3386624 | 3388315 | + | GENE_03319 | Prodigal: 2.6 | CDS | 2.7.7.7 | — | — | — | P06710 | dnaX_1 | — | — | DNA polymerase III subunit tau |
| Contig1 | 3388340 | 3388663 | + | GENE_03320 | Prodigal: 2.6 | CDS | — | — | — | — | A3DHB8 | — | — | — | Nucleoid-associated protein |
| Contig1 | 3388678 | 3389274 | + | GENE_03321 | Prodigal: 2.6 | CDS | — | — | — | — | Q932G3 | recR | — | — | Recombination protein RecR |
| Contig1 | 3389293 | 3389517 | + | GENE_03322 | Prodigal: 2.6 | CDS | — | — | — | — | — | — | — | — | hypothetical protein |
| Contig1 | 3389578 | 3389841 | + | GENE_03323 | Prodigal: 2.6 | CDS | — | — | — | — | P24282 | bofA | — | — | Sigma-K factor-processing regulatory protein BofA |
| Contig1 | 3390157 | 3391703 | + | GENE_03324 | — | rRNA | — | — | — | — | — | — | — | — | 16S ribosomal RNA |
| Contig1 | 3391804 | 3391880 | + | GENE_03325 | Aragorn: 1.2 | tRNA | — | — | — | — | — | — | — | — | tRNA-Ile(gat) |
| Contig1 | 3391895 | 3391970 | + | GENE_03326 | Aragorn: 1.2 | tRNA | — | — | — | — | — | — | — | — | tRNA-Ala(tgc) |
| Contig1 | 3392055 | 3394980 | + | GENE_03327 | — | rRNA | — | — | — | — | — | — | — | — | 23S ribosomal RNA |
| Contig1 | 3395035 | 3395145 | + | GENE_03328 | — | rRNA | — | — | — | — | — | — | — | — | 5S ribosomal RNA |
| Contig1 | 3395323 | 3395517 | + | GENE_03329 | Prodigal: 2.6 | CDS | — | — | PF10764.3 | — | — | — | — | — | Inhibitor of sigma-G Gin |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3395666 | 3396280 | + | GENE_03330 | Prodigal: 2.6 | CDS | — | — | PF10112.3 | — | — | — | — | — | 5-bromo-4-chloroindolyl phosphate hydrolysis protein |
| Contig1 | 3396296 | 3397414 | + | GENE_03331 | Prodigal: 2.6 | CDS | — | — | — | — | P60108 | — | — | — | TelA-like protein |
| Contig1 | 3397492 | 3398925 | + | GENE_03332 | Prodigal: 2.6 | CDS | 4.1.1.19 | — | — | — | P21885 | speA_2 | — | — | Arginine decarboxylase |
| Contig1 | 3398922 | 3399560 | + | GENE_03333 | Prodigal: 2.6 | CDS | 2.7.4.9 | — | — | — | Q97R91 | tmk | — | — | Thymidylate kinase |
| Contig1 | 3399631 | 3399960 | + | GENE_03334 | Prodigal: 2.6 | CDS | — | — | — | — | — | — | — | — | hypothetical protein |
| Contig1 | 3399973 | 3400413 | + | GENE_03335 | Prodigal: 2.6 | CDS | — | — | — | — | — | — | — | — | hypothetical protein |
| Contig1 | 3400425 | 3401414 | + | GENE_03336 | Prodigal: 2.6 | CDS | 2.7.7.7 | — | — | — | P06710 | dnaX_2 | — | — | DNA polymerase III subunit tau |
| Contig1 | 3401417 | 3402244 | + | GENE_03337 | Prodigal: 2.6 | CDS | — | — | PF04468.6 | — | — | — | — | PSP1 C-terminal | hypothetical protein |
| Contig1 | 3402259 | 3402618 | + | GENE_03338 | Prodigal: 2.6 | CDS | — | — | — | — | Q99WB7 | — | — | — | Initiation-control protein YabA |
| Contig1 | 3402679 | 3403422 | + | GENE_03339 | Prodigal: 2.6 | CDS | 2.1.1.223 | — | — | MF_01872 | — | yfiC | — | — | tRNA1(Val) (adenine(37)-N6)-methyltransferase |
| Contig1 | 3403409 | 3403708 | + | GENE_03340 | Prodigal: 2.6 | CDS | — | PRK00329 | — | — | — | — | — | — | GIY-YIG nuclease superfamily protein |
| Contig1 | 3403683 | 3404564 | + | GENE_03341 | Prodigal: 2.6 | CDS | 2.1.1.198 | — | — | — | P67087 | rsmI | — | — | Ribosomal RNA small subunit methyltransferase I |
| Contig1 | 3404614 | 3404898 | − | GENE_03342 | Prodigal: 2.6 | CDS | — | — | — | — | P08874 | abrB | — | — | Transition state regulatory protein AbrB |
| Contig1 | 3405387 | 3407378 | + | GENE_03343 | Prodigal: 2.6 | CDS | 6.1.1.10 | — | — | — | P67579 | metG_2 | — | — | Methionine-tRNA ligase |
| Contig1 | 3407454 | 3408221 | + | GENE_03344 | Prodigal: 2.6 | CDS | 3.1.21.- | — | — | — | P0AFQ7 | ycfH | — | — | putative deoxyribonuclease YcfH |
| Contig1 | 3408320 | 3409681 | + | GENE_03345 | Prodigal: 2.6 | CDS | 3.1.26.8 | — | — | — | O34669 | yocH3 | — | — | Cell wall-binding protein YocH precursor |
| Contig1 | 3409816 | 3410379 | + | GENE_03346 | Prodigal: 2.6 | CDS | 2.1.1.182 | — | — | — | P3754 | mmV_2 | — | — | Ribonuclease M5 |
| Contig1 | 3410369 | 3411250 | + | GENE_03347 | Prodigal: 2.6 | CDS | — | — | — | — | P66662 | rsmA | — | — | Ribosomal RNA small subunit methyltransferase A |
| Contig1 | 3411423 | 3412298 | + | GENE_03348 | Prodigal: 2.6 | CDS | 3.4.-.- | — | — | — | P37548 | yabG | — | — | Sporulation-specific protease YabG |
| Contig1 | 3412510 | 3412770 | + | GENE_03349 | Prodigal: 2.6 | CDS | — | — | — | — | — | — | — | — | hypothetical protein |
| Contig1 | 3412933 | 3413121 | + | GENE_03350 | Prodigal: 2.6 | CDS | — | — | PF00269.14 | — | — | — | — | — | Small, acid-soluble spore proteins, alpha/beta type |
| Contig1 | 3413265 | 3414134 | + | GENE_03351 | Prodigal: 2.6 | CDS | 2.7.1.148 | — | — | — | P65178 | ispE | — | — | 4-diphosphocytidyl-2-C-methyl-D-erythritol kinase |
| Contig1 | 3414190 | 3415047 | + | GENE_03352 | Prodigal: 2.6 | CDS | — | — | — | — | P37551 | purR | — | — | Pur operon repressor |
| Contig1 | 3415044 | 3415424 | + | GENE_03353 | Prodigal: 2.6 | CDS | 3.5.4.- | — | — | — | P37552 | yabJ | — | — | Enamine/imine deaminase |
| Contig1 | 3415620 | 3415913 | + | GENE_03354 | Prodigal: 2.6 | CDS | — | — | — | — | P28015 | spoVG | — | — | Putative septation protein SpoVG |
| Contig1 | 3416105 | 3417475 | + | GENE_03355 | Prodigal: 2.6 | CDS | — | — | — | — | Q7A7B4 | glmU | — | — | Bifunctional protein GlmU |
| Contig1 | 3417497 | 3418450 | + | GENE_03356 | Prodigal: 2.6 | CDS | 2.7.6.1 | — | — | — | P14193 | prs_2 | — | — | Ribose-phosphate pyrophosphokinase |

TABLE 5-continued

| #ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3418535 | 3419143 | + | GENE_03357 | Prodigal: 2.6 | CDS | — | — | — | — | P14194 | ctc | — | — | General stress protein CTC |
| Contig1 | 3419228 | 3419794 | + | GENE_03358 | Prodigal: 2.6 | CDS | 3.1.1.29 | — | — | — | Q6YP15 | pth | — | — | Peptidyl-tRNA hydrolase |
| Contig1 | 3419856 | 3420086 | + | GENE_03359 | Prodigal: 2.6 | CDS | — | — | — | — | — | — | — | — | hypothetical protein |
| Contig1 | 3420156 | 3423689 | + | GENE_03360 | Prodigal: 2.6 | CDS | 3.6.4.- | — | — | — | Q7A7B2 | mfd | — | — | Transcription-repair-coupling factor |
| Contig1 | 3423826 | 3424362 | + | GENE_03361 | Prodigal: 2.6 | CDS | — | — | — | — | P37554 | spoVT | — | — | Stage V sporulation protein T |
| Contig1 | 3424530 | 3426110 | + | GENE_03362 | Prodigal: 2.6 | CDS | — | — | — | — | O34674 | ytgP_2 | — | — | putative cell division protein YtgP |
| Contig1 | 3426100 | 3427575 | + | GENE_03363 | Prodigal: 2.6 | CDS | 3.6.1.8 | — | — | — | P0AEY3 | mazG | — | — | Nucleoside triphosphate pyrophosphohydrolase |
| Contig1 | 3427577 | 3427837 | + | GENE_03364 | Prodigal: 2.6 | CDS | — | — | — | — | P0ACG8 | hslR | — | — | Heat shock protein 15 |
| Contig1 | 3427916 | 3428218 | + | GENE_03365 | Prodigal: 2.6 | CDS | — | — | — | — | P37558 | yabP | — | — | Spore protein YabP |
| Contig1 | 3428215 | 3428850 | + | GENE_03366 | Prodigal: 2.6 | CDS | — | — | — | — | P37559 | yabQ | — | — | Spore protein YabQ |
| Contig1 | 3428868 | 3429245 | + | GENE_03367 | Prodigal: 2.6 | CDS | — | — | — | — | P37471 | divIC | — | — | Cell division protein DivIC |
| Contig1 | 3429326 | 3429712 | + | GENE_03368 | Prodigal: 2.6 | CDS | — | — | — | — | P80870 | yugI_2 | — | — | General stress protein 13 |
| Contig1 | 3429870 | 3429946 | + | GENE_03369 | Aragorn: 1.2 | tRNA | — | — | — | — | — | — | — | — | tRNA-Met(cat) |
| Contig1 | 3429955 | 3430029 | + | GENE_03370 | Aragorn: 1.2 | tRNA | — | — | — | — | — | — | — | — | tRNA-Glu(ttc) |
| Contig1 | 3430237 | 3432726 | + | GENE_03371 | Prodigal: 2.6 | CDS | 3.1.3.16 | — | — | — | P37475 | spoIIE | — | — | Stage II sporulation protein E |
| Contig1 | 3432794 | 3433531 | + | GENE_03372 | Prodigal: 2.6 | CDS | — | — | PF00092.22 | — | — | — | — | — | von Willebrand factor type A domain protein |
| Contig1 | 3433497 | 3434498 | + | GENE_03373 | Prodigal: 2.6 | CDS | 2.7.11.1 | — | — | — | A6QGC0 | prkC_2 | — | — | Serine/threonine-protein kinase PrkC |
| Contig1 | 3434603 | 3436021 | + | GENE_03374 | Prodigal: 2.6 | CDS | 6.3.4.19 | — | — | — | P37563 | tilS | — | — | tRNA(Ile)-lysidine synthase |
| Contig1 | 3436018 | 3436557 | + | GENE_03375 | Prodigal: 2.6 | CDS | 2.4.2.8 | — | — | — | Q5XEL6 | hpt | — | — | Hypoxanthine-guanine phosphoribosyltransferase |
| Contig1 | 3436655 | 3438574 | + | GENE_03376 | Prodigal: 2.6 | CDS | 3.4.24.- | — | — | — | P37476 | ftsH | — | — | ATP-dependent zinc metalloprotease FtsH |
| Contig1 | 3438723 | 3439499 | + | GENE_03377 | Prodigal: 2.6 | CDS | 2.7.1.33 | — | — | — | P37564 | coaX | — | — | Type III pantothenate kinase |
| Contig1 | 3439510 | 3440385 | + | GENE_03378 | Prodigal: 2.6 | CDS | — | — | — | — | P37565 | hslO | — | — | 33 kDa chaperonin |
| Contig1 | 3440449 | 3441321 | + | GENE_03379 | Prodigal: 2.6 | CDS | 5.2.1.8 | — | — | — | Q81TU1 | prsA2 | — | — | Foldase protein PrsA 2 precursor |
| Contig1 | 3441397 | 3442323 | + | GENE_03380 | Prodigal: 2.6 | CDS | 2.5.1.47 | — | — | — | P37887 | cysK_2 | — | — | Cysteine synthase |
| Contig1 | 3442488 | 3443912 | + | GENE_03381 | Prodigal: 2.6 | CDS | 2.6.1.85 | — | — | — | P28820 | pabB | — | — | Aminodeoxychorismate synthase component 1 |
| Contig1 | 3443919 | 3444506 | + | GENE_03382 | Prodigal: 2.6 | CDS | 2.6.1.85 | — | — | — | P28819 | pabA | — | — | Aminodeoxychorismate/anthranilate synthase component 2 |
| Contig1 | 3444503 | 3445387 | + | GENE_03383 | Prodigal: 2.6 | CDS | 2.6.1.21 | — | — | — | P99090 | dat_2 | — | — | D-alanine aminotransferase |
| Contig1 | 3445368 | 3446225 | + | GENE_03384 | Prodigal: 2.6 | CDS | 2.5.1.15 | — | — | — | Q5XCA8 | folP | — | — | Dihydropteroate synthase |
| Contig1 | 3446218 | 3446680 | + | GENE_03385 | Prodigal: 2.6 | CDS | 4.1.2.25 | — | — | — | P56740 | folB | — | — | Dihydroneopterin aldolase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3446577 | 3447080 | + | GENE_03386 | Prodigal: 2.6 | CDS | — | — | — | — | P59657 | sulD | — | — | Bifunctional folate synthesis protein |
| Contig1 | 3447032 | 3447241 | + | GENE_03387 | Prodigal: 2.6 | CDS | — | — | PF01381.16 | — | — | — | — | — | Helix-turn-helix |
| Contig1 | 3447263 | 3448264 | + | GENE_03388 | Prodigal: 2.6 | CDS | 1.-.-.- | — | — | — | P33371 | dusC | — | — | tRNA-dihydrouridine synthase C |
| Contig1 | 3448354 | 3449853 | + | GENE_03389 | Prodigal: 2.6 | CDS | 6.1.1.6 | — | — | — | Q9RHV9 | lysS | — | — | Lysine–tRNA ligase |
| Contig1 | 3450184 | 3451731 | + | GENE_03390 | — | rRNA | — | — | — | — | — | — | — | — | 16S ribosomal RNA |
| Contig1 | 3451909 | 3454834 | + | GENE_03391 | — | rRNA | — | — | — | — | — | — | — | — | 23S ribosomal RNA |
| Contig1 | 3454889 | 3454999 | + | GENE_03392 | — | rRNA | — | — | — | — | — | — | — | — | 5S ribosomal RNA |
| Contig1 | 3455026 | 3455101 | + | GENE_03393 | Aragorn: 1.2 | tRNA | — | — | — | — | — | — | — | — | tRNA-Val(tac) |
| Contig1 | 3455107 | 3455182 | + | GENE_03394 | Aragorn: 1.2 | tRNA | — | — | — | — | — | — | — | — | tRNA-Thr(tgt) |
| Contig1 | 3455219 | 3455294 | + | GENE_03395 | Aragorn: 1.2 | tRNA | — | — | — | — | — | — | — | — | tRNA-Lys(ttt) |
| Contig1 | 3455301 | 3455382 | + | GENE_03396 | Aragorn: 1.2 | tRNA | — | — | — | — | — | — | — | — | tRNA-Leu(tag) |
| Contig1 | 3455407 | 3455481 | + | GENE_03397 | Aragorn: 1.2 | tRNA | — | — | — | — | — | — | — | — | tRNA-Gly(gcc) |
| Contig1 | 3455496 | 3455581 | + | GENE_03398 | Aragorn: 1.2 | tRNA | — | — | — | — | — | — | — | — | tRNA-Leu(taa) |
| Contig1 | 3455593 | 3455669 | + | GENE_03399 | Aragorn: 1.2 | tRNA | — | — | — | — | — | — | — | — | tRNA-Arg(acg) |
| Contig1 | 3455686 | 3455762 | + | GENE_03400 | Aragorn: 1.2 | tRNA | — | — | — | — | — | — | — | — | tRNA-Pro(tgg) |
| Contig1 | 3455767 | 3455842 | + | GENE_03401 | Aragorn: 1.2 | tRNA | — | — | — | — | — | — | — | — | tRNA-Ala(tgc) |
| Contig1 | 3456010 | 3457557 | + | GENE_03402 | — | rRNA | — | — | — | — | — | — | — | — | 16S ribosomal RNA |
| Contig1 | 3457735 | 3460659 | + | GENE_03403 | — | rRNA | — | — | — | — | — | — | — | — | 23S ribosomal RNA |
| Contig1 | 3460714 | 3460824 | + | GENE_03404 | — | rRNA | — | — | — | — | — | — | — | — | 5S ribosomal RNA |
| Contig1 | 3461055 | 3461519 | + | GENE_03405 | Prodigal: 2.6 | CDS | — | — | — | — | P37568 | ctsR | — | — | Transcriptional regulator CtsR |
| Contig1 | 3461710 | 3462090 | + | GENE_03406 | Prodigal: 2.6 | CDS | — | — | PF02151.13 | — | — | — | — | — | UvrB/uvrC motif protein |
| Contig1 | 3462090 | 3463181 | + | GENE_03407 | Prodigal: 2.6 | CDS | 2.7.3.- | — | — | — | P65205 | — | — | — | Putative ATP:guanido phosphotransferase |
| Contig1 | 3463178 | 3465610 | + | GENE_03408 | Prodigal: 2.6 | CDS | — | — | — | — | P37571 | clpC | — | — | Negative regulator of genetic competence ClpC/MecB |
| Contig1 | 3465704 | 3467083 | + | GENE_03409 | Prodigal: 2.6 | CDS | — | — | — | — | A0R563 | — | — | DNA repair protein RadA homolog | hypothetical protein |
| Contig1 | 3467087 | 3468169 | + | GENE_03410 | Prodigal: 2.6 | CDS | 2.7.7.85 | — | — | — | P37573 | disA_2 | — | — | DNA integrity scanning protein DisA |
| Contig1 | 3468283 | 3469383 | + | GENE_03411 | Prodigal: 2.6 | CDS | 3.1.-.- | — | — | — | Q5SKV3 | — | — | — | putative PIN and TRAM-domain containing protein precursor |
| Contig1 | 3469396 | 3470094 | + | GENE_03412 | Prodigal: 2.6 | CDS | 2.7.7.60 | — | — | — | Q46893 | ispD | — | — | 2-C-methyl-D-erythritol 4-phosphate cytidylyltransferase |
| Contig1 | 3470087 | 3470563 | + | GENE_03413 | Prodigal: 2.6 | CDS | 4.6.1.12 | — | — | — | Q06756 | ispF | — | — | 2-C-methyl-D-erythritol 2,4-cyclodiphosphate synthase |
| Contig1 | 3470655 | 3472106 | + | GENE_03414 | Prodigal: 2.6 | CDS | 6.1.1.17 | — | — | — | P99170 | gltX | — | — | Glutamate-tRNA ligase |
| Contig1 | 3472417 | 3473070 | + | GENE_03415 | Prodigal: 2.6 | CDS | 2.3.1.30 | — | — | — | Q06750 | cysE | — | — | Serine acetyltransferase |
| Contig1 | 3473067 | 3474467 | + | GENE_03416 | Prodigal: 2.6 | CDS | 6.1.1.16 | — | — | — | Q06752 | cysS | — | — | Cysteine-tRNA ligase |
| Contig1 | 3474472 | 3474903 | + | GENE_03417 | Prodigal: 2.6 | CDS | 3.1.26.- | — | — | — | O31418 | mrnC | — | — | Mini-ribonuclease 3 |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3474887 | 3475636 | + | GENE_03718 | Prodigal: 2.6 | CDS | 2.1.1.- | — | — | — | Q7A794 | — | — | — | Putative TrmH family tRNA/rRNA |
| Contig1 | 3475643 | 3476155 | + | GENE_03419 | Prodigal: 2.6 | CDS | — | — | PF05991.5 | — | — | — | — | — | YacP-like NYN domain protein |
| Contig1 | 3476218 | 3476874 | + | GENE_03420 | Prodigal: 2.6 | CDS | — | — | — | — | P17869 | sigH | — | — | RNA polymerase sigma-H factor |
| Contig1 | 3477142 | 3477321 | + | GENE_03421 | Prodigal: 2.6 | CDS | — | — | — | MF_00422 | — | secE | — | — | Protein translocase subunit SecE |
| Contig1 | 3477429 | 3478019 | + | GENE_03422 | Prodigal: 2.6 | CDS | — | — | — | — | Q06795 | — | — | Transcription termination/anti-termination protein NusG | hypothetical protein |
| Contig1 | 3478187 | 3478612 | + | GENE_03423 | Prodigal: 2.6 | CDS | — | — | — | — | Q06796 | rplK | — | — | 50S ribosomal protein L11 |
| Contig1 | 3478707 | 3479405 | + | GENE_03424 | Prodigal: 2.6 | CDS | — | — | — | — | Q06797 | rplA | — | — | 50S ribosomal protein L1 |
| Contig1 | 3479660 | 3480160 | + | GENE_03425 | Prodigal: 2.6 | CDS | — | — | — | — | P42923 | rplJ | — | — | 50S ribosomal protein L10 |
| Contig1 | 3480202 | 3480573 | + | GENE_03426 | Prodigal: 2.6 | CDS | — | — | — | — | P02394 | rplL | — | — | 50S ribosomal protein L7/L12 |
| Contig1 | 3480665 | 3481270 | + | GENE_03427 | Prodigal: 2.6 | CDS | 2.1.1.174 | — | — | — | P42596 | rlmG | — | — | Ribosomal RNA large subunit methyltransferase G |
| Contig1 | 3481515 | 3485096 | + | GENE_03428 | Prodigal: 2.6 | CDS | 2.7.7.6 | — | — | — | P37870 | rpoB | — | — | DNA-directed RNA polymerase subunit beta |
| Contig1 | 3485159 | 3488758 | + | GENE_03429 | Prodigal: 2.6 | CDS | 2.7.7.6 | — | — | — | P37871 | rpoC | — | — | DNA-directed RNA polymerase subunit beta' |
| Contig1 | 3488926 | 3489174 | + | GENE_03430 | Prodigal: 2.6 | CDS | — | — | — | — | P46350 | rplGB | — | — | Ribosome-associated protein L7Ae-like protein |
| Contig1 | 3489290 | 3489706 | + | GENE_03431 | Prodigal: 2.6 | CDS | — | — | — | — | P21472 | rpsL | — | — | 30S ribosomal protein S12 |
| Contig1 | 3489747 | 3490217 | + | GENE_03432 | Prodigal: 2.6 | CDS | — | — | — | — | P21469 | rpsG | — | — | 30S ribosomal protein S7 |
| Contig1 | 3490270 | 3492348 | + | GENE_03433 | Prodigal: 2.6 | CDS | — | — | — | — | P80868 | fusA | — | — | Elongation factor G |
| Contig1 | 3492468 | 3493658 | + | GENE_03434 | Prodigal: 2.6 | CDS | — | — | — | — | P99152 | tuf | — | — | Elongation factor Tu |
| Contig1 | 3493762 | 3494727 | + | GENE_03435 | Prodigal: 2.6 | CDS | 3.4.11.5 | — | — | — | P46541 | pip | — | — | Proline iminopeptidase |
| Contig1 | 3494976 | 3495284 | + | GENE_03436 | Prodigal: 2.6 | CDS | — | — | — | — | P21471 | rpsJ | — | — | 30S ribosomal protein S10 |
| Contig1 | 3495324 | 3495953 | + | GENE_03437 | Prodigal: 2.6 | CDS | — | — | — | — | P42920 | rplC | — | — | 50S ribosomal protein L3 |
| Contig1 | 3495981 | 3496604 | + | GENE_03438 | Prodigal: 2.6 | CDS | — | — | — | — | P42921 | rplD | — | — | 50S ribosomal protein L4 |
| Contig1 | 3496604 | 3496891 | + | GENE_03439 | Prodigal: 2.6 | CDS | — | — | — | — | P42924 | rplW | — | — | 50S ribosomal protein L23 |
| Contig1 | 3496923 | 3497756 | + | GENE_03440 | Prodigal: 2.6 | CDS | — | — | — | — | P42919 | rplB | — | — | 50S ribosomal protein L2 |
| Contig1 | 3497814 | 3498092 | + | GENE_03441 | Prodigal: 2.6 | CDS | — | — | — | — | P21476 | rpsS | — | — | 30S ribosomal protein S19 |
| Contig1 | 3498109 | 3498450 | + | GENE_03442 | Prodigal: 2.6 | CDS | — | — | — | — | P42060 | rplV | — | — | 50S ribosomal protein L22 |
| Contig1 | 3498454 | 3499110 | + | GENE_03443 | Prodigal: 2.6 | CDS | — | — | — | — | P21465 | rpsC | — | — | 30S ribosomal protein S3 |
| Contig1 | 3499112 | 3499546 | + | GENE_03444 | Prodigal: 2.6 | CDS | — | — | — | — | Q7A461 | rplP | — | — | 50S ribosomal protein L16 |
| Contig1 | 3499536 | 3499736 | + | GENE_03445 | Prodigal: 2.6 | CDS | — | — | — | — | P12873 | rpmC | — | — | 50S ribosomal protein L29 |
| Contig1 | 3499759 | 3500022 | + | GENE_03446 | Prodigal: 2.6 | CDS | — | — | — | — | P12874 | rpsQ | — | — | 30S ribosomal protein S17 |
| Contig1 | 3500063 | 3500431 | + | GENE_03447 | Prodigal: 2.6 | CDS | — | — | — | — | P12875 | rplN | — | — | 50S ribosomal protein L14 |
| Contig1 | 3500468 | 3500779 | + | GENE_03448 | Prodigal: 2.6 | CDS | — | — | — | — | P0CI78 | rplX | — | — | 50S ribosomal protein L24 |
| Contig1 | 3500806 | 3501345 | + | GENE_03449 | Prodigal: 2.6 | CDS | — | — | — | — | P12877 | rplE | — | — | 50S ribosomal protein L5 |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3501368 | 3501553 | + | GENE_03450 | Prodigal: 2.6 | CDS | — | — | — | — | P12878 | rpsN1 | — | — | 30S ribosomal protein S14 |
| Contig1 | 3501585 | 3501983 | + | GENE_03451 | Prodigal: 2.6 | CDS | — | — | — | — | P12879 | rpsH | — | — | 30S ribosomal protein S8 |
| Contig1 | 3502014 | 3502553 | + | GENE_03452 | Prodigal: 2.6 | CDS | — | — | — | — | P46898 | rplF | — | — | 50S ribosomal protein L6 |
| Contig1 | 3502588 | 3502950 | + | GENE_03453 | Prodigal: 2.6 | CDS | — | — | — | — | P46899 | rplR | — | — | 50S ribosomal protein L18 |
| Contig1 | 3502969 | 3503475 | + | GENE_03454 | Prodigal: 2.6 | CDS | — | — | — | — | P21467 | rpsE | — | — | 30S ribosomal protein S5 |
| Contig1 | 3503489 | 3503668 | + | GENE_03455 | Prodigal: 2.6 | CDS | — | — | — | — | P19947 | rpmD | — | — | 50S ribosomal protein L30 |
| Contig1 | 3503699 | 3504139 | + | GENE_03456 | Prodigal: 2.6 | CDS | — | — | — | — | P19946 | rplO | — | — | 50S ribosomal protein L15 |
| Contig1 | 3504141 | 3505436 | + | GENE_03457 | Prodigal: 2.6 | CDS | — | — | — | MF_01465 | — | secY | — | — | Protein translocase subunit SecY |
| Contig1 | 3505488 | 3506141 | + | GENE_03458 | Prodigal: 2.6 | CDS | 27.4.3 | — | — | — | P16304 | adk | — | — | Adenylate kinase |
| Contig1 | 3506135 | 3506884 | + | GENE_03459 | Prodigal: 2.6 | CDS | 3.4.11.18 | — | — | — | P19994 | map | — | — | Methionine aminopeptidase 1 |
| Contig1 | 3507209 | 3507427 | + | GENE_03460 | Prodigal: 2.6 | CDS | — | — | — | — | P20458 | infA | — | — | Translation initiation factor IF-1 |
| Contig1 | 3507461 | 3507574 | + | GENE_03461 | Prodigal: 2.6 | CDS | — | — | — | — | P07841 | rpmJ | — | — | 50S ribosomal protein L36 |
| Contig1 | 3507597 | 3507962 | + | GENE_03462 | Prodigal: 2.6 | CDS | — | — | — | — | P20282 | rpsM | — | — | 30S ribosomal protein S13 |
| Contig1 | 3507983 | 3508378 | + | GENE_03463 | Prodigal: 2.6 | CDS | — | — | — | — | P66357 | rpsK | — | — | 30S ribosomal protein S11 |
| Contig1 | 3508555 | 3509499 | + | GENE_03464 | Prodigal: 2.6 | CDS | 2.7.7.6 | — | — | — | P20429 | rpoA | — | — | DNA-directed RNA polymerase subunit alpha |
| Contig1 | 3509577 | 3509939 | + | GENE_03465 | Prodigal: 2.6 | CDS | — | — | — | — | P20277 | rplQ | — | — | 50S ribosomal protein L17 |
| Contig1 | 3510071 | 3510916 | + | GENE_03466 | Prodigal: 2.6 | CDS | 3.6.3.- | — | — | — | Q035B2 | ecfA1 | — | — | Energy-coupling factor transporter ATP-binding protein EcfA1 |
| Contig1 | 3510892 | 3511761 | + | GENE_03467 | Prodigal: 2.6 | CDS | 3.6.3.- | — | — | — | A2RI02 | ecfA2 | — | — | Energy-coupling factor transporter ATP-binding protein EcfA2 |
| Contig1 | 3511758 | 3512555 | + | GENE_03468 | Prodigal: 2.6 | CDS | — | — | — | — | P70972 | ecfT | — | — | Energy-coupling factor transporter transmembrane protein EcfT |
| Contig1 | 3512568 | 3513311 | + | GENE_03469 | Prodigal: 2.6 | CDS | 5.4.99.12 | — | — | — | Q5SHU9 | truA | — | — | tRNA pseudouridine synthase A |
| Contig1 | 3513471 | 3513908 | + | GENE_03470 | Prodigal: 2.6 | CDS | — | — | — | — | P70974 | rplM | — | — | 50S ribosomal protein L13 |
| Contig1 | 3513929 | 3514321 | + | GENE_03471 | Prodigal: 2.6 | CDS | — | — | — | — | P21470 | rpsI | — | — | 30S ribosomal protein S9 |
| Contig1 | 3514459 | 3515226 | + | GENE_03472 | Prodigal: 2.6 | CDS | — | — | PF08241.6 | — | — | — | — | — | Methyltransferase domain protein |
| Contig1 | 3515240 | 3515713 | − | GENE_03473 | Prodigal: 2.6 | CDS | — | — | PF05163.6 | — | — | — | — | — | DinB family protein |
| Contig1 | 3515844 | 3516287 | + | GENE_03474 | Prodigal: 2.6 | CDS | — | — | — | — | — | — | — | — | hypothetical protein |
| Contig1 | 3516348 | 3517061 | − | GENE_03475 | Prodigal: 2.6 | CDS | 3.5.1.28 | — | — | — | P50864 | cwlD | — | — | Germination-specific N-acetylmuramoyl-L-alanine amidase precursor |
| Contig1 | 3517141 | 3518193 | + | GENE_03476 | Prodigal: 2.6 | CDS | — | — | — | — | Q01464 | minD_2 | — | — | Septum site-determining protein MinD |
| Contig1 | 3518226 | 3518381 | − | GENE_03477 | Prodigal: 2.6 | CDS | — | — | — | — | P16450 | gerD_1 | — | — | Spore germination protein GerD precursor |
| Contig1 | 3518444 | 3518782 | − | GENE_03478 | Prodigal: 2.6 | CDS | — | — | — | — | P16450 | gerD_2 | — | — | Spore germination protein GerD precursor |
| Contig1 | 3518890 | 3519486 | + | GENE_03479 | Prodigal: 2.6 | CDS | — | — | — | — | — | — | — | — | hypothetical protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3519487 | 3520251 | − | GENE_03480 | Prodigal: 2.6 | CDS | 3.5.1.104 | — | — | — | Q8DP63 | pgdA_2 | — | — | Peptidoglycan-N-acetylglucosamine deacetylase |
| Contig1 | 3520595 | 3522142 | + | GENE_03481 | — | rRNA | — | — | — | — | — | — | — | — | 16S ribosomal RNA |
| Contig1 | 3522320 | 3525243 | + | GENE_03482 | — | rRNA | — | — | — | — | — | — | — | — | 23S ribosomal RNA |
| Contig1 | 3525298 | 3525408 | + | GENE_03483 | — | rRNA | — | — | — | — | — | — | — | — | 5S ribosomal RNA |
| Contig1 | 3525457 | 3525531 | + | GENE_03484 | Aragorn: 1.2 | tRNA | — | — | — | — | — | — | — | — | tRNA-Asn(gtt) |
| Contig1 | 3525534 | 3525606 | + | GENE_03485 | Aragorn: 1.2 | tRNA | — | — | — | — | — | — | — | — | tRNA-Thr(ggt) |
| Contig1 | 3525903 | 3525977 | + | GENE_03486 | Aragorn: 1.2 | tRNA | — | — | — | — | — | — | — | — | tRNA-Gly(gcc) |
| Contig1 | 3526010 | 3526086 | + | GENE_03487 | Aragorn: 1.2 | tRNA | — | — | — | — | — | — | — | — | tRNA-Arg(acg) |
| Contig1 | 3526103 | 3526179 | + | GENE_03488 | Aragorn: 1.2 | tRNA | — | — | — | — | — | — | — | — | tRNA-Pro(tgg) |
| Contig1 | 3526483 | 3528030 | + | GENE_03489 | — | rRNA | — | — | — | — | — | — | — | — | 16S ribosomal RNA |
| Contig1 | 3528208 | 3531133 | + | GENE_03490 | — | rRNA | — | — | — | — | — | — | — | — | 23S ribosomal RNA |
| Contig1 | 3531188 | 3531298 | + | GENE_03491 | — | rRNA | — | — | — | — | — | — | — | — | 5S ribosomal RNA |
| Contig1 | 3531397 | 3532611 | − | GENE_03492 | Prodigal: 2.6 | CDS | — | — | — | — | O07563 | glcP | — | — | Glucose/mannose transporter GlcP |
| Contig1 | 3532837 | 3534105 | + | GENE_03493 | Prodigal: 2.6 | CDS | 2.6.1.- | — | — | — | Q5SHH5 | argD_2 | — | — | Acetylornithine/acetyl-lysine aminotransferase |
| Contig1 | 3534102 | 3535052 | + | GENE_03494 | Prodigal: 2.6 | CDS | — | — | — | — | — | — | — | — | bifunctional inositol-1 monophosphatase/fructose-1,6-bisphosphatase |
| Contig1 | 3535027 | 3536073 | + | GENE_03495 | Prodigal: 2.6 | CDS | 1.1.1.14 | — | — | — | Q06004 | gutB_3 | — | — | Sorbitol dehydrogenase |
| Contig1 | 3536305 | 3537738 | + | GENE_03496 | Prodigal: 2.6 | CDS | — | PRK12676 | — | — | P0AFR2 | dauA_2 | — | — | C4-dicarboxylic acid transporter DauA |
| Contig1 | 3537847 | 3538830 | + | GENE_03497 | Prodigal: 2.6 | CDS | — | — | PF01758.10 | — | — | — | — | — | Sodium Bile acid symporter family protein |
| Contig1 | 3538819 | 3539571 | − | GENE_03498 | Prodigal: 2.6 | CDS | — | PRK10439 | — | — | — | — | — | — | enterobactin/ferric enterobactin esterase |
| Contig1 | 3539568 | 3540590 | − | GENE_03499 | Prodigal: 2.6 | CDS | — | — | — | — | P40411 | feuC_3 | — | — | Iron-uptake system permease protein FeuC |
| Contig1 | 3540580 | 3541587 | − | GENE_03500 | Prodigal: 2.6 | CDS | — | — | — | — | P40410 | feuB_3 | — | — | Iron-uptake system permease protein FeuB |
| Contig1 | 3541607 | 3542563 | − | GENE_03501 | Prodigal: 2.6 | CDS | — | — | — | — | P40409 | feuA | — | — | Iron-uptake system-binding protein precursor |
| Contig1 | 3542651 | 3544246 | − | GENE_03502 | Prodigal: 2.6 | CDS | — | — | — | — | P40408 | btr_2 | — | — | HTH-type transcriptional activator Btr |
| Contig1 | 3544384 | 3545628 | − | GENE_03503 | Prodigal: 2.6 | CDS | — | — | — | — | — | — | — | — | hypothetical protein |
| Contig1 | 3545644 | 3547557 | − | GENE_03504 | Prodigal: 2.6 | CDS | — | — | — | — | — | ybbD | — | — | putative lipoprotein YbbD precursor |
| Contig1 | 3547604 | 3548887 | − | GENE_03505 | Prodigal: 2.6 | CDS | 3.1.1 | — | — | — | Q9KX40 | estB | — | — | Esterase EstB |
| Contig1 | 3548906 | 3550273 | − | GENE_03506 | Prodigal: 2.6 | CDS | — | — | — | — | Q7A804 | — | — | — | PTS system EIIBC component |
| Contig1 | 3550402 | 3551331 | − | GENE_03507 | Prodigal: 2.6 | CDS | 4.2.1.126 | — | — | — | Q45582 | murQ | — | — | N-acetylmuramic acid 6-phosphate etherase |
| Contig1 | 3551431 | 3551907 | − | GENE_03508 | Prodigal: 2.6 | CDS | — | — | PF00583.18 | — | — | — | — | — | Acetyltransferase (GNAT) family protein |
| Contig1 | 3551926 | 3552378 | − | GENE_03509 | Prodigal: 2.6 | CDS | — | — | — | — | — | — | — | — | hypothetical protein |
| Contig1 | 3552559 | 3552630 | + | GENE_03510 | Aragorn: 1.2 | tRNA | — | — | — | — | — | — | — | — | tRNA-Glu(ttc) |
| Contig1 | 3552634 | 3552709 | + | GENE_03511 | Aragorn: 1.2 | tRNA | — | — | — | — | — | — | — | — | tRNA-Val(tac) |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3552715 | 3552788 | + | GENE_03512 | Aragorn: 1.2 | tRNA | — | — | — | — | — | — | — | — | tRNA-Thr(tgt) |
| Contig1 | 3552807 | 3552891 | + | GENE_03513 | Aragorn: 1.2 | tRNA | — | — | — | — | — | — | — | — | tRNA-Tyr(tgta) |
| Contig1 | 3552895 | 3552969 | + | GENE_03514 | Aragorn: 1.2 | tRNA | — | — | — | — | — | — | — | — | tRNA-Gln(ttg) |
| Contig1 | 3553199 | 3553762 | + | GENE_03515 | Prodigal: 2.6 | CDS | — | — | — | — | Q45585 | sigW | — | — | ECF RNA polymerase sigma factor SigW |
| Contig1 | 3553776 | 3554402 | + | GENE_03516 | Prodigal: 2.6 | CDS | — | — | — | — | Q45588 | rsiW | — | — | Anti-sigma-W factor RsiW |
| Contig1 | 3554570 | 3555391 | + | GENE_03517 | Prodigal: 2.6 | CDS | 2.7.7.85 | — | — | MF_01438 | — | disA_3 | — | — | DNA integrity scanning protein DisA |
| Contig1 | 3555384 | 3556823 | + | GENE_03518 | Prodigal: 2.6 | CDS | — | — | PF07949.6 | — | — | — | — | — | YbbR-like protein |
| Contig1 | 3556841 | 3558187 | + | GENE_03519 | Prodigal: 2.6 | CDS | 5.4.2.10 | — | — | — | O34824 | glmM | — | — | Phosphoglucosamine mutase |
| Contig1 | 3558619 | 3560421 | + | GENE_03520 | Prodigal: 2.6 | CDS | 2.6.1.16 | — | — | — | P64228 | glmS | — | — | Glutamine-fructose-6-phosphate aminotransferase [isomerizing] |
| Contig1 | 3560845 | 3561717 | + | GENE_03521 | Prodigal: 2.6 | CDS | — | — | — | — | O34641 | ytrB_2 | — | — | ABC transporter ATP-binding protein YtrB |
| Contig1 | 3561695 | 3562348 | − | GENE_03522 | Prodigal: 2.6 | CDS | — | — | — | — | — | — | — | — | hypothetical protein |
| Contig1 | 3562463 | 3563371 | − | GENE_03523 | Prodigal: 2.6 | CDS | — | — | — | — | — | — | — | — | hypothetical protein |
| Contig1 | 3563473 | 3564639 | + | GENE_03524 | Prodigal: 2.6 | CDS | — | — | — | — | — | — | — | — | hypothetical protein |
| Contig1 | 3564692 | 3565537 | − | GENE_03525 | Prodigal: 2.6 | CDS | 1.1.1.274 | — | — | — | P15339 | dkgB | — | — | 2,5-diketo-D-gluconic acid reductase B |
| Contig1 | 3565648 | 3566340 | − | GENE_03526 | Prodigal: 2.6 | CDS | — | — | — | — | P60639 | cidB | — | — | Holin-like protein CidB |
| Contig1 | 3566310 | 3566807 | − | GENE_03527 | Prodigal: 2.6 | CDS | — | — | — | — | P60647 | cidA_2 | — | — | Holin-like protein CidA |
| Contig1 | 3566906 | 3567340 | + | GENE_03528 | Prodigal: 2.6 | CDS | — | — | PF01047.16 | — | — | — | — | — | MarR family protein |
| Contig1 | 3567340 | 3567444 | + | GENE_03529 | Prodigal: 2.6 | CDS | — | — | — | — | — | — | — | — | hypothetical protein |
| Contig1 | 3567766 | 3569151 | + | GENE_03530 | Prodigal: 2.6 | CDS | — | — | — | — | P27837 | yifK | — | — | putative transport protein YifK |
| Contig1 | 3569244 | 3569948 | + | GENE_03531 | Prodigal: 2.6 | CDS | 3.-.-.- | — | — | — | O06480 | yfnB | — | — | Putative HAD-hydrolase YfnB |
| Contig1 | 3570004 | 3571161 | + | GENE_03532 | Prodigal: 2.6 | CDS | 2.7.13.3 | — | — | — | O32198 | liaS_3 | — | — | Sensor histidine kinase LiaS |
| Contig1 | 3571185 | 3571838 | + | GENE_03533 | Prodigal: 2.6 | CDS | — | — | — | — | P13800 | degU_4 | — | — | Transcriptional regulatory protein DegU |
| Contig1 | 3572056 | 3572988 | + | GENE_03534 | Prodigal: 2.6 | CDS | 3.6.3.- | — | — | — | P32010 | drrA_3 | — | — | Daunorubicin/doxorubicin resistance ATP-binding protein DrrA |
| Contig1 | 3573004 | 3574212 | + | GENE_03535 | Prodigal: 2.6 | CDS | — | — | PF12698.1 | — | — | — | — | — | ABC-2 family transporter protein |
| Contig1 | 3574215 | 3575378 | + | GENE_03536 | Prodigal: 2.6 | CDS | — | — | PF12698.1 | — | — | — | — | — | ABC-2 family transporter protein |
| Contig1 | 3575434 | 3575607 | + | GENE_03537 | Prodigal: 2.6 | CDS | — | — | — | — | — | — | — | — | hypothetical protein |
| Contig1 | 3575679 | 3576374 | + | GENE_03538 | Prodigal: 2.6 | CDS | 1.1.-.- | — | — | — | Q70LM8 | lgrE_2 | — | — | Linear gramicidin dehydrogenase LgrE |
| Contig1 | 3576746 | 3584368 | + | GENE_03539 | Prodigal: 2.6 | CDS | — | — | — | — | P27206 | srfAA_1 | — | — | Surfactin synthase subunit 1 |
| Contig1 | 3584328 | 3595085 | + | GENE_03540 | Prodigal: 2.6 | CDS | — | — | — | — | Q70LM4 | lgrD_2 | — | — | Linear gramicidin synthase subunit D |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3595168 | 3596421 | + | GENE_03541 | Prodigal: 2.6 | CDS | 2.3.1.39 | — | — | — | Q9R9J2 | fenF_2 | — | — | Malonyl CoA-acyl carrier protein transacylase |
| Contig1 | 3596465 | 3601237 | + | GENE_03542 | Prodigal: 2.6 | CDS | — | — | — | — | P40872 | pksM_3 | — | — | Polyketide synthase PksM |
| Contig1 | 3601423 | 3606213 | + | GENE_03543 | Prodigal: 2.6 | CDS | 2.3.1.- | — | — | — | O31782 | pksN_7 | — | — | Polyketide synthase PksN |
| Contig1 | 3606292 | 3607758 | + | GENE_03544 | Prodigal: 2.6 | CDS | 1.3.99.28 | — | — | — | P17054 | crtI | — | — | Phytoene desaturase (neurosporene-forming) |
| Contig1 | 3607853 | 3614473 | + | GENE_03545 | Prodigal: 2.6 | CDS | 2.3.1.- | — | — | — | P39846 | ppsB_2 | — | — | Plipastatin synthase subunit B |
| Contig1 | 3614494 | 3615537 | + | GENE_03546 | Prodigal: 2.6 | CDS | 2.1.1.- | — | — | — | P16559 | tcmN | — | — | Multifunctional cyclase-dehydratase-3-O-methyl transferase TcmN |
| Contig1 | 3615694 | 3616170 | + | GENE_03547 | Prodigal: 2.6 | CDS | — | — | — | — | O31994 | yolA | — | — | SPBc2 prophage-derived uncharacterized protein YolA precursor |
| Contig1 | 3616248 | 3616499 | + | GENE_03548 | Prodigal: 2.6 | CDS | — | — | — | — | — | — | — | — | hypothetical protein |
| Contig1 | 3616609 | 3617307 | - | GENE_03549 | Prodigal: 2.6 | CDS | — | — | — | — | — | — | — | — | hypothetical protein |
| Contig1 | 3617353 | 3617613 | - | GENE_03550 | Prodigal: 2.6 | CDS | — | — | — | — | — | — | — | — | hypothetical protein |
| Contig1 | 3617781 | 3619418 | + | GENE_03551 | Prodigal: 2.6 | CDS | — | — | — | — | — | — | — | — | Aspartate-proton symporter |
| Contig1 | 3619981 | 3620277 | + | GENE_03552 | Prodigal: 2.6 | CDS | — | — | — | — | — | — | — | — | hypothetical protein |
| Contig1 | 3620234 | 3621184 | + | GENE_03553 | Prodigal: 2.6 | CDS | — | — | — | — | — | — | — | — | hypothetical protein |
| Contig1 | 3621252 | 3621500 | + | GENE_03554 | Prodigal: 2.6 | CDS | — | — | — | — | — | — | — | — | hypothetical protein |
| Contig1 | 3621684 | 3622568 | - | GENE_03555 | Prodigal: 2.6 | CDS | 3.1.4.46 | — | — | — | O07002 | yveE_2 | — | — | putative glycerophosphoryl diester phosphodiesterase 1 |
| Contig1 | 3622664 | 3623998 | - | GENE_03556 | Prodigal: 2.6 | CDS | — | — | — | — | P96236 | glpQ1 | — | — | Glycerol-3-phosphate transporter |
| Contig1 | 3624333 | 3624575 | + | GENE_03557 | Prodigal: 2.6 | CDS | — | — | — | — | P08194 | glpT | — | — | hypothetical protein |
| Contig1 | 3624631 | 3626079 | - | GENE_03558 | Prodigal: 2.6 | CDS | 1.14.14.9 | — | — | — | Q5SJP8 | — | — | — | 4-hydroxyphenylacetate 3-monooxygenase oxygenase component |
| Contig1 | 3626228 | 3626653 | - | GENE_03559 | Prodigal: 2.6 | CDS | — | — | PF01471.12 | — | — | — | — | — | hypothetical protein |
| Contig1 | 3626726 | 3628900 | - | GENE_03560 | Prodigal: 2.6 | CDS | — | — | — | — | — | — | — | — | Putative peptidoglycan binding domain protein |
| Contig1 | 3629280 | 3629723 | + | GENE_03561 | Prodigal: 2.6 | CDS | — | — | PF12844.1 | — | — | — | — | — | hypothetical protein |
| Contig1 | 3629986 | 3630456 | + | GENE_03562 | Prodigal: 2.6 | CDS | — | — | — | — | — | — | — | — | Helix-turn-helix domain protein |
| Contig1 | 3630529 | 3631599 | + | GENE_03563 | Prodigal: 2.6 | CDS | 1.1.1.6 | — | — | — | Q9WYQ4 | gldA_2 | — | — | Glycerol dehydrogenase |
| Contig1 | 3631681 | 3632835 | + | GENE_03564 | Prodigal: 2.6 | CDS | 2.1.2.- | — | — | — | P33221 | purT | — | — | Phosphoribosyl-glycinamide formyltransferase 2 |
| Contig1 | 3633312 | 3633845 | + | GENE_03565 | Prodigal: 2.6 | CDS | 27.8.5 | — | — | MF_01437 | — | pgsA_2 | — | — | CDP-diacylglycerol--glycerol-3-phosphate 3-phosphatidyltransferase |
| Contig1 | 3633836 | 3634324 | + | GENE_03566 | Prodigal: 2.6 | CDS | — | — | — | — | P33366 | yohD | — | — | Inner membrane protein YohD |
| Contig1 | 3634317 | 3635132 | + | GENE_03567 | Prodigal: 2.6 | CDS | 4.1.1.65 | — | — | — | P0A8K1 | psd | — | — | Phosphatidylserine decarboxylase proenzyme |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3635175 | 3635450 | + | GENE_03568 | Prodigal: 2.6 | CDS | — | — | — | — | — | — | — | — | hypothetical protein |
| Contig1 | 3635557 | 3636525 | + | GENE_03569 | Prodigal: 2.6 | CDS | 2.8.1.1 | — | — | MF_01009 | P24943 | glpE_2 | — | — | Thiosulfate sulfurtransferase GlpE |
| Contig1 | 3636562 | 3637812 | — | GENE_03570 | Prodigal: 2.6 | CDS | — | — | — | — | — | gltT_2 | — | — | Proton/sodium-glutamate symport protein |
| Contig1 | 3638183 | 3639250 | + | GENE_03571 | Prodigal: 2.6 | CDS | 2.6.1.42 | — | — | — | O31461 | ilvE | — | — | Branched-chain-amino-acid transaminase 1 |
| Contig1 | 3639291 | 3640754 | — | GENE_03572 | Prodigal: 2.6 | CDS | — | — | — | — | P39636 | rocC_2 | — | — | Amino-acid permease RocC |
| Contig1 | 3640808 | 3641755 | — | GENE_03573 | Prodigal: 2.6 | CDS | 2.1.1.10 | — | — | — | Q47690 | mmuM | — | — | Homocysteine S-methyltransferase |
| Contig1 | 3641871 | 3643307 | — | GENE_03574 | Prodigal: 2.6 | CDS | — | — | — | — | Q45068 | alsT_2 | — | — | Amino-acid carrier protein AlsT |
| Contig1 | 3643332 | 3644315 | — | GENE_03575 | Prodigal: 2.6 | CDS | 3.5.1.2 | — | — | — | O31465 | glsA1 | — | — | Glutaminase 1 |
| Contig1 | 3644559 | 3645851 | + | GENE_03576 | Prodigal: 2.6 | CDS | 2.7.13.3 | — | — | — | P40758 | glnK | — | — | Sensor histidine kinase GlnK |
| Contig1 | 3645853 | 3646800 | + | GENE_03577 | Prodigal: 2.6 | CDS | — | — | — | — | P06534 | spo0A_2 | — | — | Stage 0 sporulation protein A |
| Contig1 | 3647097 | 3648017 | + | GENE_03578 | Prodigal: 2.6 | CDS | — | — | PF01636.17 | — | — | — | — | — | Phosphotransferase enzyme family protein |
| Contig1 | 3648405 | 3648569 | + | GENE_03579 | Prodigal: 2.6 | CDS | — | — | — | — | O31466 | rtpA | — | — | Tryptophan RNA-binding attenuator protein inhibitory protein |
| Contig1 | 3648649 | 3649542 | — | GENE_03580 | Prodigal: 2.6 | CDS | — | — | — | — | O07084 | czcD_1 | — | — | Cadmium, cobalt and zinc/H(+)-K(+) antiporter |
| Contig1 | 3649940 | 3650560 | + | GENE_03581 | Prodigal: 2.6 | CDS | 1.-.-.- | — | — | — | P96692 | mhqN | — | — | Putative NAD(P)H nitroreductase MhqN |
| Contig1 | 3650585 | 3651523 | + | GENE_03582 | Prodigal: 2.6 | CDS | 1.13.11.- | — | — | — | P96693 | mhqO | — | — | Putative ring-cleaving dioxygenase MhqO |
| Contig1 | 3651659 | 3652048 | + | GENE_03583 | Prodigal: 2.6 | CDS | 1.-.-.- | — | — | — | P96694 | mhqP | — | — | Putative oxidoreductase MhqP |
| Contig1 | 3652228 | 3652566 | — | GENE_03584 | Prodigal: 2.6 | CDS | — | — | PF00085.14 | — | — | — | — | — | Thioredoxin |
| Contig1 | 3652905 | 3653288 | — | GENE_03585 | Prodigal: 2.6 | CDS | — | — | — | — | — | — | — | — | hypothetical protein |
| Contig1 | 3653442 | 3653870 | + | GENE_03586 | Prodigal: 2.6 | CDS | — | — | — | — | P42249 | cwlJ | — | — | Cell wall hydrolase CwlJ |
| Contig1 | 3654134 | 3655885 | + | GENE_03587 | Prodigal: 2.6 | CDS | 3.1.3.1 | — | — | — | P42251 | phoD | — | — | Alkaline phosphatase D precursor |
| Contig1 | 3655898 | 3656095 | + | GENE_03588 | Prodigal: 2.6 | CDS | — | — | — | — | O31467 | tatAd | — | — | Sec-independent protein translocase protein TatAd |
| Contig1 | 3656157 | 3656882 | + | GENE_03589 | Prodigal: 2.6 | CDS | — | — | — | — | P42252 | tatC1 | — | — | Sec-independent protein translocase protein TatCd |
| Contig1 | 3656879 | 3657526 | — | GENE_03590 | Prodigal: 2.6 | CDS | 3.4.19.3 | — | — | — | P46107 | pcp | — | — | Pyrrolidone-carboxylate peptidase |
| Contig1 | 3657598 | 3658725 | + | GENE_03591 | Prodigal: 2.6 | CDS | 2.8.1.7 | — | — | — | P99177 | csd_2 | — | — | putative cysteine desulfurase |
| Contig1 | 3658762 | 3660195 | — | GENE_03592 | Prodigal: 2.6 | CDS | — | — | — | — | P0AEJ0 | emrB_3 | — | — | Multidrug export protein EmrB |
| Contig1 | 3660238 | 3660804 | — | GENE_03593 | Prodigal: 2.6 | CDS | — | — | — | — | P42105 | yxaF_2 | — | — | putative HTH-type transcriptional regulator YxaF |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3660982 | 3662097 | + | GENE_03594 | Prodigal: 2.6 | CDS | 3.5.1.1 | — | — | — | O34482 | ansZ | — | — | L-asparaginase 2 precursor |
| Contig1 | 3662294 | 3662938 | + | GENE_03595 | Prodigal: 2.6 | CDS | 3.1.1.3 | PRK05590 | — | — | P37957 | estA | — | — | Lipase EstA precursor |
| Contig1 | 3663076 | 3664146 | + | GENE_03596 | Prodigal: 2.6 | CDS | — | — | — | — | — | — | — | — | hypothetical protein |
| Contig1 | 3664277 | 3665209 | + | GENE_03597 | Prodigal: 2.6 | CDS | 1.1.1.- | — | — | — | P80874 | yhdN_4 | — | — | General stress protein 69 |
| Contig1 | 3665253 | 3666248 | - | GENE_03598 | Prodigal: 2.6 | CDS | — | — | PF11611.2 | — | — | — | — | — | Telomeric repeat-binding factor 2 |
| Contig1 | 3666377 | 3667777 | + | GENE_03599 | Prodigal: 2.6 | CDS | — | — | — | — | — | — | — | — | hypothetical protein |
| Contig1 | 3667978 | 3669336 | + | GENE_03600 | Prodigal: 2.6 | CDS | — | — | — | — | — | — | — | — | hypothetical protein |
| Contig1 | 3669333 | 3669836 | - | GENE_03601 | Prodigal: 2.6 | CDS | 3.4.-.- | — | — | — | O34360 | cwlK | — | — | Peptidoglycan L-alanyl-D-glutamate endopeptidase CwlK precursor |
| Contig1 | 3669946 | 3671067 | + | GENE_03602 | Prodigal: 2.6 | CDS | 3.1.-.- | — | — | — | O34327 | rapJ | — | — | Response regulator aspartate phosphatase J |
| Contig1 | 3671183 | 3671962 | + | GENE_03603 | Prodigal: 2.6 | CDS | 1.1.1.47 | — | — | — | P80869 | yedF | — | — | Glucose 1-dehydrogenase 2 |
| Contig1 | 3672046 | 3673725 | + | GENE_03604 | Prodigal: 2.6 | CDS | 3.2.1.10 | — | — | — | O34364 | yedG | — | — | putative oligo-1,6-glucosidase 2 |
| Contig1 | 3673865 | 3674869 | + | GENE_03605 | Prodigal: 2.6 | CDS | — | — | — | — | O34966 | znuA | — | — | High-affinity zinc uptake system binding-protein ZnuA precursor |
| Contig1 | 3674924 | 3675619 | + | GENE_03606 | Prodigal: 2.6 | CDS | 3.6.3.- | — | — | — | O34946 | znuC | — | — | High-affinity zinc uptake system ATP-binding protein ZnuC |
| Contig1 | 3675583 | 3676416 | + | GENE_03607 | Prodigal: 2.6 | CDS | — | — | — | — | O34610 | znuB | — | — | High-affinity zinc uptake system membrane protein ZnuB |
| Contig1 | 3676461 | 3677456 | - | GENE_03608 | Prodigal: 2.6 | CDS | 1.14.14.3 | — | — | — | P07740 | luxA_3 | — | — | Alkanal monooxygenase alpha chain |
| Contig1 | 3677732 | 3678328 | + | GENE_03609 | Prodigal: 2.6 | CDS | — | — | — | — | P81100 | yceC | — | — | Stress response protein SCP2 |
| Contig1 | 3678352 | 3678933 | + | GENE_03610 | Prodigal: 2.6 | CDS | — | — | — | — | P80875 | yceD_1 | — | — | General stress protein 16U |
| Contig1 | 3678967 | 3679545 | + | GENE_03611 | Prodigal: 2.6 | CDS | — | — | — | — | P80875 | yceD_2 | — | — | General stress protein 16U |
| Contig1 | 3679584 | 3680357 | + | GENE_03612 | Prodigal: 2.6 | CDS | — | — | — | — | P42601 | alx | — | — | Inner membrane protein alx |
| Contig1 | 3680430 | 3682052 | + | GENE_03613 | Prodigal: 2.6 | CDS | — | — | — | — | — | — | — | — | hypothetical protein |
| Contig1 | 3682059 | 3683147 | + | GENE_03614 | Prodigal: 2.6 | CDS | — | — | — | — | P60108 | — | — | — | TelA-like protein |
| Contig1 | 3683262 | 3684464 | + | GENE_03615 | Prodigal: 2.6 | CDS | — | — | — | — | O34691 | naiP | — | — | Putative niacin/nicotinamide transporter NaiP |
| Contig1 | 3684847 | 3686103 | + | GENE_03616 | Prodigal: 2.6 | CDS | 3.6.3.32 | — | — | — | P46920 | opuAA | — | — | Glycine betaine transport ATP-binding protein OpuAA |
| Contig1 | 3686104 | 3686952 | + | GENE_03617 | Prodigal: 2.6 | CDS | — | — | — | — | P46921 | opuAB | — | — | Glycine betaine transport system permease protein OpuAB |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3686952 | 3687833 | + | GENE_03618 | Prodigal: 2.6 | CDS | — | — | — | — | P46922 | opuAC | — | — | Glycine betaine-binding protein OpuAC precursor |
| Contig1 | 3687869 | 3688990 | + | GENE_03619 | Prodigal: 2.6 | CDS | 3.-.-.- | PRK11588 | — | — | P54955 | yxeP_1 | — | — | putative hydrolase YxeP |
| Contig1 | 3689125 | 3690558 | + | GENE_03620 | Prodigal: 2.6 | CDS | — | — | — | — | — | — | — | — | hypothetical protein |
| Contig1 | 3690650 | 3691132 | + | GENE_03621 | Prodigal: 2.6 | CDS | — | — | — | — | — | — | — | — | hypothetical protein |
| Contig1 | 3691380 | 3693359 | + | GENE_03622 | Prodigal: 2.6 | CDS | 3.2.1.1 | — | — | — | P00691 | amyE | — | — | Alpha-amylase precursor |
| Contig1 | 3693630 | 3694583 | + | GENE_03623 | Prodigal: 2.6 | CDS | 1.1.1.27 | — | — | — | P13714 | ldh_2 | — | — | L-lactate dehydrogenase |
| Contig1 | 3694625 | 3696157 | − | GENE_03624 | Prodigal: 2.6 | CDS | — | — | — | — | P96712 | bmr3_4 | — | — | Multidrug resistance protein 3 |
| Contig1 | 3696272 | 3696733 | + | GENE_03625 | Prodigal: 2.6 | CDS | — | — | — | — | O31672 | mhqR_3 | — | — | HTH-type transcriptional regulator MhqR |
| Contig1 | 3696797 | 3697426 | + | GENE_03626 | Prodigal: 2.6 | CDS | — | — | — | — | — | — | — | — | leucine export protein LeuE |
| Contig1 | 3697491 | 3698252 | + | GENE_03627 | Prodigal: 2.6 | CDS | — | — | PF08892.5 | — | — | — | — | — | YqcI/YcgG family protein |
| Contig1 | 3698254 | 3699582 | − | GENE_03628 | Prodigal: 2.6 | CDS | — | PRK10958 | — | — | P15993 | aroP | — | — | Aromatic amino acid transport protein AroP |
| Contig1 | 3699707 | 3700303 | + | GENE_03629 | Prodigal: 2.6 | CDS | — | — | — | — | — | — | — | — | hypothetical protein |
| Contig1 | 3700438 | 3701256 | + | GENE_03630 | Prodigal: 2.6 | CDS | 6.3.1.5 | — | — | — | P08164 | nadE | — | — | NH(3)-dependent NAD(+) synthetase |
| Contig1 | 3701304 | 3701588 | − | GENE_03631 | Prodigal: 2.6 | CDS | — | — | — | — | P82243 | — | — | — | Antimicrobial peptide LCI |
| Contig1 | 3701769 | 3702362 | − | GENE_03632 | Prodigal: 2.6 | CDS | — | — | — | — | P12921 | tmrB | — | — | Tunicamycin resistance protein |
| Contig1 | 3702418 | 3703206 | − | GENE_03633 | Prodigal: 2.6 | CDS | 4.2.1.118 | — | — | — | Q81RQ4 | asbF | — | — | 3-dehydroshikimate dehydratase |
| Contig1 | 3703409 | 3704719 | + | GENE_03634 | Prodigal: 2.6 | CDS | — | — | — | — | P0AA76 | dgoT | — | — | D-galactonate transporter |
| Contig1 | 3704845 | 3705405 | + | GENE_03635 | Prodigal: 2.6 | CDS | 2.7.1.71 | — | — | — | O67925 | aroK | — | — | Shikimate kinase |
| Contig1 | 3705550 | 3706506 | + | GENE_03636 | Prodigal: 2.6 | CDS | 3.1.1.41 | — | — | — | P94388 | cah | — | — | Cephalosporin-C deacetylase |
| Contig1 | 3706572 | 3707357 | + | GENE_03637 | Prodigal: 2.6 | CDS | — | — | PF10127.3 | — | — | — | — | — | putative nucleotidyltransferase |
| Contig1 | 3707545 | 3708456 | + | GENE_03638 | Prodigal: 2.6 | CDS | 1.5.5.2 | — | — | — | O32179 | fadM_2 | — | — | Proline dehydrogenase 1 |
| Contig1 | 3708474 | 3710021 | + | GENE_03639 | Prodigal: 2.6 | CDS | 1.2.1.88 | — | — | — | Q65NN2 | rocA_2 | — | — | 1-pyrroline-5-carboxylate dehydrogenase |
| Contig1 | 3710137 | 3711567 | + | GENE_03640 | Prodigal: 2.6 | CDS | — | — | — | — | Q7A4Q7 | putP_2 | — | — | Sodium/proline symporter |
| Contig1 | 3711725 | 3712960 | + | GENE_03641 | Prodigal: 2.6 | CDS | — | — | — | — | P37047 | cdaR_3 | — | — | Carbohydrate diacid regulator |
| Contig1 | 3713159 | 3714169 | + | GENE_03642 | Prodigal: 2.6 | CDS | 1.18.1.2 | — | — | — | O05268 | yumC_2 | — | — | Ferredoxin--NADP reductase 2 |
| Contig1 | 3714224 | 3714895 | − | GENE_03643 | Prodigal: 2.6 | CDS | 2.1.1.107 | — | — | — | P42437 | nasF_1 | — | — | Uroporphyrinogen-III C-methyltransferase |
| Contig1 | 3714859 | 3715662 | − | GENE_03644 | Prodigal: 2.6 | CDS | 2.1.1.107 | — | — | — | P42437 | nasF_2 | — | — | Uroporphyrinogen-III C-methyltransferase |
| Contig1 | 3715729 | 3716049 | − | GENE_03645 | Prodigal: 2.6 | CDS | 1.7.1.4 | — | — | — | P42436 | nasE | — | — | Assimilatory nitrite reductase [NAD(P)H] small subunit |
| Contig1 | 3716070 | 3718487 | − | GENE_03646 | Prodigal: 2.6 | CDS | 1.7.1.4 | — | — | — | P42435 | nasD | — | — | Nitrite reductase [NAD(P)H] |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3718879 | 3720081 | + | GENE_03647 | Prodigal: 2.6 | CDS | — | — | — | — | P94400 | yciC | — | — | Putative metal chaperone YciC |
| Contig1 | 3720146 | 3721282 | + | GENE_03648 | Prodigal: 2.6 | CDS | 1.2.1.46 | — | — | — | P46154 | fdhA | — | — | Glutathione-independent formaldehyde dehydrogenase |
| Contig1 | 3721294 | 3721731 | + | GENE_03649 | Prodigal: 2.6 | CDS | — | — | PF06271.6 | — | — | — | — | — | RDD family protein |
| Contig1 | 3721804 | 3722124 | + | GENE_03650 | Prodigal: 2.6 | CDS | — | — | — | — | — | — | — | — | hypothetical protein |
| Contig1 | 3722332 | 3722469 | + | GENE_03651 | Prodigal: 2.6 | CDS | 3.2.1.86 | — | — | — | P42403 | bglC | — | — | Aryl-phospho-beta-D-glucosidase BglC |
| Contig1 | 3722599 | 3722997 | − | GENE_03652 | Prodigal: 2.6 | CDS | — | — | — | — | P12669 | nin | — | — | DNA-entry nuclease inhibitor |
| Contig1 | 3723019 | 3723456 | − | GENE_03653 | Prodigal: 2.6 | CDS | 3.-.-.- | — | — | — | P42983 | nucB_2 | — | — | Sporulation-specific extracellular nuclease precursor |
| Contig1 | 3723815 | 3724372 | − | GENE_03654 | Prodigal: 2.6 | CDS | 5.3.1.27 | — | — | — | P42404 | hxlB | — | — | 3-hexulose-6-phosphate isomerase |
| Contig1 | 3724369 | 3725004 | − | GENE_03655 | Prodigal: 2.6 | CDS | 4.1.2.43 | — | — | — | P42405 | hxlA | — | — | 3-hexulose-6-phosphate synthase |
| Contig1 | 3725236 | 3725598 | + | GENE_03656 | Prodigal: 2.6 | CDS | — | — | — | — | P42406 | hxlR | — | — | HTH-type transcriptional activator HxlR |
| Contig1 | 3726187 | 3736941 | + | GENE_03657 | Prodigal: 2.6 | CDS | — | — | — | — | P27206 | srfAA_2 | — | — | Surfactin synthase subunit 1 |
| Contig1 | 3736963 | 3747726 | + | GENE_03658 | Prodigal: 2.6 | CDS | — | — | — | — | Q04747 | srfAB | — | — | Surfactin synthase subunit 2 |
| Contig1 | 3747761 | 3751597 | + | GENE_03659 | Prodigal: 2.6 | CDS | — | — | — | — | Q08787 | srfAC | — | — | Surfactin synthase subunit 3 |
| Contig1 | 3751617 | 3752348 | + | GENE_03660 | Prodigal: 2.6 | CDS | 3.1.2.- | — | — | — | Q08788 | srfAD | — | — | Surfactin synthase thioesterase subunit |
| Contig1 | 3752470 | 3753780 | + | GENE_03661 | Prodigal: 2.6 | CDS | 2.6.1.1 | — | — | — | P23034 | — | — | — | Aspartate aminotransferase |
| Contig1 | 3753816 | 3754490 | − | GENE_03662 | Prodigal: 2.6 | CDS | 2.7.8.- | — | — | — | P39135 | sfp | — | — | 4′-phosphopantetheinyl transferase sfp |
| Contig1 | 3754589 | 3755218 | − | GENE_03663 | Prodigal: 2.6 | CDS | — | — | — | — | — | — | — | — | hypothetical protein |
| Contig1 | 3755318 | 3756061 | − | GENE_03664 | Prodigal: 2.6 | CDS | 3.6.3.- | — | — | — | P39456 | — | — | — | L-cystine import ATP-binding protein TcyC |
| Contig1 | 3756074 | 3756763 | − | GENE_03665 | Prodigal: 2.6 | CDS | — | — | — | — | P42200 | tcyB | — | — | L-cystine transport system permease protein TcyB |
| Contig1 | 3756765 | 3757562 | − | GENE_03666 | Prodigal: 2.6 | CDS | — | — | — | — | P42199 | tcyA | — | — | L-cystine-binding protein TcyA precursor |
| Contig1 | 3757691 | 3758563 | − | GENE_03667 | Prodigal: 2.6 | CDS | — | — | — | — | P20668 | gltC_4 | — | — | HTH-type transcriptional regulator GltC |
| Contig1 | 3758693 | 3759271 | + | GENE_03668 | Prodigal: 2.6 | CDS | 4.1.1.- | — | — | — | P94404 | bsdB | — | — | Phenolic acid decarboxylase subunit B |
| Contig1 | 3759274 | 3760695 | + | GENE_03669 | Prodigal: 2.6 | CDS | 4.1.1.- | — | — | — | P94405 | bsdC | — | — | Phenolic acid decarboxylase subunit C |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3760713 | 3760940 | + | GENE_03670 | Prodigal: 2.6 | CDS | 4.1.1.- | — | — | — | C0H3U9 | bsdD | — | — | Phenolic acid decarboxylase subunit D |
| Contig1 | 3760940 | 3761401 | + | GENE_03671 | Prodigal: 2.6 | CDS | — | — | — | — | — | — | — | — | hypothetical protein |
| Contig1 | 3761444 | 3762922 | − | GENE_03672 | Prodigal: 2.6 | CDS | — | — | — | — | P0C2U3 | dtpT | — | — | Di-/tripeptide transporter |
| Contig1 | 3763201 | 3764946 | + | GENE_03673 | Prodigal: 2.6 | CDS | — | — | PF12708.1 | — | — | — | — | — | Pectate lyase superfamily protein |
| Contig1 | 3765039 | 3765260 | − | GENE_03674 | Prodigal: 2.6 | CDS | — | — | — | — | — | — | — | — | hypothetical protein |
| Contig1 | 3765382 | 3767022 | + | GENE_03675 | Prodigal: 2.6 | CDS | — | — | — | — | P39569 | gerBA_3 | — | — | Spore germination protein B1 |
| Contig1 | 3767009 | 3768235 | + | GENE_03676 | Prodigal: 2.6 | CDS | — | — | — | — | P39571 | gerBC_3 | — | — | Spore germination protein B3 precursor |
| Contig1 | 3768260 | 3769378 | + | GENE_03677 | Prodigal: 2.6 | CDS | — | — | — | — | O31809 | yndE_2 | — | — | Spore germination protein YndE |
| Contig1 | 3769550 | 3770872 | + | GENE_03678 | Prodigal: 2.6 | CDS | 1.14.14.10 | — | — | — | P54989 | ntaA | — | — | Nitrilotriacetate monooxygenase component A |
| Contig1 | 3770886 | 3771377 | + | GENE_03679 | Prodigal: 2.6 | CDS | 2.3.1.- | — | — | — | O34350 | ytmI_2 | — | — | putative N-acetyl-transferase YtmI |
| Contig1 | 3771406 | 3772197 | + | GENE_03680 | Prodigal: 2.6 | CDS | — | — | — | — | P54952 | yxeM | — | — | putative amino-acid-binding protein YxeM precursor |
| Contig1 | 3772220 | 3772894 | + | GENE_03681 | Prodigal: 2.6 | CDS | — | — | — | — | P54953 | yxeN | — | — | putative amino-acid permease protein YxeN |
| Contig1 | 3772908 | 3773657 | + | GENE_03682 | Prodigal: 2.6 | CDS | 3.6.3.- | — | — | — | P54954 | yxeO | — | — | putative amino-acid import ATP-binding protein YxeO |
| Contig1 | 3773675 | 3774826 | + | GENE_03683 | Prodigal: 2.6 | CDS | 3.-.-.- | — | PF03972.8 | — | P54955 | yxeP_2 | — | — | putative hydrolase YxeP |
| Contig1 | 3774823 | 3776169 | + | GENE_03684 | Prodigal: 2.6 | CDS | — | — | — | — | — | — | — | — | MngE/PrpD family protein |
| Contig1 | 3776273 | 3776956 | − | GENE_03685 | Prodigal: 2.6 | CDS | 3.6.3.- | — | — | — | P75957 | lolD | — | — | Lipoprotein-releasing system ATP-binding protein LolD |
| Contig1 | 3776971 | 3778407 | − | GENE_03686 | Prodigal: 2.6 | CDS | 3.6.3.- | — | — | — | Q5MK06 | macB_2 | — | — | Macrolide export ATP-binding/permease protein MacB |
| Contig1 | 3778620 | 3779303 | + | GENE_03687 | Prodigal: 2.6 | CDS | — | — | — | — | Q9L524 | srrA_3 | — | — | Transcriptional regulatory protein SrrA |
| Contig1 | 3779293 | 3780723 | + | GENE_03688 | Prodigal: 2.6 | CDS | 2.7.13.3 | — | — | — | P23545 | phoR_4 | — | — | Alkaline phosphatase synthesis sensor protein PhoR |
| Contig1 | 3780876 | 3782024 | + | GENE_03689 | Prodigal: 2.6 | CDS | 3.1.-.- | — | — | — | P71002 | rapF_3 | — | — | Response regulator aspartate phosphatase F |
| Contig1 | 3782008 | 3782127 | + | GENE_03690 | Prodigal: 2.6 | CDS | — | — | PF11131.2 | — | — | — | — | — | Rap-phr extracellular signalling |
| Contig1 | 3782467 | 3783831 | − | GENE_03691 | Prodigal: 2.6 | CDS | 2.7.2.4 | — | — | — | P94417 | yclM | — | — | Aspartokinase 3 |
| Contig1 | 3784246 | 3785199 | + | GENE_03692 | Prodigal: 2.6 | CDS | — | — | — | — | P40410 | feuB_4 | — | — | Iron-uptake system permease protein FeuB |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3785189 | 3786136 | + | GENE_03693 | Prodigal: 2.6 | CDS | — | — | — | — | Q56992 | hmuU_2 | — | — | Hemin transport system permease protein HmuU |
| Contig1 | 3786130 | 3786888 | + | GENE_03694 | Prodigal: 2.6 | CDS | — | — | — | — | O32188 | yusV_3 | — | — | putative siderophore transport system ATP-binding protein YusV |
| Contig1 | 3786910 | 3787854 | + | GENE_03695 | Prodigal: 2.6 | CDS | — | — | — | — | P94421 | yclQ | — | — | putative ABC transporter solute-binding protein YclQ precursor |
| Contig1 | 3787896 | 3789320 | − | GENE_03696 | Prodigal: 2.6 | CDS | — | — | — | — | P52600 | emrY | — | — | putative multidrug resistance protein EmrY |
| Contig1 | 3789338 | 3790213 | − | GENE_03697 | Prodigal: 2.6 | CDS | — | — | PF00440.17 | — | — | — | — | — | Bacterial regulatory proteins, tetR family |
| Contig1 | 3790374 | 3791120 | − | GENE_03698 | Prodigal: 2.6 | CDS | 1.5.1.39 | — | — | — | P94424 | nfrA2 | — | — | FMN reductase [NAD(P)H] |
| Contig1 | 3791137 | 3791424 | − | GENE_03699 | Prodigal: 2.6 | CDS | 1.-.-.- | — | — | — | P94425 | ycnE | — | — | Putative monooxygenase YcnE |
| Contig1 | 3791566 | 3791880 | + | GENE_03700 | Prodigal: 2.6 | CDS | — | — | — | — | Q55940 | — | — | Transcriptional repressor SmtB homolog | hypothetical protein |
| Contig1 | 3791908 | 3793317 | − | GENE_03701 | Prodigal: 2.6 | CDS | — | — | — | — | P94426 | gabR_2 | — | — | HTH-type transcriptional regulatory protein GabR |
| Contig1 | 3793425 | 3794732 | + | GENE_03702 | Prodigal: 2.6 | CDS | 2.6.1.48 | — | — | — | Q9I6M4 | davT | — | — | 5-aminovalerate aminotransferase DavT |
| Contig1 | 3794838 | 3796226 | + | GENE_03703 | Prodigal: 2.6 | CDS | 1.2.1.79 | — | — | — | P94428 | gabD | — | — | Succinate-semialdehyde dehydrogenase [NADP(+)] |
| Contig1 | 3796381 | 3797244 | + | GENE_03704 | Prodigal: 2.6 | CDS | — | — | — | — | P40420 | glcU | — | — | Glucose uptake protein GlcU |
| Contig1 | 3797265 | 3798050 | + | GENE_03705 | Prodigal: 2.6 | CDS | 1.1.1.47 | — | — | — | P12310 | gdh_3 | — | — | Glucose 1-dehydrogenase |
| Contig1 | 3798096 | 3798707 | − | GENE_03706 | Prodigal: 2.6 | CDS | — | — | — | — | — | — | — | — | hypothetical protein |
| Contig1 | 3798720 | 3800348 | − | GENE_03707 | Prodigal: 2.6 | CDS | — | — | — | — | C0SP95 | ycnJ | — | — | Copper transport protein YcnJ precursor |
| Contig1 | 3800381 | 3800953 | − | GENE_03708 | Prodigal: 2.6 | CDS | — | — | — | — | P94433 | ycnK | — | — | HTH-type transcriptional repressor YcnK |
| Contig1 | 3801130 | 3801471 | + | GENE_03709 | Prodigal: 2.6 | CDS | — | — | — | — | — | — | — | — | hypothetical protein |
| Contig1 | 3801653 | 3803086 | + | GENE_03710 | Prodigal: 2.6 | CDS | — | — | — | — | P00550 | mtlA | — | — | PTS system mannitol-specific EIICBA component |
| Contig1 | 3803112 | 3803543 | + | GENE_03711 | Prodigal: 2.6 | CDS | 2.7.1.- | — | — | — | C0H3V2 | mtlF | — | — | Mannitol-specific phosphotransferase enzyme IIA component |
| Contig1 | 3803545 | 3804666 | + | GENE_03712 | Prodigal: 2.6 | CDS | 1.1.1.17 | — | — | — | P09424 | mtlD | — | — | Mannitol-1-phosphate 5-dehydrogenase |
| Contig1 | 3804736 | 3805131 | + | GENE_03713 | Prodigal: 2.6 | CDS | 4.2.1.59 | — | — | — | P64107 | fabZ_2 | — | — | 3-hydroxyacyl-[acyl-carrier-protein] dehydratase FabZ |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3805170 | 3805334 | − | GENE_03714 | Prodigal: 2.6 | CDS | — | — | — | — | — | — | — | — | hypothetical protein |
| Contig1 | 3805462 | 3806211 | + | GENE_03715 | Prodigal: 2.6 | CDS | 3.1.3.- | PRK05406 | — | — | Q5XD45 | — | — | — | Putative phosphatase |
| Contig1 | 3806417 | 3807181 | + | GENE_03716 | Prodigal: 2.6 | CDS | — | — | — | — | — | — | — | — | LamB/YcsF family protein |
| Contig1 | 3807204 | 3808418 | + | GENE_03717 | Prodigal: 2.6 | CDS | — | — | — | MF_00221 | — | mntH_1 | — | — | Divalent metal cation transporter MntH |
| Contig1 | 3808423 | 3809217 | + | GENE_03718 | Prodigal: 2.6 | CDS | — | — | — | — | — | — | — | — | hypothetical protein |
| Contig1 | 3809247 | 3809978 | + | GENE_03719 | Prodigal: 2.6 | CDS | — | — | — | — | P60495 | kipI | — | — | Kinase A inhibitor KipI |
| Contig1 | 3809975 | 3810988 | + | GENE_03720 | Prodigal: 2.6 | CDS | — | — | — | — | Q7WY77 | kipA | — | — | KipI antagonist |
| Contig1 | 3810976 | 3811755 | + | GENE_03721 | Prodigal: 2.6 | CDS | — | — | — | — | P42968 | kipR | — | — | HTH-type transcriptional regulator KipR |
| Contig1 | 3811820 | 3812461 | + | GENE_03722 | Prodigal: 2.6 | CDS | 3.-.-.- | — | — | — | P42969 | lipC_2 | — | — | Spore germination lipase LipC |
| Contig1 | 3812628 | 3812873 | + | GENE_03723 | Prodigal: 2.6 | CDS | — | — | — | — | — | — | — | — | hypothetical protein |
| Contig1 | 3812844 | 3813164 | − | GENE_03724 | Prodigal: 2.6 | CDS | — | — | PF03992.10 | — | — | — | — | — | Antibiotic biosynthesis monooxygenase |
| Contig1 | 3813321 | 3815324 | + | GENE_03725 | Prodigal: 2.6 | CDS | — | — | — | — | P07944 | pbp | — | — | Beta-lactam-inducible penicillin-binding protein |
| Contig1 | 3815438 | 3816340 | + | GENE_03726 | Prodigal: 2.6 | CDS | 1.-.-.- | — | — | — | P76187 | ydhF | — | — | Oxidoreductase YdhF |
| Contig1 | 3816642 | 3818726 | + | GENE_03727 | Prodigal: 2.6 | CDS | — | — | — | — | P96574 | mtlR | — | — | Transcriptional regulator MtlR |
| Contig1 | 3818948 | 3820462 | + | GENE_03728 | Prodigal: 2.6 | CDS | 6.2.1.3 | — | — | — | O07610 | lcfB_4 | — | — | Long-chain-fatty-acid-CoA ligase |
| Contig1 | 3820621 | 3821481 | + | GENE_03729 | Prodigal: 2.6 | CDS | 1.-.-.- | — | — | — | P80873 | ydaD_3 | — | — | General stress protein 39 |
| Contig1 | 3821494 | 3821997 | + | GENE_03730 | Prodigal: 2.6 | CDS | 5.3.1.- | — | — | — | P96578 | ydaE | — | — | putative D-lyxose ketol-isomerase |
| Contig1 | 3822084 | 3822707 | + | GENE_03731 | Prodigal: 2.6 | CDS | 2.3.1.- | — | — | — | P96579 | ydaF | — | — | Putative ribosomal N-acetyltransferase YdaF |
| Contig1 | 3822714 | 3823136 | + | GENE_03732 | Prodigal: 2.6 | CDS | — | — | — | — | P80238 | ydaG | — | — | General stress protein 26 |
| Contig1 | 3823635 | 3824444 | + | GENE_03733 | Prodigal: 2.6 | CDS | — | — | — | — | — | — | — | — | hypothetical protein |
| Contig1 | 3824482 | 3824772 | + | GENE_03734 | Prodigal: 2.6 | CDS | — | — | — | — | — | — | — | — | putative diguanylate cyclase AdrA |
| Contig1 | 3824949 | 3825383 | + | GENE_03735 | Prodigal: 2.6 | CDS | — | — | — | — | P96582 | lrpC | — | — | HTH-type transcriptional regulator LrpC |
| Contig1 | 3825423 | 3827633 | + | GENE_03736 | Prodigal: 2.6 | CDS | 5.99.1.2 | — | — | — | P14294 | topB | — | — | DNA topoisomerase 3 |
| Contig1 | 3827866 | 3828951 | + | GENE_03737 | Prodigal: 2.6 | CDS | — | — | — | — | — | — | — | — | hypothetical protein |
| Contig1 | 3828932 | 3829780 | + | GENE_03738 | Prodigal: 2.6 | CDS | 2.7.7.65 | — | — | — | P0AAP1 | adrA | — | — | putative diguanylate cyclase AdrA |
| Contig1 | 3829770 | 3831497 | + | GENE_03739 | Prodigal: 2.6 | CDS | — | — | — | — | — | — | — | — | hypothetical protein |
| Contig1 | 3831490 | 3832752 | + | GENE_03740 | Prodigal: 2.6 | CDS | 2.4.1.- | — | — | — | Q3MB01 | — | — | — | Beta-monoglucosyldiacyl-glycerol synthase |
| Contig1 | 3832749 | 3834863 | + | GENE_03741 | Prodigal: 2.6 | CDS | — | PRK11114 | — | — | — | — | — | — | cellulose synthase regulator protein |
| Contig1 | 3835301 | 3837121 | + | GENE_03742 | Prodigal: 2.6 | CDS | — | — | — | — | — | — | — | — | hypothetical protein |
| Contig1 | 3837175 | 3837621 | + | GENE_03743 | Prodigal: 2.6 | CDS | 3.6.1.- | — | — | — | Q9ZDT9 | rppH | — | — | RNA pyrophospho-hydrolase |
| Contig1 | 3837679 | 3839400 | + | GENE_03744 | Prodigal: 2.6 | CDS | — | — | — | — | P96591 | ydaP | — | — | Putative thiamine pyrophosphate-containing protein YdaP |
| Contig1 | 3839661 | 3839891 | − | GENE_03745 | Prodigal: 2.6 | CDS | — | — | — | — | — | — | — | — | hypothetical protein |

TABLE 5-continued

| #ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3840078 | 3840257 | − | GENE_03746 | Prodigal: 2.6 | CDS | — | — | — | — | — | — | — | — | hypothetical protein |
| Contig1 | 3840274 | 3840897 | − | GENE_03747 | Prodigal: 2.6 | CDS | — | — | — | — | — | — | — | — | hypothetical protein |
| Contig1 | 3840927 | 3841505 | − | GENE_03748 | Prodigal: 2.6 | CDS | — | — | — | — | — | — | — | — | hypothetical protein |
| Contig1 | 3841729 | 3841995 | − | GENE_03749 | Prodigal: 2.6 | CDS | — | — | — | — | — | — | — | — | hypothetical protein |
| Contig1 | 3842101 | 3843375 | − | GENE_03750 | Prodigal: 2.6 | CDS | — | — | — | — | P96593 | mntH_2 | — | — | Divalent metal cation transporter MntH |
| Contig1 | 3844015 | 3844368 | + | GENE_03751 | Prodigal: 2.6 | CDS | — | — | PF08239.5 | — | — | — | — | — | Bacterial SH3 domain protein |
| Contig1 | 3844418 | 3844642 | − | GENE_03752 | Prodigal: 2.6 | CDS | — | — | — | — | — | — | — | — | hypothetical protein |
| Contig1 | 3844700 | 3845107 | − | GENE_03753 | Prodigal: 2.6 | CDS | — | — | — | — | — | — | — | — | hypothetical protein |
| Contig1 | 3845104 | 3845469 | − | GENE_03754 | Prodigal: 2.6 | CDS | — | — | — | — | P23895 | emrE | — | — | Multidrug transporter EmrE |
| Contig1 | 3845636 | 3846442 | + | GENE_03755 | Prodigal: 2.6 | CDS | — | — | PF12787.1 | — | — | — | — | — | EcsC protein family protein |
| Contig1 | 3846543 | 3846914 | + | GENE_03756 | Prodigal: 2.6 | CDS | — | — | — | — | P26907 | gsiB | — | — | Glucose starvation-inducible protein B |
| Contig1 | 3847049 | 3847390 | + | GENE_03757 | Prodigal: 2.6 | CDS | — | — | PF07883.5 | — | — | — | — | — | Cupin domain protein |
| Contig1 | 3847384 | 3847743 | + | GENE_03758 | Prodigal: 2.6 | CDS | — | — | — | — | — | — | — | — | hypothetical protein |
| Contig1 | 3847768 | 3848589 | − | GENE_03759 | Prodigal: 2.6 | CDS | 1.11.1.6 | — | — | — | P80878 | — | — | — | putative manganese catalase |
| Contig1 | 3848674 | 3849726 | − | GENE_03760 | Prodigal: 2.6 | CDS | — | — | — | — | P37735 | dctP | — | — | C4-dicarboxylate-binding periplasmic protein precursor |
| Contig1 | 3849807 | 3851429 | + | GENE_03761 | Prodigal: 2.6 | CDS | 2.7.13.3 | — | — | — | P0AEC8 | dcuS_2 | — | — | Sensor histidine kinase DcuS |
| Contig1 | 3851404 | 3852075 | + | GENE_03762 | Prodigal: 2.6 | CDS | — | — | — | — | P0AD01 | dcuR_2 | — | — | Transcriptional regulatory protein DcuR |
| Contig1 | 3852184 | 3853440 | + | GENE_03763 | Prodigal: 2.6 | CDS | — | — | — | — | P96603 | dctA | — | — | C4-dicarboxylate transport protein |
| Contig1 | 3853626 | 3854675 | + | GENE_03764 | Prodigal: 2.6 | CDS | 3.6.3.- | — | — | — | — | — | — | — | hypothetical protein |
| Contig1 | 3854777 | 3855703 | + | GENE_03765 | Prodigal: 2.6 | CDS | — | — | — | — | P94374 | yxlF_6 | — | — | putative ABC transporter ATP-binding protein YxlF |
| Contig1 | 3855696 | 3856463 | + | GENE_03766 | Prodigal: 2.6 | CDS | — | — | PF12730.1 | — | — | — | — | — | ABC-2 family transporter protein |
| Contig1 | 3856558 | 3856893 | − | GENE_03767 | Prodigal: 2.6 | CDS | — | — | — | — | — | — | — | — | hypothetical protein |
| Contig1 | 3857009 | 3858151 | + | GENE_03768 | Prodigal: 2.6 | CDS | 1.3.99.- | — | — | — | P96608 | ydbM | — | — | Putative acyl-CoA dehydrogenase YdbM |
| Contig1 | 3858180 | 3858326 | − | GENE_03769 | Prodigal: 2.6 | CDS | — | — | — | — | — | — | — | — | hypothetical protein |
| Contig1 | 3858313 | 3858492 | − | GENE_03770 | Prodigal: 2.6 | CDS | — | — | — | — | — | — | — | — | hypothetical protein |
| Contig1 | 3858705 | 3859598 | + | GENE_03771 | Prodigal: 2.6 | CDS | — | — | — | — | O53471 | — | — | — | putative cation efflux system protein/MT2084 |
| Contig1 | 3859595 | 3859912 | − | GENE_03772 | Prodigal: 2.6 | CDS | — | — | — | — | P96611 | ydbP | — | — | Thioredoxin-like protein YdbP |
| Contig1 | 3860065 | 3861150 | + | GENE_03773 | Prodigal: 2.6 | CDS | 6.3.2.4 | — | — | — | P63892 | ddl | — | — | D-alanine—D-alanine ligase |
| Contig1 | 3861227 | 3862597 | + | GENE_03774 | Prodigal: 2.6 | CDS | 6.3.2.10 | — | — | — | P11880 | murF | — | — | UDP-N-acetylmuramoyl-tripeptide-D-alanyl-D-alanine ligase |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3862928 | 3864412 | + | GENE_03775 | Prodigal: 2.6 | CDS | 3.6.4.13 | — | — | — | P96614 | cshA | — | — | DEAD-box ATP-dependent RNA helicase CshA |
| Contig1 | 3864524 | 3865006 | + | GENE_03776 | Prodigal: 2.6 | CDS | — | — | PF03703.8 | — | — | — | — | — | Bacterial membrane flanked domain protein |
| Contig1 | 3864999 | 3866462 | + | GENE_03777 | Prodigal: 2.6 | CDS | — | — | PF03703.8 | — | — | — | — | — | Bacterial membrane flanked domain protein |
| Contig1 | 3866459 | 3867058 | - | GENE_03778 | Prodigal: 2.6 | CDS | 3.4.21.105 | — | — | — | P54493 | gluP | — | — | Rhomboid protease GluP |
| Contig1 | 3867151 | 3867516 | + | GENE_03779 | Prodigal: 2.6 | CDS | 2.7.8.7 | — | — | — | P96618 | acpS | — | — | Holo-[acyl-carrier-protein] synthase |
| Contig1 | 3867681 | 3868688 | + | GENE_03780 | Prodigal: 2.6 | CDS | — | — | — | — | P96619 | ydcC | — | — | Sporulation protein YdcC |
| Contig1 | 3868805 | 3869974 | + | GENE_03781 | Prodigal: 2.6 | CDS | 5.1.1.1 | — | — | — | P10724 | alr_2 | — | — | Alanine racemase |
| Contig1 | 3870094 | 3870375 | + | GENE_03782 | Prodigal: 2.6 | CDS | — | — | — | — | P96621 | ndoAI | — | — | Antitoxin EndoAI |
| Contig1 | 3870381 | 3870731 | + | GENE_03783 | Prodigal: 2.6 | CDS | 3.1.-.- | — | — | — | P96622 | ndoA | — | — | mRNA interferase EndoA |
| Contig1 | 3870849 | 3871670 | + | GENE_03784 | Prodigal: 2.6 | CDS | — | — | — | — | P42409 | rsbRA | — | — | RsbT co-antagonist protein RsbRA |
| Contig1 | 3871675 | 3872040 | + | GENE_03785 | Prodigal: 2.6 | CDS | — | — | — | — | P42410 | rsbS | — | — | RsbT antagonist protein RsbS |
| Contig1 | 3872043 | 3872444 | + | GENE_03786 | Prodigal: 2.6 | CDS | 2.7.11.1 | — | — | — | P42411 | rsbT | — | — | Serine/threonine-protein kinase RsbT |
| Contig1 | 3872456 | 3873463 | + | GENE_03787 | Prodigal: 2.6 | CDS | 3.1.3.3 | — | — | — | P40399 | rsbU_1 | — | — | Phosphoserine phosphatase RsbU |
| Contig1 | 3873527 | 3873856 | + | GENE_03788 | Prodigal: 2.6 | CDS | — | — | — | — | P17903 | rsbV | — | — | Anti-sigma-B factor antagonist |
| Contig1 | 3873853 | 3874335 | + | GENE_03789 | Prodigal: 2.6 | CDS | 2.7.11.1 | — | — | — | P17904 | rsbW | — | — | Serine-protein kinase RsbW |
| Contig1 | 3874301 | 3875089 | + | GENE_03790 | Prodigal: 2.6 | CDS | — | — | — | — | P06574 | sigB | — | — | RNA polymerase sigma-B factor |
| Contig1 | 3875089 | 3875691 | + | GENE_03791 | Prodigal: 2.6 | CDS | 3.1.3.3 | — | — | — | P40399 | rsbU_2 | — | — | Phosphoserine phosphatase RsbU |
| Contig1 | 3875764 | 3877923 | + | GENE_03792 | Prodigal: 2.6 | CDS | — | — | — | — | P0AG67 | rpsA | — | — | 30S ribosomal protein S1 |
| Contig1 | 3877933 | 3878046 | - | GENE_03793 | Prodigal: 2.6 | CDS | — | — | — | — | — | — | — | — | hypothetical protein |
| Contig1 | 3878263 | 3878595 | + | GENE_03794 | Prodigal: 2.6 | CDS | — | — | — | MF_00745 | — | — | — | — | Protein SprT-like protein |
| Contig1 | 3878731 | 3878805 | + | GENE_03795 | Aragorn: 1.2 | tRNA | — | — | — | — | — | — | — | — | tRNA-Asn(gtt) |
| Contig1 | 3878810 | 3878900 | + | GENE_03796 | Aragorn: 1.2 | tRNA | — | — | — | — | — | — | — | — | tRNA-Ser(gct) |
| Contig1 | 3878920 | 3878994 | + | GENE_03797 | Aragorn: 1.2 | tRNA | — | — | — | — | — | — | — | — | tRNA-Glu(ttc) |
| Contig1 | 3879006 | 3879080 | + | GENE_03798 | Aragorn: 1.2 | tRNA | — | — | — | — | — | — | — | — | tRNA-Gln(ttg) |
| Contig1 | 3879114 | 3879189 | + | GENE_03799 | Aragorn: 1.2 | tRNA | — | — | — | — | — | — | — | — | tRNA-Lys(ttt) |
| Contig1 | 3879198 | 3879280 | + | GENE_03800 | Aragorn: 1.2 | tRNA | — | — | — | — | — | — | — | — | tRNA-Leu(tag) |
| Contig1 | 3879348 | 3879431 | + | GENE_03801 | Aragorn: 1.2 | tRNA | — | — | — | — | — | — | — | — | tRNA-Leu(gag) |
| Contig1 | 3879937 | 3880386 | - | GENE_03802 | Prodigal: 2.6 | CDS | — | — | — | — | — | — | — | — | hypothetical protein |
| Contig1 | 3881525 | 3882319 | + | GENE_03803 | Prodigal: 2.6 | CDS | 3.1.1.2 | — | — | — | P22862 | — | — | — | Arylesterase |
| Contig1 | 3883358 | 3884761 | + | GENE_03804 | Prodigal: 2.6 | CDS | — | — | — | — | P0C0L7 | proP | — | — | Proline/betaine transporter |
| Contig1 | 3885322 | 3886269 | - | GENE_03805 | Prodigal: 2.6 | CDS | — | — | — | — | P71667 | nlhH | — | — | Carboxylesterase NlhH |
| Contig1 | 3886360 | 3886779 | - | GENE_03806 | Prodigal: 2.6 | CDS | 3.1.1.1 | — | — | — | P80242 | ohrB_2 | — | — | Organic hydroperoxide resistance protein OhrB |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3887121 | 3887558 | + | GENE_03807 | Prodigal: 2.6 | CDS | — | — | — | — | O34777 | ohrR_3 | — | — | Organic hydroperoxide resistance transcriptional regulator |
| Contig1 | 3888042 | 3888446 | − | GENE_03808 | Prodigal: 2.6 | CDS | — | — | — | — | P71036 | ywnA_2 | — | — | Putative HTH-type transcriptional regulator YwnA |
| Contig1 | 3888684 | 3889322 | + | GENE_03809 | Prodigal: 2.6 | CDS | — | — | — | — | — | — | — | — | NmrA-like family protein |
| Contig1 | 3889884 | 3890087 | + | GENE_03810 | Prodigal: 2.6 | CDS | — | — | PF05368.7 | — | P39158 | cspC | — | — | Cold shock protein CspC |
| Contig1 | 3890689 | 3891150 | − | GENE_03811 | Prodigal: 2.6 | CDS | — | — | — | — | A0R561 | carD | — | — | RNA polymerase-binding transcription factor CarD |
| Contig1 | 3891690 | 3892370 | + | GENE_03812 | Prodigal: 2.6 | CDS | 5.1.1.- | — | — | — | P32960 | racX | — | — | putative amino-acid racemase |
| Contig1 | 3892477 | 3893046 | − | GENE_03813 | Prodigal: 2.6 | CDS | — | — | — | — | — | — | — | — | hypothetical protein |
| Contig1 | 3893033 | 3893350 | − | GENE_03814 | Prodigal: 2.6 | CDS | — | — | PF03551.8 | — | — | — | — | — | Transcriptional regulator PadR-like family protein |
| Contig1 | 3893703 | 3894608 | + | GENE_03815 | Prodigal: 2.6 | CDS | 2.3.1.- | — | — | — | P94562 | ysnE_2 | — | — | putative N-acetyltransferase YsnE |
| Contig1 | 3894625 | 3895914 | − | GENE_03816 | Prodigal: 2.6 | CDS | — | — | — | — | Q51330 | oxlT | — | — | Oxalate:formate antiporter |
| Contig1 | 3896006 | 3896974 | − | GENE_03817 | Prodigal: 2.6 | CDS | 3.1.1.- | — | — | — | O06996 | cotR | — | — | Putative sporulation hydrolase CotR |
| Contig1 | 3897178 | 3897654 | + | GENE_03818 | Prodigal: 2.6 | CDS | — | — | PF12867.1 | — | — | — | — | — | DinB superfamily protein |
| Contig1 | 3897690 | 3898055 | + | GENE_03819 | Prodigal: 2.6 | CDS | 1.13.11.6 | — | — | MF_00825 | — | HAAO | — | — | 3-hydroxyanthranilate 3,4-dioxygenase |
| Contig1 | 3898702 | 3899022 | + | GENE_03820 | Prodigal: 2.6 | CDS | — | — | — | — | — | — | — | — | hypothetical protein |
| Contig1 | 3899413 | 3900759 | + | GENE_03821 | Prodigal: 2.6 | CDS | 1.21.-.- | — | — | — | O06997 | yvdP_2 | — | — | putative FAD-linked oxidoreductase YvdP |
| Contig1 | 3900837 | 3901136 | − | GENE_03822 | Prodigal: 2.6 | CDS | — | — | PF12681.1 | — | — | — | — | — | Glyoxalase-like domain protein |
| Contig1 | 3901331 | 3902272 | + | GENE_03823 | Prodigal: 2.6 | CDS | — | — | — | — | O07084 | czcD_2 | — | — | Cadmium, cobalt and zinc/H(+)-K(+) antiporter |
| Contig1 | 3902335 | 3903372 | + | GENE_03824 | Prodigal: 2.6 | CDS | 1.-.-.- | — | — | — | O07085 | czcO | — | — | putative oxidoreductase CzcO |
| Contig1 | 3903720 | 3904253 | + | GENE_03825 | Prodigal: 2.6 | CDS | — | — | PF07883.5 | — | — | — | — | — | Cupin domain protein |
| Contig1 | 3904511 | 3905038 | − | GENE_03826 | Prodigal: 2.6 | CDS | — | — | PF12867.1 | — | — | — | — | — | DinB superfamily protein |
| Contig1 | 3905136 | 3905678 | + | GENE_03827 | Prodigal: 2.6 | CDS | 4.3.3.7 | — | — | — | O67216 | dapA_2 | — | — | 4-hydroxy-tetrahydrodipicolinate synthase |
| Contig1 | 3905734 | 3906114 | + | GENE_03828 | Prodigal: 2.6 | CDS | — | — | PF05014.9 | — | — | — | — | — | hypothetical protein |
| Contig1 | 3906413 | 3906874 | + | GENE_03829 | Prodigal: 2.6 | CDS | — | — | — | — | — | — | — | — | Nucleoside 2-deoxyribosyltransferase |
| Contig1 | 3906874 | 3907884 | + | GENE_03830 | Prodigal: 2.6 | CDS | 2.1.1.45 | — | — | — | Q8NS38 | thyA | — | — | Thymidylate synthase |
| Contig1 | 3907881 | 3908639 | + | GENE_03831 | Prodigal: 2.6 | CDS | 2.1.1.- | — | — | — | E5KIC0 | cypM_2 | — | — | Cypemycin methyltransferase |
| Contig1 | 3908654 | 3909502 | + | GENE_03832 | Prodigal: 2.6 | CDS | 2.7.1.49 | — | — | — | P99124 | thiD_2 | — | — | Hydroxymethyl pyrimidine/phosphomethylpyrimidine kinase |
| Contig1 | 3909483 | 3910718 | + | GENE_03833 | Prodigal: 2.6 | CDS | 3.-.-.- | — | — | — | O32125 | yutF_2 | — | — | putative hydrolase YutF |
| Contig1 | 3910907 | 3911869 | + | GENE_03834 | Prodigal: 2.6 | CDS | — | — | PF01758.10 | — | — | — | — | — | Sodium Bile acid symporter family protein |

TABLE 5-continued

| # ContigID | Start | End | Strand | GeneID | Prediction Tool | Type | EC_Number | CLUSTERS | Pfam | HAMAP | UniProt | GeneName | Repeat-Family | Note | Description |
|---|---|---|---|---|---|---|---|---|---|---|---|---|---|---|---|
| Contig1 | 3911928 | 3912977 | − | GENE_03835 | Prodigal: 2.6 | CDS | 1.1.1 | — | — | — | C0SPA5 | adhA | — | — | putative formaldehyde dehydrogenase AdhA |
| Contig1 | 3913137 | 3913541 | + | GENE_03836 | Prodigal: 2.6 | CDS | — | — | — | — | O06008 | adhR_2 | — | — | HTH-type transcriptional regulator AdhR |
| Contig1 | 3913765 | 3915054 | + | GENE_03837 | Prodigal: 2.6 | CDS | — | — | — | — | O07553 | nhaC_3 | — | — | Na(+)/H(+) antiporter NhaC |
| Contig1 | 3915092 | 3916474 | − | GENE_03838 | Prodigal: 2.6 | CDS | — | — | — | — | P94426 | gabR_3 | — | — | HTH-type transcriptional regulatory protein GabR |
| Contig1 | 3916593 | 3917213 | + | GENE_03839 | Prodigal: 2.6 | CDS | — | — | — | — | P21341 | paiB_2 | — | — | Protease synthase and sporulation protein PAI 2 |
| Contig1 | 3917262 | 3917624 | − | GENE_03840 | Prodigal: 2.6 | CDS | — | — | — | — | — | — | — | — | hypothetical protein |
| Contig1 | 3917841 | 3919031 | − | GENE_03841 | Prodigal: 2.6 | CDS | — | — | — | — | P43531 | ynfM_3 | — | — | Inner membrane transport protein YnfM |
| Contig1 | 3919276 | 3919854 | + | GENE_03842 | Prodigal: 2.6 | CDS | — | — | — | — | P43506 | bm3R1_4 | — | — | HTH-type transcriptional repressor Bm3R1 |
| Contig1 | 3920047 | 3920346 | − | GENE_03843 | Prodigal: 2.6 | CDS | — | — | — | — | P23261 | cotF_4 | — | — | Spore coat protein F precursor |
| Contig1 | 3920361 | 3920558 | − | GENE_03844 | Prodigal: 2.6 | CDS | — | — | — | — | — | — | — | — | hypothetical protein |
| Contig1 | 3920577 | 3921713 | − | GENE_03845 | Prodigal: 2.6 | CDS | 1.2.99.4 | — | — | — | Q52078 | fdm_2 | — | — | Formaldehyde dismutase |
| Contig1 | 3921732 | 3922100 | − | GENE_03846 | Prodigal: 2.6 | CDS | — | — | — | — | P23261 | cotF_5 | — | — | Spore coat protein F precursor |
| Contig1 | 3922118 | 3922363 | − | GENE_03847 | Prodigal: 2.6 | CDS | — | — | — | — | — | — | — | — | hypothetical protein |
| Contig1 | 3922714 | 3923991 | + | GENE_03848 | Prodigal: 2.6 | CDS | 2.7.13.3 | — | — | — | O32198 | liaS_4 | — | — | Sensor histidine kinase LiaS |
| Contig1 | 3923984 | 3924619 | + | GENE_03849 | Prodigal: 2.6 | CDS | — | — | — | — | Q7A4R9 | vraR_2 | — | — | Response regulator protein VraR |
| Contig1 | 3924718 | 3925566 | + | GENE_03850 | Prodigal: 2.6 | CDS | — | — | — | — | P96687 | ydfJ_2 | — | — | Membrane protein YdfJ |
| Contig1 | 3925569 | 3926837 | + | GENE_03851 | Prodigal: 2.6 | CDS | — | — | — | — | P96687 | ydfJ_3 | — | — | Membrane protein YdfJ |
| Contig1 | 3926906 | 3927274 | − | GENE_03852 | Prodigal: 2.6 | CDS | 2.4.2.- | — | — | — | O33341 | — | — | — | Putative glutamine amidotransferase |
| Contig1 | 3927268 | 3927507 | − | GENE_03853 | Prodigal: 2.6 | CDS | 2.4.2.- | — | — | — | O33341 | — | — | — | Putative glutamine amidotransferase |
| Contig1 | 3927763 | 3928221 | − | GENE_03854 | Prodigal: 2.6 | CDS | — | — | — | — | P63389 | yheS_5 | — | — | putative ABC transporter ATP-binding protein YheS |

Although the invention has been described in conjunction with specific embodiments thereof, it is evident tint many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting. In addition, any priority document(s) of this application is/are hereby incorporated herein by reference in its/their entirety.

REFERENCES

1. Cho, K.-M. (2008). "Characterization of potential probiotics *Bacillus subtilis* CS90 from soybean paste (doenjang) and its antimicrobial activity against food-borne pathogens." Journal of Applied Biological Chemistry 51(6): 285-291.
2. FRANZ, C. M., A. HUMMEL and W. H. HOLZAPFEL (2005). "Problems related to the safety assessment of lactic acid bacteria starter cultures and probiotics." Mitteilungen aus Lebensmitteluntersuchung und Hygiene 96(1): 39-65.
3. Ginsberg, H. S., L. L. Moldawer, P. B. Sehgal, M. Redington, P. L. Kilian, R. M. Chanock and G. A. Prince (1991). "A mouse model for investigating the molecular pathogenesis of adenovirus pneumonia." Proceedings of the National Academy of Sciences 88(5): 1651-1655.
4. Holzapfel, W. H. and U. Schillinger (2002). "Introduction to pre- and probiotics." Food Research International 35(2): 109-116.
5. Hong, H., J. M. Huang, R. Khaneja, L. Hiep, M. Urdaci and S. Cutting (2008). "The safety of *Bacillus subtilis* and *Bacillus indicus* as food probiotics." Journal of applied microbiology 105(2): 510-520.
6. Jeon, H. H., J. Y. Jung, B.-H. Chun, M.-D. Kim, S. Y. Baek, J. Y. Moon, S.-H. Yeo and C. O. Jeon (2016). "Screening and characterization of potential *Bacillus* starter cultures for fermenting low salt soybean paste (doenjang)." J. Microbiol. Biotechnol 26(4): 666-674.
7. Jorgensen, J. H. and J. D. Turnidge (2015). Susceptibility test methods: dilution and disk diffusion methods. Manual of Clinical Microbiology, Eleventh Edition, American Society of Microbiology: 1253-1273.
8. Kong, X., G. R. Hellermann, G. Patton, M. Kumar, A. Behera, T. S. Randall, J. Zhang, R. F. Lockey and S. S. Mohapatra (2005). "An immunocompromised BALB/c mouse model for respiratory syncytial virus infection." Virology journal 2(1): 3.
9. Leuschner, R. G., T. P. Robinson, M. Hugas, P. S. Cocconcelli, F. Richard-Forget, G. Klein, T. R. Licht, C. Nguyen-The, A. Querol and M. Richardson (2010). "Qualified presumption of safety (QPS): a generic risk assessment approach for biological agents notified to the European Food Safety Authority (EFSA)." Trends in Food Science & Technology 21(9): 425-435.
10. Reysenbach, A.-L., L. J. Giver, G. S. Wickham and N. R. Pace (1992). "Differential amplification of rRNA genes by polymerase chain reaction." Applied and Environmental Microbiology 58(10): 3417-3418.
11. Sorokulova, I. B., I. V. Pinchuk, M. Denayrolles, I. G. Osipova, J. M. Huang, S. M. Cutting and M. C. Urdaci (2008). "The safety of two *Bacillus* probiotic strains for human use." Digestive diseases and sciences 53(4): 954-963.
12. Wang, L.-T., F.-L. Lee, C.-J. Tai and H. Kasai (2007). "Comparison of gyrB gene sequences, 16S rRNA gene sequences and DNA-DNA hybridization in the *Bacillus subtilis* group." International Journal of Systematic and Evolutionary Microbiology 57(8): 1846-1850.
13. Xu, S. J., D. H. Park, J.-Y. Kim and B.-S. Kim (2016). "Biological control of gray mold and growth promotion of tomato using *Bacillus* spp. isolated from soil." Tropical Plant Pathology 41(3): 169-176.

SEQUENCE LISTING (4 sequences)

SEQ ID NO: 1 - DNA, 20 bp, Artificial Sequence
  Single strand DNA oligonucleotide
agagtttgatcctggctcag

SEQ ID NO: 2 - DNA, 22 bp, Artificial Sequence
  Single strand DNA oligonucleotide
tacggytaccttgttacgactt

SEQ ID NO: 3 - DNA, 1457 bp, Bacillus amyloliquefaciens
ggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttatggagccagccgccga

SEQ ID NO: 4 - DNA, 3928316 bp, Bacillus amyloliquefaciens (residues 1-1,964,158 of 3,928,316)
aaaaaaacatccttataaatgaaaggaaaaggctgacggagaaacagagggaaattgatgaaaccataaaacgattaaacaggaagattgaggattacgaagatatcctggaaaatgaagcgaaacttaaaaacagattgaaagctgaatgtatttctgaatgaagagaaggtgtcccgggcgccgggccgcatgaaatgtaccaagggaaacgagccttggtttttttattttctaaagagaggaaacaaaacagctttttctatcttatcaaacattacttatccttttttcagcttgactttttactgcagacttttaaagtgtgaaatgttgcttagactgtgattagcgactttaatgctgaaaagaggtggtttacccagatgaacaatcataagaatccttgggcgttattgcctttagtcttattcgtagggctttttgtcggctctggtctggtgaccggagatttttataaattgccgatcttgattgccgcgatcattgcgtcagcttttgcgctgttatttaaccggaagaaatcgctcaatcaaaaaatagaatggttcgcttccggtgcgggacatcctgatattatcattatggttatgatttttatattggcaggtgcctttgcttcagcggctgaggcgatgggagcggtgcattcaactgtcaatcttgctttgagcgttattccgcagcagtttttgctgccggggctgtttatcattgcttgttttatttctatatcgatgggaacatcaatgggcacgattgcggcggttgcgccgatcagcgcgggtctgagcggagagcttggcatctccggcgcgattacgatggcagctgtggtcggcggagctatgttcggagataatctttcttttatttccgatacgaccattgcgtcagtccggacgcaaaaaacacaaatgatggataaattcaaaacgaacttcctgattgttttgcccgctgctattttaacggttattatcttattttttattccggcaggccacgcgggccatgcgggcgctgcatcttacagctggattaaggtgcttccttatgtcgccgtgttggtttttgcgttaatcggttttaatgtgatggctgtcatattcggcggattggttttgacggggatcatcggattggcgggcggcagcctgacgtttgactcttattttaaggcgattacggatggaatcgccggaatgagcgatctgatcatcctgtccatgctgatcggcgggatggtcggcgtgatgaaacaaaacggcgggatcgactttttactggagttcatcacgaaacgaatccgttccaaaaaaggcgccgaagccggcattgccggactggtcagcgtgacgaatctggctgcggccaataatacgatctcgattatcgcagccgggccgattgcaaagaatatcgctgataaattcagcatcgacaacagaaaatcggcaagtattctggatatcttttcgtgtatgatacaaggattgattccttacggcgcgcagctgttatcagccgggaaattcgggaatatttcacccgtcagcatcctgccatactctttctatcccgttttaatcggaatctgcggcatcgccgccattatatttggactgccgaaattcacaagaaatacgaaataaaagataaaaaaaggcgccgttcggcgccttttttctttcatgacagccaagcatttctcaaaagctgtacgccctgtgcgatctgatccgtatcgagatgggcgaaacctaactttatgatcggcggttcaggctttccggcaacgaaataaacggcggtaggatatactttcactccgtactgaaaagcgcgttcgattaatgtttcttctgtatagttcaggtgaactctcaccaatatatacaatcccgactgctcgccgatgatcgtcacctgatcgccgaactgctgcttgatatgtgaagtcaagtgctgcatcttacgcttgtagacagtgcgcatgcgcttaatatggcgggtccattcaccggccttcatcaattcagccatggtcagctggttaagcgaagaagcggtgctttcgaaatgaataaaccgttttttataccggtgcaaaaggcgctgcggcaaaaccatatagcttatgcggatgcccggtagaaaggattttgagaaattccctaaataaatcacccggtctgattgaatggaagcaagagcgggaaacggctgctgtgtataacggaattcactgtcataatcatcttcaagaatataaccctctctatgattcacccaattgatcagtgtttggcgctgctgaatggacatgcttacgccgtaagggctgtgatgggatggggtcacatagattaatttttctttcattgcatgcaattgagaaaaatcagctccgttttcatagacaggcatcgtttccagagatagcccgtgaaattgaaatgccgctctggccccgtcaaacccagggtcttcaacgataattccggaaaaatcctctttcagaatccggctgagatatatcagcatctgctgggtgctgctgccgatgataaccgaatccgcatctgttttcactccgcgtgattccaagagataagcggcaatttgttcacgcaggtctctctcgccgaacggttcaccgtaaaggaagcttttctctgatgccaaaacttgattgtataattttctccatgttttcagaggaaaatgcttttgatcgacggctccggcgcgaaaatcaatcagggccggctgagttgattcggttttcttagcgtaaacaacatcgttttctttttgaaataaagaaggttctacttcatttgcaaaataacctttgcgtgtttccccgcgaatgtatccctccgctaaaagaagatcataagccatcagcgttgtattgcggcttacccgcagggaatccgccagctcccgaatcgaaggcagccgctcatctgcctgaatatttccctgctcaatcaatgttttaaattgctcgtaaatttgtttgtatttcggggtgccgcttctgaaagcgaaaatcatatttttcatcagatattctcctctgacatgtgtatttgtttgaaactgtatctttttaaatgtcagttgatatcttattatagcggaaagcgctttatcaatccatgttcagagaggagagttttgtatgtatattccggctccatttcagctgagtgaagctgaagcgtgcgatgtaatcaaagagtatggtttcgcagcattgttttcaacggcgggaggcatgccgtatgcaacccacctgccattgatgatgagtaaggataacgaatgcttatacggtcattttgcattgccgaatccccaatggaaagagattgatggccaaaacgtgttagctgtttttcaagggcctcattgttatatctcgcctaaatggtatgagacgaatcaggctgttcccacatggaattacgtggcggttcatgtttacggagaggcggagcttttggatgaggaagaaaccgtgcagtcgatgagtgatctcgtcttgaaatacgaaagccccgacagcccgtacaaattagaggatgtcgatgcgaaattgctggcaggcatgaacaaaggggtaaaaggttttaaaatcaaaatcagcaaaatagaggggcaagcgaagcttagtcaaaatcattcagccgcaagacaagggctggtcgtacaacagctcaaacagattcctcatacaaacgaacagctcatttccggcttgatggaagaaaacatcaaacggatcaccgcggacaactgacaagcatgttaaaaacataccggcagcatgcggtatgtttttttctgattatgaagcttttctcaggatgaataacgactcgaacagcacataaatcaacggcgccattaaaatgaagaaagaatgaaaaatagcatacggtatgagtaagtaaacgataagtttcaatagaatggaagacgttttattcaatgtccagcggtttttcaagatatcagtcatacaagctaaaacaaggccgaccgtcaaatatatggctgctatgtaaagataaataaaaaggtaaaacgggtaagaagacaacggaggtgtgtcttcctgtgtcatttttaaacccacataaaagaccaataaaaagcaaacggacgaaacgagagctaacaaaaggtgtttatataaatacttcttcatgtgttcacctgcctatggcgcaattatttcttaacatattatgacatggttttaccgctgctgaaagaattggaagtccggctatatgagcggggcgtaaagaatcaatatcatcttttcatgaatccggatgttttgttcggatggatgtaaagaagaatacaccaaaaaaaaagctgtcagcttggtcctgacggcttattttttgggaaaggcttatttctccgtggtgaaataaagcaatgctatgacaggaaaagcgattccaatccataatgtgatactccacccgcctgaggcgtatgcccatcctccgattgatgagcctgcagcgccgcccagaaagaagattgccataaataatccgtttaatcggctgcgaaattcaggtgccaacgaaaaaatggcacgctgactgagtacgagattggcagatacccccatatccaacaggatagctgcggccaccagaactgctattccgacgggggagctgctctgaatcatgagcgggagtaataaagaaacgatgacaacaccgagagcgattccggtggcaagccgggtcaagccgcgatcagccagacggccgcctatcggtgcagccgctgcacccgcaatgcccgctaatgcatacagcgcgattgccttttgagaaaaatgaaaagcaggaccggacaataataaaggtacagtcgtccagaataagctgaaagctccaaatacaaacgcatgataaatggcacggcggcgtaagaccggagtcgtgcgcagcagcttccacattgaaccgagtaagacggtgtagcttgtgtttgctgttggttttctggcaggaagcacttttgataagacgattgccaggacaacacttaacgcggcggataaagcaaatatggcattccacccccatatatcagcgaccagactggatatcggacgggaaagcataataccgagaagcaggccgctcatcacattgccgacaacccggcctcgtgcggcatctggtgcaaggtatgatgcgaacggaactagcacttgggctgcgatggatcccagtccgatgaaaaacgcagcggctaaaaacagtgttccatgcttcacacatgctgtcagagttagagcggctgcgcttagtaggagcgataccacgacaagttttctgttttcgataatatctcccaaagggacgagaaacagtaggccggcaacgtatccgatttgagtcagcgtgacaatcaatccggcactgcttggagaaagcccgattgccgcactaatgaatcctgccaagggctgtgcataataaagattagcgacaatgataccgcatgccgttgcgagaagaagggttaaactggttgagattctctgatctgctttttgtttgtttaacgtagccatgtgaatgaactcctttttaatgattttatgaggtttgataaatattttgctgattcatctcctctccatagatttttagtgctaaggtttgcggagtgttgagcatttactaaactgtacgtttagtttttataagtaaataatatactgaacgttcagttttgtaaataggcttctgttttatttttttatcatgttaagtatactgaacgtatcgtttataattcgggaaggaatgattcatgtgcagagtaaacgaggacggccgcgtgatgaaggaacacataaggcgattctttctgctgcctatgacctattgttggaaaatggctttgacgcggtgacagtcgataaaattgcagagcgtgccaaagtgagtaaggcaacgatttataaatggtggtcaaacaaggctgccgttatcatggacagctttctttcgaccgctacggacagactgcctgtgcccgatacaggatcaacagtgcaagatatattgatccacgccgcgaatttagcaaagtttttgacaagccgggaaggaaccgttattaaggaattaatcggtgcgggacagctggatgcaaaattggcggaagaatatcgcacgcgatttttccagccccgccgcctccaagcgaaaggccttctggaaaagggaattcagaaaggtgaattaagagagaatcttgatattgaagtaagcatcgatctcatttacggaccgattttctatcgcctgttgatcacaggtgatgaggtgaatgattcctatgtgcatgatcttgtgatgagtgcgtttaagggagttcaagctacgtgaataatcgctcgaatggggcagataatgaaaaggcagaacaaattgttctgccttctcttgcgaacgcccggcagctgccacgcacgcattcaccgctgcaagccccaataacagcccgaagaaaggctggagaagctgcagagctgtttcgttgaagcttgagccagaggtgctgtctcagcagcaaaacatttataggacgggcaggcggagcgccgtatcaatattttgtaaattaaaccggacttgttcatctgtgttccacggatgataccagcctttttccatcatatagcgtgagatttgctcgtgcatgtcgatggcttcttctaagtgacgggtgaggatcgctttcacttcaggcgttccggcttccgtcgccgccatcgcatagtttctgactccgctttttgccgaattcaataaatccatagcgacaatttggtctgtcagtgcatccatccccgtcaagtattccataatcggattcattcgttattcatctcctattcgtgctttgcatcagataaaatcgaggcaaattcctgcaattgccttgttgatgtatccgcatcctgctgcatgatttctttcagctgcggatcggatacgagcgctttcatggttttggatttcgtcagacaaagtgacttaaaagaagccatctcctgaatttcgagtaattcatgtaaggcgctggccatttctgtagcctccgttctctaaggtttgagtacaactttaatacaatcatctgttttcgtgtcaaacatctcatagccgtgcttcgcttcactgagcggaatgacatggcttacaacatcgctcggatcaattttgccggttgacaccagttcaaacatatacggcatataatggataaccggagcttgtcctgatcggatattgacgttccgctgcatgatatcgccaaggggaaacccgttgtatctgccgccgtacacacccgtaatctgaatcgttccgccttttcgcaccgcttgggacgcgatgaccaatgcgctcatggccccgccttgaagttttaatccgctggcgaggaactccagatctgtcatttttccgtccatgccgacggcgtcaatgacaacgtcggcgccgcctttggtgatttccttcaggtagctgcccgtattttcgtggtcttcgaagttcacgatttccactttattcgtccgtttcgcatgctggagacggtagttgacatagtctacggctatgacgcgtttcgctccctttaaccagcagaatttttgagcgaaaaggcccacgggcccgcagccgagaacgatgaccgtatcgcctgcttttacgccggcattgtcaacgctccaaaaaccggttgtcatcgcatcggcaataacactcaatttctcatccggttcttcgcatgtttcggggactttaaaatgggtgaagttcgcaaaagggacgcgtaaatattcggcctggccgcccggatagccgccggtactccctgaatagccgaaataagcgcccatatcgccgttttcatttgattgatcacattggctttccaggtgatttttacaataagtgcattctccgcaggcgatattaaaaggaataatgacgcggtcgccttttttgactttcgtcacgccgggaccggtttcttccacaatgcccatcggttcatgcccgataatatagtcttcctgcaagttcggaatgagtccgtggattaaatgtaaatctgatccgcaaattgccgtacttgtgacttttataatcatgtcatcgtgtttttcaatcttcggatcaggcacgtctttgactacgacgtttttcactccttgatacgttacggccttcatgctgtaatacctccagtgttagtgttcatcaggtgtgcggtcaaacatcccttttctgttcgtttcaacgggaaacagattcatgtttccgaccatgagggtatttttcgcagagagctggtccagtttatactgttcgctcagatcatgcgggtgaaaccactttttgctgaccatcaagtcggtaatttcctgatgcatcgcgattccctgcatgagctgtttgcgcagcaaagctcttacatcaggtgaagcggtttctgttaaagcgacggcggtatttctgacgccttcttttgcccgtaaaagaaaatccattgcgaatgtcatatctgcgagttcagggacgtgtaatgaattgattggatctaaatagtcatgattcaatgatgcttaccttcctttcaattaatgatcgaagtcggccggttttgaggaacaggagcctgaaaagatgcccgttcataaaccgcctgcagatcagcaaggttttgcgaggcttgctgaacgtctttttccattaacgttttcagatcctgatcaaacacaagcccttgcatgagcttggatttcgctacacaaagcgtcttgaagttaatgatttcatgtaagtccagcgactcgtgagccgctaattcacgcttttccataatcgttttttaaacctcctcttctcaattacataattaatttcccctgagaaaagagctctagtcttacaaattttgtttataaaaaaagagagaagaaatctgacggtacattaaaaaagaggaagcacaatcgcttcctcttgttcacatggaatggctgtcggtgtcctgaacgtttttctgatgcgcgggcggttttgccgcgcgggagacgagaccgctgaaacccgggaaaggtcataaaaaagatatgaacaaaagcagcccgcgaacaatcccgcaggctgttttttctttcacccgtcatgcaggacagaaggggaaggtgagaagcaggcgattatggtatgatgacaaatagaataaaacatcgtgaggccggtcggctaaaaggaagtggacagagattgtttggtacaaaacatcaagaagactatgtctcccgtgacagacgctcattgcatatgcttgcgcttcgggtgcccggtctggcgtttatttttatggtatatgccgcatcagtctctttgcagtacatttatgaaagctggacggttttattgctgctgttattcacgatattgatcgtcatttttgccgtgctgcactggcattcctatcgctgggtcaagaaaaaaacgtttctttatttcatcatacagggattaatcatatatacatcggctaacttgatgaccggcggctatatcgcggcggtcatcggtctctatgcctttttaatcgggcagattatcggaatggcggataagggcaaaacgctgctcatactctatcttttcattttaatgtccatagcagccctgcaccaggagcatccgcatcatctgcttcgtttcatcgttatcgccgctcccatcatgatcgtgattatcacgtatgcggcaacatttttcgcgcaagttgatgaaaaaatcaaaacacagatgacgcttgaaaaattagagctcgctcaccggcaagtgaaacagctgacgcttcaaaacgaaaggcagcggatggcgagagacttgcacgatacacttgcacaagggctggtcagcttgcatatgcagcttgaagcggtgcatgttcatctttcaaagggtaacactgacagagcgaaagacatcatcagccagtcaatggatagagtgaagggcacattggctgatgcgcgctcggccattgacaaccttcgcagcaaatcagaagagatcgggttcttaaaagaaagcatcactgaacaaatcaaccattttacagaagcctccgggctgtcttgttttttagattacagcgtgcatcatgtgcttgacgttcatacggcggagaattgcctttacatgattggcgaaggcctgactaacgccgccaagcatgcagaagccaagaatgtctgggtgtccgttcaggaagaagagggacagatccgcataaccgtcaaagatgacgggaaaggctttgatgccggaacagaaatgagaaaaagcggacattacgggctgcttgggatacaagaacgcgtcaatatgatgaatggcactttccgtataacaagcgccagagcagcgggaactcaaattgagatcatcataccaattcaaggagaagcggaacatgtataaagtgttaatagcagatgaccatcttgtcgtcagagaaggtctgaagcttttgatagaaacaaatgaccattacaccataacgggagaggcggaaaacgggaaaaccgccgtccgccttgcagaggaactaaagcccgatgtcattctcatggatctgtacatgccggaaatgagcgggctggaagccattaaacagataaaagagcattctgatgtgccgatcattattttgacgacctataatgaagatcatctgatgatagaaggcatcgaatcaggcgcgaacggttatctgctgaaggacacaagctcagaaaccttatttcatacgatggatgcggcggtgaggggagaagtgcttctgcagccggacatcttgcgccgtttccgggaaatgaaaatggaacgggcaaatgccaatgaaacacagctgacggacaaggaaatcatagttctgcaagccgtggcgaaaggacataaaagcaaagcgatcgccttcgatttaggaatctctgagcggacggtaaaagcgagattaacatcgatttataacaaattaggcgctgattcgcggacggaagccgtcaccattgccatgcaaaaaggcattctgaaactgaatatataatgaaaaactgcccaaacgtacatgcccctatgtacgttttttttatgtgaatgtgaactacaattaggcagaaagtaatgattggagaggagtattcgatgtctggttttttatataaattagggggatggtctgcccgcaaccgattcaaaatgatcagtgcgtggctcgtgatactgatcgcttcgattgtgatcgccatctcgttaaaacctgctttttctgaggatatgtcaattcccgacacaccttctgaaaaggcgatggatgtgattcaaaaagaattttcaaaggggcccgataaaggaagcatacgggttattttcggagctgaagacgggaagaaattgacgtcaaaaccggaaaaacaagcgattgaagagacattaaagaagatcaaaacagatcattcagtcgcttcgattgcaagtccttttgaaacaggaaccatttctaaagacggatcagtggcatatgccgatattacgtacaaaaaagcggcggatgacattacggatgcgtctgtttcacatattaaacacagtctgtccgccgccggagacaagggcctgcagacggagctcagcggcgatgtgccgggggccggtgttgaagccggcggtgtatctgaaattgtcggcgttgtgctggctttcgtcgttctggccattacatttggttcattagtcatagcggggctgccgattgtcacggccctgatcgggttaggtgtaagcgtcgcgctgacgttaattgggacacagatctttacgatagcctccgtcagtctctcattatcaggaatgatcggcctggccgtcgggattgattatgcgctgtttatctttacgaagcatcgtcagtttttgggcgaaggtgtacaaaaaaatgaatcgatcgctaaagctgcgggaacggctggcagcgccgtcgtttttgcgggactgaccgtgatcgtcgcgctttgcggattgaccgttgtcggcattccgttcatgtctgcgatgggattgactgcggcactcagtgtgctgatggctgtattggcatcagtaacgctggtgcctgcggtgttgtcaattgcaggaaaacggatgattccgaaatcaaacaagaagaaagaaaagaaaagcgccgacacgaatgcctggggacgcttcgttacaaagaagcctattctgttaagcattttcagcattattcttttagccgtcatcagtctgccggccatgcatttagagctggggctgcctgatgcgggaatgaaagcgaaagacagcccggaccgccgcgcctatgatctgttgtctaaaggattcggcgagggctttaacggcaagctgacaattgttgccgatgcaaaaggggtcaagggaaacaaaagtgaagcatttcaagacgccgtgaaagaaataaaggacttgcacaatgtggcgagcgtcacacctgccatgccgaatcaaaaaggggattatgccatcattacggcagtgcctgaaaccgggccgaatgataaggcaacgaaagagttagtgcaggatatacggaaacgatcagacaaaaacggcacccgcctgctcgtcaccgggtcaacagcggtgaatattgatatttcagaccggttaaacgatgcgattccggaattcgccattcttattgtcgggtttgcgtttgtattgctgaccgttgttttccgctcgcttctcgtgccgcttgccgccgtcgtcggctttttgctgacgatgaccgctacactcgggttatcggtattcgttctgcaggatgggaatttcaccggcttgctcagcattccggaaaaaggtccgattctcgccttcctgcctattttagccatcggtattcttttcgggctggcgatggactatcaagtattccttgtcagcagaatgagagaagaatatgtcaaaacaaaaaatccggtacaagccatccatgccggattgaaacatagcggacctgtcgtaacagcggcgggactgatcatgattttcgtctttgcgggattcatcttcgcgggggactctacgatcaaatccatggggttggcaatgaccttcggtgttcttttcgatgcgttcattgtaagaatgaccatcattccgagtgtcatgaagctgatgggacatgcggcctggtacttgccgaagtggctggataaaatcattccgaacgtggatatcgaaggccataagctgacacaaggcaaaacaccggagaaaccggaagaataaaatgaaaaagcagatcgttatgatctgctttttttatgtgctgaccgcattcatgaacagagaaaaaagctttttcatgtcttcatgtttttttgtcagcatttcgggatgccattgcacgccgacgacaaataattcacccgttcgttcaatcgcttcaatggccccgtctttcgcataagccgcggctttaaatgaaggcgccgtctcttttatgatctggtgatggaatgaattcacccgcgctgaatcgccaaacaaggaatggagacgtgtccctttttcaaaagaaacatgatgggtttttaacggcggatctttttcttgatcgtgcttaatgtcagcaaacgaagcgtgtgtcaggtcttgatataaagttcccccgtaagtgacgtttaacatatgcatcccccggcagattgccagaatcggcttttctaaagcaaccgccgtgagaatcagctccttctcgtaggcatcccgatcaggaaaggtctttcttaaagcctgtaaaggttcttcgccgtaaaacagcgggtctatatcctggccgccggacagaatgatgccgtcaacatgagagacctgttcctttaaaagcgccatctcttgaatcaccggcaatataaatggcacaccgccggcctcagaaacagactgaatataatcattattgacatatgcccgattataacccgggaaagggccggattgatcagccataatgtttcccgtaattccgatgcgtttggccatcctgcgttcacctgaacctttctttctgaaccttctcgtataaatctgaacgtaggttgtacaaatcagtttgaaattattcttcatgatatgtgaacttttcaaaaaaacccgtgacaatcacgggtttttacattcatttcaacttcttgatttcttccgtcagctctttgaacttttgatcaagctcacgatattgtttatcagccggagtcatgaagctgagttttccgaggacttcctgccgttcggtttcaagctttaatcgcagttcttcagcatcatccctgacggagggagattctttccattgttttcggacgctgccgtttgagatatcaagccggatgtccgtcgtcttttcgacaaagtaacgatcatgcgatacgatgatgagcgttccgtcgtatcgggccaaagtgtcttcaagctgctcgcgtgacggcagatcaaggtggtttgtcggctcatccagaatcagcacatctttctcctccagaataaacgccatcagcttgcatttgacccgctctcccatgctcatcttgccgatgggttccgtccattgcgctgcggtaaatcctaaatgcttcatgagggattgaacatttccccttgcttcgaacgtttctttgtaaaaaagctgttcgggggttttatcaagcggaaggtcgaatacttcctgggttaaatagccgacgtttgcagacggagaaatccatatgccgccctgcgctttttcctgaccgaggatgaccttcaataatgttgttttcccgctgccgttcgggcctgtaatcgcgatcttttcaccgtgcatcacagtgaaattcacgtttttaaaaagcgttcggccttcatatgactttgtgacatcacttacttctaaaaaacgctttcccgcttttttgcggtgctcaatggaaaaacggacttcatactccgcttcaaccggttctgctttcgctttttcaagctctttttcaagacgcttctgctttgatttaatctgggcgtccgtgcgttttgcttttacgcggtgatattctttaaagccttctattttcgttgattgggcgtgggctttttttgaccaggcgctcagctcgttcatttgagcttcaatccgtctgatcatatgctgctgattctcatattcccgctgctgtgtcagccttctctgtttgcggacctccatatagcttgaataattccctttatgttcaatgagtttctttccttcgatggcccagatttttgtcgccgccgcatctataaaagcacgatcatgtgaaacgaaaataatggtgcctttgtaattcctgatctgattcagcagtatttctaaactgtgctgatcgaggtggttcgtcggctcatctaataacaaaaggccgcttgaggaggagaaacctttggcaagacgggctttcaatttttctccgccgcttaattgcgaaaaggcgcgtgcgggcacgttccacttttctaacagggctgcctccgcaggctccgggtggccggaattataagcttccgtttcttgttccaccatatatatgttcacatcttgcatcatctggatctgtccttgtgacggcgctttttgattgcagatcaattgcagcaataaagatttgccggcgccgtttttaccgataacgccgatgatgtcgccttgctggacactcgcgctgatctgttcaaaaaggggaacgctgttgatttcataactgatgccgcttaactttaacatttctttcatatgtcaatccctcgctttaaagggaggacaaaaaaatcctcccaattgatttggaaggattagccgtacctgtgcatgatcaaataagctatttttacatagctttctcgtatcgtatagaaaatgggcagactaatcctattttttctgatttgaaatatttgatttcaaacggtcaaaataagattagttaatcattgtccacccatcatcccttcgtatttgttacgaacagtgtagcatacacttatctgtaaaagcaaagggtataagcctttttattccagattgggggcttcccactcttcttctaaaacggcataataatattcatcccaccattcattatcatgggggatgcattttttaaaaaagccttcccgcctcatcccgatcttttccattacccggtgcgaagccatgttttccggctgacatgtcgcaatgatccggtgtaatttcatctttttaaacccgaaagccagcacggcgcgcgccgcctctgaagcatatcctttgccctggtattccgggtgaaacacccagccgattacatacgtatgatcgccaaaatactgaaaaaaagcaatgtggccaatgaccgttttctcatccttcaataaaacgggaaacttcccggcatgttcaccgctgttttcagtaacgaatttcctggcatcttcttcggtaaagacaccctctggtatatatttcatgacactcggatttgaggtgtacgcatagacatcctgccaatcttccggttcaaatgtccgaatgacgagcctttcagttttgatattcatttttttatgttcctccatcaaaaaaggtttcatttactacttcgattgaaagatgtaaaaaacctttgagcggggaagagccgaataaaaaaagcctgcagctatacactgcaggcggttatttttcatttgcggcggcaggcaggtttgtaaacccgaattgccctccgacagcttcttttacttcatgaataacgataaatgatttcggatcaattttttgaacatgttttttgattttcagcaattcgttctttttaatgacaacatagataatgcgcttgtctttgctgccgtaatacccgtatccgtaaaaaatcgtcgccgcgttgccgtactcggaggtgatggctttggcgatttcttcgtattggtcagacataatggtgagggcttttttattatggaaaccctcaatgacaatatcgacgattttggcgcacagataaacgaatataaacgtatacagcatatgattgattccgatcgctaaaacggatgcgaaaatgatgacacaatccatataaaacatgcttttggagatgttaaagccctttgtgtaattcaataaatacgccaaaagcgtggtcccgccggtagatccgtcagcgataaagatcaatgccagccccgctcccatcagcagagcgccgaatacgatcccgagcaccatgtcgtgcacgccgaatggaataaagctgacgatgctgagaaaaacagaagtcattcccgtaccgagtatcgtgtataaaatcgtttttttcgttaaaaatttataagccaacccgataaaaatcaaatttacaaccagagtcgtaatacttgcaggtatatggaaaagataatataaaacgagagcgattcccacggtgctgccgtcccctaaatgattcgggatgacgaaaaattccacggacgccgcgataagaaaggctccggccataatcatcagtatatccttgcaaatgttcttcatatgcaaacctcctccgcagtcaaaaatatataaaaaacaaaaacgcctcaaaaattatccagcagaactaaataatttttaagacgaatcattcacaatctcgtttgttcattcagtaaagaatgatcagcttcaatatcgaagattatatagacaccttcacatcttgtcaatgccgtgaaaattgatttttcagcagtgtatatgaggtttgaatcaaaccaaaacgaggaatgatatcagaagagttttcatttctgctctatcaataagagaaatgtaatgagagacaacgaagaagggatgatgacattggaacgaatttttatcagtccggccaaatacgtgcagggaaaaaacgccattgaaacaatcggcggacatctggagggtgttggtgaaaaagccgtcgtcatcgcggacaaaaccgtatgggatatcgcgggccataaagtgacggctgaattaaagaaaagcaatatctcttctgaagaggcggttttcaacggcgaagcctcccaggaagaaatgaaaagaattgccggcatcgcagaaaaagcaggggcgactattgtcatcggagtcggcggcggtaaaacgcttgatacggccaaagccgtatcagatgaaataaacggctacaccgttatcgtgccgacggccgcttcaacggatgctccgacaagcgggctgtctgtcgtgtattctgaacaaggcgcgttcgaaaactatcgtttttatcataagaatcctgacttggttctggtcgatacgaaaatcgtcgcggaagctccgccgcgctttttagcatcagggattgccgatgcgatggcgacgtggatagaggcgcgcagtgtcatcgccaatggcggtaaaacgatggcaggcggaattccgacaatcgccggagaggctatcgcggaaaaatgtgaagcggtattattcaaatacggccgtctcgcttatgagtctgtgaaagcgaaagccgttacgcctgcattggaagcggtggttgaagccaatacacttctgagcggactgggatttgaaagcggcggcttagctgcggcgcatgccattcataacggatttaccgcgcttgaaggtgaaatccatcacttgacccacggtgaaaaagtggcattcggcacgctcgttcaattggcgctggaaaaacgttcgcttgaggaaattgagcggtatatcgcgttttatatcagcttggggctgcctgtcacacttgaagacatcaaattgaaagacgcatctaaagaggacattatgaaagtggcagaagccgcgacgattgaagaagaaacgattcatgccgcttttgacgtgacggctgacgacgtggcggatgccattatagcggctgatcaatacgcaaaagcatttaaagaaaaacacgcgtaaaaccttttaccgcgtgacccggaaccaagggctgttacagcccttggttttttttatgccctttgaaaacttttaaaaataaagaaaaaattatgatacaatatacaaatgttttgagagattgacaaaggaaaggtgggaacgatatgctgcataatccgaccggtaaggagcggcttgcgctggcttttctactcggaatgcttgcgatactggggccgctcaatatagatatgtatctgccgagcttccctgaaatcgccgaagatttaagcgcccgcgcttcgcttgtccagctcagtttaaccgcttgtctgatcggactgacaatcggacaggttgttgtcggcccgttaagtgacgcgaagggaagaagaaaaccgttattgctatgtatttttttatttgctttgttttctctgttttgcgcgcttgcaccgaacatttcaacactggtgattgcccgttttcttcaaggattcaccgcttcggcgggactcgttttatcccgtgcaatcgtcagagatgtgtttacggggagagagctttctaaatttttctcgctgctgatggttattaccgccgtcgcgccgatggtggcgccgatgacgggaggcgcgattttattgcttccgtttgcatcatggcatacgatttttctgtttttaacctttatcgggtttttgcttgttctcatcattgcgctcaagttgacagaaaccctgccgccggaaaagcggattccgagctccatcggaaattccgtgcggacaatgggaagcctgctgaaggatcggtcatttatcggctatgcgctgacggtcggttttattcacggcgggagctttgcgtatgtctccggaacgccttttgtgtatcaggatatttacggagtatcgcctcaggtattcagtgttttattcggcataaacggtctggcgatcattaccggaagctttatcatcggccgtttcggcgggatcattcacgaaaaaagcctgctgagaatcggcgtgattacagcgatgacggcgactgccgttctgctcgtcatgacgatcattcacgggccgctggcggcactggtgatttctatttttatttatatgattacgatcggcatgacgctgacaagcacctttacattggcgatggaaaagcagggacaccgcgcgggaagcgcaagcgcactgctcggcatgcttccgcttcttctcggttccatcgtgtcgccgcttgtggggatgaatgaagcgacggccgtgccgatgggggcaattatgttcacgacatccgttatcggttccatcgcttttttcgccttaacaacaaaaccggagaaagcaaaaaaggagtgaaatgattcactcctttttttgatgcccgctattcatatttcttcagcacgatcgccgaattatgtccgccaaagccgaatgagttggaaaggccgatcgttaacgattgatggcggggcccgtctgacacatagtccaaatcacatgccgaatcagggtgctgcagattgatcgtcggcgggatgatgccgtgtctcaggctttctgtcagagcgatggcttcaacgccgcctgccgcgccaagcatgtggccgagcattgatttgttggccgtaaccggaatgtcatacgcaagctctccgaataatgtcttgatggccaatgtttcagaaagatctccggcttttgtgcttgtcgcgtgggcgcttacgacatcaatgtcttccgctgaaacgtttgcctttttcaaagcatttttcatcgccaggtatgcacccgtcccttccggatgggaggccaccatatgatacgcgtcagagcttgcgccgtagccgagcacttcacaaaggatcggggcatttctgccgattgcgctatccaatgattccaatactaagatgcctgcgccttcactcatgacaaacccatcgcgatccgcgtcaaacggccggcttgccgcggcggggtcttcgtttctcgctgacagcgcgtgggcattgccgaagctggctaatgacaaattcgtaatcgccgcttccgctcccccggcaaacatgatatctgcgtcatcattccgaatggcgttgaatgcttccccgatcgacgtattgccgatggaacacgcggtgacgggcgaaagtgaggggccgagcgcgcctaatctgatgctgatttgagcggcggccgcgtttgagatcatcatggggacaaggctcgggctcacttttcgcgctccccgttcatttaaagtatgaacgttatcaatcaaagtcgtgatgccgccgattcccgagccgacgtacacgccgaggcgttcacggtcaatctgatcgagctgaatcccggagctttcaagcgcctgttccgctgccgctaaagcaaactggctgaaacggtcaagccgtctcgcttcttttctgccccatctttcttctgcgtcaaaatcacggacggtgccggctatttttgtcttggagccggagacatcaaacgaatcgatgagagagattcccgatgttccttccgtcaggtgtttccaaaatgtatgcacatcattgccgagaggtgaaatcactcccattccggtgatcacaactcttttcatggtcattcctccttcggtatgtatttattgtaactcgcaattatcctattacaagttgttggttatcctagtataataaataccagggtaagagaggagagattcggtatgataccagaaggaagattgcaggcgctctcagagtttttaaaaacgcagcgggccaaaatttctccgcagatggccgggctgccgatgggcacacggagaagaacgcccggactccgaagagaagaggtcgcgcaattagccggcgtaagcaccacgtggtatacgtggctggagcagggcagagacattaaagtgtccgcagccgtgttggacgcggtttccgatgcgctgcagctcaataaagatgagagaaattatttatacgcgcttgccattgaggagggcgtgaagcagccgtttaccgcggaggaagaagcggttatcagcccgtcgctttcaaaaatcctgcaggagctccgttattgccccaccattatctcggacaggcggtgtcatatcgtaggatggaatcaggccgcggctcacgtgtttttagattttgaacaaattcctcctgaaaaacggaatctcatagagctattgttttccagaaaagaattaagaagtttagccgtgaactgggagcactttgtgaaaggattcatcgccattttcagaacgtattacggccagtatgtagctgatacgtggtattctcagtttatagaagaaatggagaaaacgtattcggaatttcatacgctgtggaatgagagcgaagtcagctcggcacccgaagtattaattgagttccgccacgcgaaggcgggaaaaatggtctttaacctgacttcatttcaggttcagggcaacagtgatctgcgctgcagtgtgtatacgccggtagatcataccgaaacggaagcaaagctgaaaaagctcttcgaaaacaggtgaagaacagaaaaaaaggggaggcggccgcctcccgtttcagtttaaaataaaagcatcaaaccggcgatggccggtgttaaaaagatggctgatttcagaatgactttcggcacgaggttggtgaattttgctccgacatatgcgccgcacatcgttccgatcagcactttgaccaacagcatataatcgacaaatccttccgtcacataaccgagtcctccgccgaccgcaagcgggataatgacaagcatggtggtgccgaccgactggcggatggataagcgcaaaagaatcattaagccgatttggataaaaggagcagagccgataccgaacgttccggacaagattcctgcgatgataccgagtacaacggctttcacccatatgttcaggttgctttgccgtccggaatcttcttgtgtttcttttacaataaataaccggactaaaataagcagagcagataaaaacagcatgccggccgtcaagtaatgcagcaaatctgcggggataagggaagtaagccttgccccgaaaaacgaaccgaatgccgcaaaaacgccgacgatgaggccgattttcatctgaatattgccttcacggtagtggctgaaagcccccgataaacttgtgaaagccattccggcgagggaggtgcccaaagccgtatgaatcggtacgtgaaacagtatagttaaaagtgcaatgacaaaaccggctccccccgcgccgataaacccgagaataatcccgagaagaaacataacgagtataataagcacaatcttctcctccatttagatgcctgatcaccatgttcagatccgctttatcaggtttttaacaatcgatcgtcgtccgtcgaccgtcgtccattatctttatgttacctcaaatttgagggattggcaagaagccgaatcgcttttatacagagggtttacagctctttcaccatcactttttccccgtttgagtccagctctccattgaataagaagccgaatttttgataaagccgcaatgcgtgcacgttatcttcaaacagacttaaataaatccgtctgcactcatatattcgaacgagatggcggataagggcatcaagcaacagcctgcccaatccacgtccctgataacgttcatcaataaaaaaacggtcaagccacactctgccgttttcattttcctcatcatattccggaaaccatccgtacatggcaaagccgaccaattccccgttaacataaagaccggccggctgataatgccggcaatcctcagcatcttgtaagcactcttccgcggtttcaataaatgaagtctggctttcccttacatgaagcgccagtatatcggcacggttctcttccgtgactgctctgatttcaatcgtcatacttgatactcctcttccgcttttttctgagacggtaaagctttcatttcgtaagccatttgtgaatcagccttctctcggatacaatgatcatcataaaggatatggttaccgtatagtcaaggaggcattatgagcgaagacgtcagaaaatacttcacaacgggtgaatttgcaaaactgtgccacgtaaaaaaacaaaccctgttccattatgacgagatcggcctgctttctccggaaatcaaaaaagcgaacggatacagatactattcctatcataaattcgaactgttccaggtcatcggtctgtttaaggaggtcggggtgtccttgaagcagatcaaaccgctcttaacagacaaaacccccgaaggtatcatcacgcttttaaaagagaaatcttcagaaatcgaaagcaaaatcaaaaagctggagcacctgcaaagaatgattcagacaaaggtgaagctgaccgaacaagctttggagacagacttctcctccgtctcattgcaacgattagatgaagagacacttatgataggacgacccgtactccatttgccagaacggcaatacactgccgccatttccgaattgatccgctatatgcgggtacatgaactcgatcagggacatccggtcggcggactgtttgcgcgggagcagattctgaaaaaagaattctacaactacacccatttttatatgaagacagaaggaggcatagagaatagagacctccatatcaagccgaaagggctttatgccgtcgggtaccaaataggggatgaagcggaatcggcgtaccgcagcatcatgcagtttattgaagagtatgggctggaaatgggcgattatgcatatgaagaatatatgcttgatgaggttgtggcggacgggtttgacaatcagatcacaagaatccagctgcaagtccgcaatcgataaagccgatgccgccgttcgtttacgtcttctgacaaaccttgtataatgagaaaatcagattgcaattgaggtgaaaaacgatatgtttctagcgcccttatttgaacatgatgtaccggcagcacttctccgcccttaatggaggaaagtgactgcgcttctctccgttagggcatatgacgtgacctaatatgataacggagggtgcatcaaattgaaaaatacattgttcggttcgatttatttggcattggccgccagtatctggggcggtatgtatgtcgtcgtaaaagtagtggtagcggtcattccgccgcttgaactggtatggctgagatatgcggtggcgcttctttcgcttttgattctcagtttatttacacgccaatcctggaaagttcataaacgtgatttattactgatcgctgcgatcggattgatcggcaacacggtttcgatcgtcacgcaggaaatcggcacgaaattatcaaccgcgcagatgggtgcgattattacggcatccactcccgcatttatggttgtatttgcccggctgatgctgaaagaacggttaacgctgaaaaaaggaatatcgacagggctggcgacgatcggagtattgctcattgtggggaacggagatctcgatatgtcgagccagctcggcggtctctcgcttctggctgcggcgctgacatgggctttgatgtccgtgctgatgaaacgggttcccggccattactcaccgcttgtcgtcacaacgtattctatttgcgtcgcatttgtcatcctgaccccgtttacagcgggcccgcttcgggagattcctttgtctcagcttgcccggcctgagatatggggcggacttttatatctgggtgtgatctcaaccgcctgcgcgttcatgctttggaatcgcggattgcaattgctgaatgcggcaagcggcggtctgtttttcttctttcagccgctttccgggacattgctcggctggctgctgttgggagagtcgatcggaggaaccttctggatcggggcggcccttattgtttcaggcgtcgttctcgtcatgaaagaaaaatagaaaatgaaaaaaagccattcagcaaatgaatggcttttttctgatttcccggcaggattcgctccgccataaacagaaaacaaggagcagaaacggatcatgggcaccggtactctcaaggtgcaattcggggtttcgtcaattaacataacgggcggtgaaaaaatggagccaaaatggcttgaatgggcaaaacagcttcaatccgcggcgcaagcggggctggcttattccaaagacatatatgatattgagagatttgaagaaataagaaaaataagcgtggatatcatggcgcaacataccgggatcgacaaaaggatcatcaaagacgtattcgccggtgacacgggctatcccactccgaaagttgatatcagagcggcagtttttaaagatcagagcatattaatggtaagagagaaaagcgacggcagatgggcgctgccgggcgggtgggctgatatcgggatttcaccgggcgagaccgctgtcaaagaagtaaaagaggagtcgggaatcgacgtaaagcccgttaaactgttagctgtaatggataagaaatgccattcccatccgccgtccgccgcccacgtttacaaagtgtttatcaaatgcgagatcatcggcggccggctcagagagggaacggaaacaagcgcggccggcttttttgcggaaacggagctgccgccgctatctgccgcccgcaatacggtaagtcagattgaaaagatgtttgcatatctcaaacatccggatgaacccgtttattttgattaaggcagcaagcaggaaaaagagaggaactggttcagcaccatttcacttatgaatgatccggcctgtgatagagaagggtaaatcatcaggccgggttttaagagtctgtctgtttcggtgtggtgcaccccttaaaaaaccgtttttgaaaagtcgataatcctgcgggcagcttctgtcggtttttcctcggggacataatggccgcagccttttacctcatatccgctgacttcacgaattgattctctccatgtgtcaagcacgggaaggccggctaagttccctttttctccccacagcaaaagcgtgggaacatccagttttttctgtgattccttttctgaacgatatctcggcaaatcaatttgataagcggctctgtagtcattaagcgcagcttgaacagcgccgggctgcttccaggcggctaagtaccggtcccaggcgccgtctgatgccagcaggtcaaaaagcccgtcacctctgcttaataaaaatctaagatattcctcttcttttccttttattaattcttccggcagatggggaacgacctgaaatgtccagtgccagtatttttttgccgcttcagctgccgtcaaagaatcatagacgtattcagtcggcataatgtcaatgagcacaaggcctgccgccagctccggcgcatctaaagcgagccgccttgctactcttgcgcctctgtcatgcccggcaattaacgctttttgtatatgcaggcggcgcatcagaccttgtatatcgcctgccatcgttttgttatcatagccgtttatgccgctcggcttttcagaatcgccgtagcccctcagatcaactgcgatgactctatgagaagcggcaagcgtcggaatcacataacgccacgtcacccagctttgcggaaagccgtgcaggagaatgacggggggagcatcctcctttcccgtaaagacgtaatgaaggcggatgccatttaccttaattgaatcatgggtcacatgcttttcaaattgttcacgaaaagaatccattttctctctcctcataaaatgttatttgtttatttgagaaataatagcggaagtgacatcttccgttgaatgttttccgccggcatcaggagtcagaatgccgctgtttgtgaccgtttcaatagattgtaagaggagatggcccagttcctcttctccgaatgaatcgagcattaatttcgccgtccatatttggcctataggattggcaattccttttccgacaatatccggggcggagccgtgaacaggctcaaacatagaaggatatttgccgtttacattgatgttggctgcgggagcgattccgacgcttcccataatcgccgcgccgatatctgtcagcacatctccgaacagattcgaagcgacaatgacatcaaagcgttccggctgcgtgacaaagaaggccgccagtgcatcgatgtgctgggaatccgtctcaatcccggcgtactcccggctgacctctttaaagatgtcatcccagaacggcatcgagtgaacaataccgtttgatttcgtcgcgcttgtgacgtgtttccgccgacttgccgccagttcgaaagcataccgcatcactctttctgtaccccgtcgggaaaagaccgcgttttgtatggcgatttcgtcctcaccctgatagattctgccgccgacagagctgtactcgccctcactgttttcgcggacgactatcagatcaaaatccttcgggttaacgaggggggaagtgattcccggcaggagcttcgccggccgcacattaatcacctgttcaaattcccggcgtatcttgatgagcagcccccacagcgaaacatgatcggggacgagtttttgattccccaccgctcccaaaaacaaagcatcaaagtgctgtaacgtttctagtccatcatccggcatcatagtcccgtgctccaaataatactcgcagctccacggaaaagaagtgaaatcaaaggcaatgcctccatgtaattcggcgatcgcgttcaacacccgctccgcttgcggaacgacttctttccccacaccgtcccccggtatgctggcaatcttgtatgttttcatgtttccgtcacctctgaatgaattgttttcggtttacggcagaccgtcgaccgtcgttcgctataattccatattacgccacatccgatatgctgacaagctcgggaatgttgcttccatagataaactgttatatgatcttggtaacaataaggcctaaattgtatgaagaggtaggaaagatggataattttaaattagataagccaatcccgtattatctgcaattttattcccaattgaaaaaaatgatatttgacgggatttttaaaccgggtgaacggctgaatgagactcagctggctaaggatttcggagtcagccggtcgccggtcagagaagccatgcggctccttgaaaaggacgggcttctgacagcagacgatcgaaacggctttgtcatttattctttgtccgttaaggatgttgaagagatttatcaaatcagaatgtcacttgaatcactggcggtcgaactggttattgatgaagcggctgagagtgaaattgacctcattgaaaaacagctgcgggagacggaagaagccatcaataaaggcgtcaaagagactgagattatttccttaaacgagtcgtttcatcggcttcttgtggatttcagccgcaacagccggctggccatgctgcttgagcatgtcaatgtgctgattcatttttgcagagttcttaattttaaaggagatgaccgtgcggaggttatcctgcatgagcatcggaaagtctttgaagaaataaaaaagggcgataaaacaaaagccgtgcaatatatgacggagcatctcaagcatgatgaagaacatctgaaaggcgtgctcaaagcgggagaaacagacgaatcatcacgatagacaaggtgaaaagccttgtcttttttgccgatgtcatcgaaccgtcataaagacctgacggatgttccttgcatgattttttccgcgtcatttatgatggatatggaagagacgcaaaaaaggcaaaggagtttgaaaaatggcgaaacatattctgatgatcaattttcccgcagaaggacacgtaaacccgactttgggtatgacaaaggccttcagcgaacggggcgatcacgttcattatatctcaacggaaaaatacaaaagcagactggaaggagtaggagcgaaagttcatcttcacagcgatctgctcagaatgacacccattgatcccggcagtccgtccggcatacttgcatttttaaaggttcatatcaaaacgtcactggagattttacatattgtgcagcggctggcagaggacattcaattcgacgccgtctattatgataaattcggtgcgggagagctggtgcgggattatctcaacattcccggcatctcttcttcagcatccttcctgttcaatgaagaccgtctgaaaatactgccgctccatccggaatcgggcgtgccgtttcagccggacagggaatgtgaagagctgttggccgagatgaaagacaaatacggtgtcgcccctgacagcatggttcaatttatgaacaacacaggtgaattgaacgtcgtctatacaagcagatattttcagcccgaaagtgagacattcggagatgagtatttatttatcggtccgagttttccgaagagaaaagggcgcgtcgacttcccgattgactcattaaagaatgaaaaagtcatttatatctcaatgggaacggtgctcggggacacggaagcgtttttcaatctgtgcatagacgcgttctcagattttgaaggaaaagtagtcattgccgccggggaaaaagccgatatgtcgaaaatcaaacaggcgcccgaaaactttatcatcgccccgtacgtgccgcagcttgaagtgctggagcaggccgacgtgtttgtcacgcatggcggaatgaacagtgtaaatgaaggcattcattatcaagtgccgctggtcgttattccgcatgataaagaccagccgatggttgcgcgccgcctgactgaattggatgcaggctatacagtgcaaaaagatgaagtgagcgctgaaaaggtaaagcttgccgcggaagaagtgctgcataacggaaaatacaaacaaggcattcaagccattaatgaaagctttaaagaatgtatggacatgaaggatgttctggcccggatcgaccggtttattgaacaaaaacatgctcaataatacatggaaaaagcctgtttcctctgccaaagggaaacaggctttttataatggcttttagatgatgtgatgttcttcatttgcaagtttcacaagagtcagaagagattctgcctcacgtgcgtcgagtgtttttgccagacggtctttttcaaagatctgctggccgaagacattcactgacgcctggtcaaccgccgtgtgccagttcttttgtgaatgattctcagaaaaagagaaaacaaacacggcaaagaccgctataagcatcgccatgacccaaaatttttgccgatttcctgctgctgacataggccgcctcctaacgttcattttactggtattagatcatatatgagctgtttttcatagagtaaagaagtcattatttcaggtagtccaaatgaaacggagcacagccgaaagcccgccggtcaggccgatgagccaattcatattttgttcatattttattaaaagtttatccaagcctgtcctttacagtggatataaccacaaaacgctgctgaaaggggccttgaaaaatgcatattcatatgatcaacaaaaaccagtttgagagtgacttggaggcggccggcttcatccgtcaggcagatgatattatcggcaaaatgaaagaatacgtaacggaatacgcggcttcatccgaacggtttctgattgaaattcaaaccgtcatgaacgaatacaaagccgtcgtctgtgcgatgttttcgactatggaaattgccggtgcaaaaaaagacgagaagcatgttgagttcgaagcctgcacagtatggtgcgaataaaagaccttcatcaaacccccgcggctgcctgaacggcagtttactgactggtgttccagtaaggaaaaatattgaaacttctaaagcggctgttcgtataaaagagtaaatcagcttgtatatggaggttcgtgaaatgaacgataagaaaaaacaagcttttgaacagcttttcagcactttagacggaagacatgaaataaacggagctgtattggcagcggaaaacggccgcatcttatatcagggttcattcggcgctgcagaactgaaaacaaagaggatgctgaatgaccaatcggtctttgaattggcctcagtatcgaagccgtttacagctttaggcgttatcattttagagcagcaagggaagctgcgttatgacgatatgatagagcggtggcttcctgattttccttatccgggcattaccattcggcaactactccatcatacgtcaggattgccggactatatggagttatttttaacacattgggaccgggacagaattgccgttaatcaagatgtgatcgatatgcttaagcagcataaaccggatgcttatttcccgccgggcaaggattggctttacagtaatacggggtatgcggtgttagcggttattatagaaattgtatcaggcatgagttttgctgaatttatgaaacaagccgtatttcatccgcttcgtatgcacgatacgcggatttataacagaaggctgagtaaagaaaacattccgaactatgcatatggctatgtgtatgatgttcattccggagaatatgtgctgccggatgaacttgaggaaaccgattatgtcgtctttcttgacgggattcaaggtgacggaaccgttaactccactattagagatttatatctgtttgatcaggctctttatacggaagaaatcatcggcaaagagtctaaagatcaagcgtttacgccgggctattggaatgaagaagagcaattcggatacggatttggctggatgattcaaaacagccgccaaaaagggaaggttatcagtcacgacggaggctggccgggctattcaactctgatgatccggtatattgaccagaacaaaacactgatttatctcagcaatatggaacaatcgtatcaatttgaacaagctgtgattgccgcggccgtaaacatcttatttgatcagccatacgtgattccgaaacgtccggcggatcagaaaaaagcagatatcgatcctgcgatttacagcagatttaccggcaattactcatttcaggatgacacacatgcatcggtgacggtaaaagaaaaccgattgtatcttacaatagacgggcagacaccattcgaattattcccaatgacggaaacccgttattttgtcagggcgctgccgcttgaaattgaatttgcaggtgataaagcacaaacagccccgcatttcgttttatatcaggacggcacagaagaaacggctttgcggatagactgagtgacatgcaaaacaaaaccgccgtcctgagaagacggcggtaatagagaagtcaaacccctttgatgacgcgaaattttcttttcggctctgacataaatatagaagaaaaaatcatagctccgaccattgtgatgtattccatataaagcgaaacttctgccaaaaccaaccccgcaatcattaaaacagcgcccaataccaccgcaaaaaccttcgttttcatgatgagttcccctattatctgataattgaattatactgcatctctattaatgtgtacattttgtgaacaatttcacctgataaaaggcaataaagagagagttgaagaattaggagaaatgacaggccatctttttgttttaccgaagaaacgaaagggaaaatgaaaaatcaaaaaggcaaaggagttcttgaaatgaaagcgagactatttttattcagcatgtttctcctgatccccgttctggcgcttgccggatgcaacagccaatcttcaggaggaagcgaaaaagcgaaagacaaagaaacgcactctcacgaagacatgaatcactcaggttcatccgaggtgccgaaaggtttaaagaaggccgaaaatccgacttataaagtcggcagtgacgtcatgattttagcttctcatatgaaaggcatgaaaaatgcgcaaggaaccgtaaaaggtgcttatgatacaacggtttacagtgtatcttacactccggaaacgggaggaaagcgcgtcgaagatcacaaatgggtcattcaggaagagctgaagggcaccggtgatcaaacgttaaaaccgggtgacaaggccgtgatcgaggcatcccatatgaaaggcatgaagggtgccgaagccgttattgattcagccaaaaagacaaccgtttatatggtcgactatacaccgactgacggcggccaaaaagtaaccaatcataaatgggtgacagaagacgagcttgctgccgcaaaataaaaagaccgccaaagccgaaggaactcctttggcttttttgcggtctcacatttatgcggattttcttttcaaggcaggtctcgttaaagagaatacagctaaagcgacagcgataatgacaatcaaaccgccgcaccaggctgttgctgtgacagaaccggtttgtccgatcacgccgccgccgatggctgacccgagcgcgatgccgatctgcaaagcggacgtgttgaagctttgctgaatatcggaagactcaggcgcaattttgattaaatagctttgctgcgccggcgcaaggctccagctgagcaatccccagatcaccatcgcaggcaggaaaatgattaaagaaaccgttgtcagcggaagaataaacaggatcagagcgaaagaaacggtcacaagcatgatgcttttaaatgctcctaaacggtcatacagccagcctccgaacgggccgccgcataccgctgacagaccgaacaaaaagtagcatacactgacccaaacggaactcaaatgaagcgttctttccaaaaaaggcgcaaagtaggcatagagtgtgtaatgccccgccaatgtaaacaaggtgacaaggtgtgcgctggcaattttggcggtcccgatcgtcttgatctgctcacgaaacggaatcattttttcagcaggtattttttcaaaaaagacgctgataatcagcatggaaatgagagataatacgccgattcccaagaacagaacacgccaaccgaaggcattgctgatgataatgccgacaggcacgcctaaagcgattgcggagctgaaccccatgaaaatgatgccgatcgcccgcgctctgtattcaggcgccacgattttaggagcaatcgttaaagaaaggacgacaatcagccctgtgctcatggaagcgagcacccgtgacaccataagaacggcgaaattgggactgaaataagcgaccagattacttaggaagaaaataaacagtgcgattaaataaagccgctttcgttcagcctttgccgtcactgccaaaagcagcgggccggataccgcgtaaccgagcgcaaacacgctgatcagctgccccgcgctgacgatggatatatctaagtcggaagcgatttgcggaagaataccgcccacaattaattcaaccaatccgactgcgatggtagatgctgcaagcagaaatactttgaaattcatgtacagatactcctttttttattttttagaaaataaaaaatcctgattacaaaaagtgtacgggacaatttttgtaatcaggattttacggttcctggtagacaccctcaaaccatatcattgaggttatacaatgtatgcaatattcggctgtgtccgtttctgcaaaaaattctaccataatagtgagggagattccatagaaaattcgaggaaatcctttcaatttcaatatcggcggctgtaacgtcattgatgaagcagggaaaaaaatttatgataaccgtaaggagtctatacagatcaaacattatacagccggaggaaaccgatgaataagtacgaaaaaatcgccaacgaaatgagaaagaggattaaaagcagtgtatatgacatagatcagccgatcccggatgaaaagacgctcgctgcggagttcgggtgcagccggatgacgatgaagcgggcgcttgatacacttgcggctgaagggatgcttttcagaaaaagagggcacggcacatttatcatccaatcagccatgcaggatgagcacgttcacgtagtcagcaacgaaattctcggcttgagcaatttgttaaaaggcaaaaatatcaagagcaaggtcatccggtttgaagtgcagtttccgtctcaagatgtcgccgcacatttggccatcgatgaaaagactcccgtctattatgtagtgaggctcagaattgttgaaggcgaaccgtacgttcttgaaaaaacatacatgccggcgagccttatacccggcattaatgacgaggtgctcaaccattccatctacgatcatattacgcgggaactgcagctcaaaatcgcgggctcacacagaaaaatcagagcgtgcaagtcggatgacatggatcagcaatatctcggctgccggccggatgacccgatacttgaagtcgagcatgtaggctttttggacaacggcactccctttgaatattcattttcccgccaccgtcatgacaagtttgtcgtgacctcagtcaatataaaacgttcataaaagcgccgaagagtgagagaaaaactcactctttttttgttgccgctgatttacatcgtcgcttcttttatgttatattacccaatgatagaatcatcctacaaatttcagaggtgttttgatggagatatccaaaacaagcagactgtcgctcgtagaacaagtggtggcgcaaattgaatcgttaattcaatcggataaatggccggtcgggacgcgcattccccctgagctggatttaatgaagcaatttgatgtgagccgaaacacgttgcgtgaggccattcgggcgctcgtacatgccggcctgctgcagacaaggcaggggagcggtacgtatgtcagctcatccagtgttctcggcgcggcattttaccgccatattaaaaaatcaaatttgcttgaaacattagaagtcagatacgcactcgaaagagaagctgcacgattggcggcggaaaggcgtaatgacgaagacctgaaagcactgaaggcatgcttggatgaatgtgaagcggccttgcaaaatgaagatcgaaaacggtatgccgaagccgacattaagctgcacaaaacaattgtacaggcggcccataacaacatgctttctgatctatacgagcatatgacggaggcgctttgtgcgtcagtccataacctgttggaaatcacccctgctatccggatccacacccagcttgccgccgcgattatcggacagaaaccggatcaggccatggaggccgtcaaccaatacatcacagtatttaaagatacaatacacatggaggatgaacatgaaaattgaagacgaacatcaaattctgcaagcaagtcatcgtaaaaaactgatattgctggtcatcggagtcatattgataggggccaacctcagagcgcctttgacatcggtcgggccgctcgtttcctcaattcgggacagcctcggcatgaccaatgcggctgccggcaccattacgacagtgccgcttttggcctttgcatgtctgtcgccgtttgttcctttattgtcccggcgcttcgggaccgagattgtcttactgtcatcattaattgtcctgacagccggaactctgctgcgctccatcgccggaatcggcactctctttttcggaacgatcctgttgggattgtcgatcgccgtatgcaatgtcctgctgccgagtctcattaaacataagtttcccggaaatttaggcatcatgaccggcgtctactcggtttctatgaatctgtgcggtgcgattgcatccggcatcagcgtgccgatcgcctcttcagcggggttaggctggaaaggcgcgctcggctgctgggctatcctttcttttattgcgttcgtcatgtggattccgcaaatgcgaggacgtgaactgcccgtccgcacgactgggacaaacggagagaagaaaaacagtctgatgcggtctccgctggcttggaaggtgacgatgttcatggggctgcaatcccttattttttacaccgtcatcgcctggctgccggaaattcttcagcagaatggactcagctcaagtaaggcgggatggatgctttcattaatgcaattctcagtcctgcctattacttttatcgtgccgatcgctgccgctaaaatgaaaaatcagcgcgcactcgccggactgacggctttatttttccttatcggcattgccggcgttcttttcggaagcccggctctcactccgctatgggtcattttgatcggaattgcgggaggctgtgcgttcagtctggcgatgatgttcttcagcctgcggacccggcatgttcatgaagccgcggcgctttccggcatggcccagtcattcggatacctgcttgccgcgttcggaccgcttgtattcggtttgctgcatgacatcacgcacggctggacggttccgttattcatgctgatcgcagtctccgttctgattttcattttcggagtcggagcgggaaaagcggaacagatcaaaacagcataaaaaaacaaagggcccgtttagggtcctttgttttttgtttaaaaagctgtctcaggccgtcacgctgtcagttttaagccgatgacaccgatgaggataagccccagagacaccaattgtgacagattgaatttttctttaaaccaaagtatgcccacggccgaaacgccgatgcttcccatgccggtccaagccgcatacgcgacacctgtgggaagaacctgcatcgctccggaaaggcaaaagaatgaaagcataaagcctgttaccatgacaatcagcggccacttttttttaaaaccgtcaatatgtttcatggcaacggccgctacaacttcctccgctccggcaataaataacagcagccatgccattaatgttcaccccttgtttcagtttctttcgtaaataccttcattcctaaaatgccggacaacagcaaagccaaaaagaatatttgcccgattgaaaacgattcgcctaaaatgacgcccgttacatatgtgccgacggtgcctattccgacaaaaacggtatatgcggcagccatcggaatttttttataagagcggatcagcatcagaaagctgacggcaatcaaaaggaaaataccaatccaatcaaagagcgagtccgcatgcttcagggcggacgcccaaactacttctaacagtccggctatcaatacaagcagccaatacatgatacagtcacctcagttatgaatgaatgtcagtcatttttacggcggtcaaaaatgatcggtctccgccaatcatttctgcaagcttcttttgagaaagctgaatatttcttttttatatacttcgagatcgacatcctgttcacagccgatataaaaccgttcagccgcgttctcgacaacgttgataatcgttctggccgtccatctgacatgaatgccgctgatgacctcaccctgttcaatggccgtattgatcacgccttccagccaggaataataaggctgataaatggcttcccatttctccattgaatgatcgatggcaagaccggaataacagaggacgataatatctttatgaagccgggtgatgtgaaatgtctcatctaccaaaatgtccagcaacgtccaaaaatcttcagaaccgtccgttttcccttttattctgtccagcgtagtgtcgagcaggttttctgcaatcgcggatatcagtgcgtttttagaagaaaaatataaataaaacgtaccttgggccgttccggcttttttgacgatttctgaaatggatgctttgtctaatcctttttcagaaatgacttcaatcgcggcttgcaggatcttttcgtattttcccgagctttgttttgccaatagaggggttcctccttttatgaatgactgtcattcattttatcgcatattcgcttttttgtcaccccttaacataaaaataccggaaagaagaccatacttctttccggcattcgtcatttatcactgtcgatcatagccttcggcagacctgtatattttgcccagtaataaataccgagcgaaccgatggcgatcagaatcaggtcaagcggattgctgataatgcccaatccgtggccgaacgagccgagataggagaaaatcagcatcatgacataaaagccgacgatccaccatgctgatttcagctgctggcgtatgctgacatcatctttgggagcatatttactgaaacagagatagatcagaaacatgacaatttgagaaccgagaagccaggatacggtgcgccatccggaccaatatacaatataagaggtaaaaataaacgacagcggcccgatgatgctcatcccttttaaataaaacggtctgttaatgttcttcgcgttgactctcagcgccgcagaagaaatcggcgcaatcgcataagacagaatcaatgcgacggagcatacgttgacaagagcgttccaagaagggaacggaagcgtccaaaaaacagccagaccgaacgaaagccaaagggaggcgcgcggtgtcccggtttctttattgactttagaaaaaatgctgaataatgttccgtttctggcccaggcatagacgagacgtgaagtcgtattcataaagatatttccgttaccgcccggtgataaaatcgcatctaaaataaccaatgtcgccagccaccccaaaccgagcaaaacggcgatatctttgaacggaagggagaattcagtcccgatagccggccatccgtgcttcagggtatccgccgggatcgccccgataaaagtgagctgcagcacggtgtaaataatagtagaaacgataatacaaacaatcaatgcaatcggaatgttccgcttcggattctgcacttcactcgcgacagccacaatcggatgcagcccaaggtatgcaaacatgacgccgcctgtggaaatcgcggcctgaattccggtgaaaccaaaaggcgcgaatccgtgaacggtcatattgcccgggtgaaaatgaaaaatcagtacaacaattaccgtaatcggtacgacatatttaaaaatcgaaataatgaagtttgctttcgcaaaggttttgacactccagtaattgaggaggaagaacaggcaaagcagcgcaaattgcaatatccatccggcaattgtcggcgaatcagagccttttacggtcaaaccgggaaaccaatacgctacgtattggcggactgccgtgacttctattgaaataagactcgtgtatgccacaatggtgacaaaggaaattaaatatccgaccaggtgtccgtgtgaatatacgggataccggataattcccccggtccgcggcagcgcggcgcccagttccgcataaactaagccgatcaataagatgattcccccgccgatcagccaggaaaaaacgcctgacgggcccgctttagaggcgacgttactgacggcaaacagccatgccgaaccgaatatggctcccatgccgattaaaataagatcaaaaagtgacatagttttctggaagtttccttgcttagacattcgctgcctccttaaaaaagacattgttctctttacataattcccattatcattcaaacatacccagccggccggctggaaaattaggacaactttcgaaacgaagtatgtacagaaatgtgctcacatcaaaataacggccgtatggcaagatctcccggcttatattccccgttttgaacacattcaaacctcatattcagaaaaacaaaaaacgcccgaaacaggcgttttttgttacaagttcatatctttcagtccggggctgtgctcattcggaagctcgggaagttccgggacggggaaacctttaggaggctcggacacacttaattcgccgccgtttcggctcggcgtcgttccctgcagaatttctccgatccgtgtcggatccagtctgaaattaaattgggtattatgataacccatttcaacgaatttccggcattccgggtatttttcaatatcataattcggcacgggaaataatttgccccattcgacacccagtgtttccagcgcttttgtaaatgcattttgatgggcgttgtcacggacgatcagaaaaccgagtgtttctctgaacgtctgatttgaactcatttcataaatgcgcgtcttttgcagcacgccggttgattccagcacgacattgtccaatagatcggaaatcagattcccgtggttgtatacccaagacccgttccatggattgccgccggcgtctacaggaagagaactttgcgccccgatgataaaatggtgcggattggcgtgtttaactgcttcgtcaagcggcgcctgatctgctgcctgatttccggcgccctcagcgccgctttcatcgagcagcgcattaatcgtatgctggacgagctcaacgtgtgcgatctcttctaaaaatacaccgcgaagcaggtcacggaactgtttttcttttcctctgaaattagagctttggaaaaagtattgcatcatcgtccgcatttccccgtaatgcccgcctaaaatttcctgaagcaccttggccgcggccgggtccggcttgtccggtttaatgatattgatcagctcttctttgtaataatacataaacagcgccccctgaaagaagttttcggttcttctgttagtgtctttgcaaattcagtttttatgtatcggcatcaaaaaaaggacggaaagcgtgtccgtccttttgtgttaagcctcaaccgccccgcgaagtttcgtgttgacaagcccgttccatccttgatccatcgtactgtgaatctcggagcttttccgattgactttattgatgacggcttccggctctttccatccgccgtgaatgagagtgaattccgtatccccgctttccgtttcctttaagacaaaagaaacgatccagccttccgtatcccatgaaaaagaaaggcggtacggcgcttcaatatccagcagcttgcacggagacggaccgaacggagattccagctgaaactcactgtcttcttgaggtgtgaaatcattcggcataaaccagagagacaggccgtccgccgtagagaccgtatcccagacaacttgtatcggcgccttgaaaacggcggtatgaataatgtccggtaatggctgattgctgttgtttttgttatctttgttttgtttatcagacatgatgcgtaaccactctttcgctgtttttacttttgatcatactacacagggcaggacatttgaaaacaaatcaaacttattttatgcttttccaaagccattcaattcattttaaggagacgtagtgatgacagatcaatttaaagcgttagtagtcgatcaacatgaagaccggttttcagtcagcgtacgggagctggcggttcaggaccttcccgagggtgaagtgctgattaaggtttgctactcaggggtgaattataaagacagcttggctgccattcctgacggcaagatcgtaacctcgtatcctttcgtgccgggaattgatttagcgggaatcgtcgtttcttcagaggacgcccgttttaaagaaggggacaaagtcattgcgacaagctacggcataggcgtttcccattttggcggctatagcgggatggcccgcattccggcagattggatcgtgccgctgcctgaaggtctgacacttaaagaagccatgacgatcggaaccgccggcttcactgccgcattgtccgtccagcgtcttgaagaaaaccatgccgctcctgaaaaagggaaggtgctggtgacgggagcgacaggcggcgtcggaagctttgccgtctccattctttcaaccttaggttatgaggtcgaggccagtacgggaaaagaagaagaaagcggctatttgaagagcctcggagcaaagacggtcattcaccgtgacgaagtgtataacggcacgttaaaaccgatgcaaaaacaaaaatgggcagcggccgtcgatccggtcggaggtgagccgcttgcttcagttctcagtcagattcagtacggcggatcagttgctgtgagcggactgacagcgggaacgaaactcccggctacagtctttccgtttatattgcgcggcgtcagtctcttgggaattgattccgtattctgtccgatggagacaagaaagaaaatatggcagcgtttagctgatgacttcaagcctgcagatctggaggcctttattcaaaaggaaattacacttgaagagctgccggatacgcttcctgcccttttaaaaggagaagcgagagggagaacgattgttacaataaacaaagaataaaacaaaaacccccaatcagcagttgggggttttcaatatgtaatcaattattgattataataggggtaattcattgagtatgttatggaaataaattgatataaaacgaaaattgattatatataggtaatataaaggtgagttataaaatttcctgaaatatttattgactgaaagcgcttttaaaattatgataataacatgagtgccaataatatcattataacttcactacaaagtaactataaaataacaatatgacgagagggggagagcgaataatcactataaatgataacgctttcggaacattttcttcttatataactgttttggacggtcagaacttgtatgcagatgttagaggtgtaaatattgataactgaatattccgatattatctctgtgtaaaaactaggaggatttgaagatgaataaaaatagcagccagcattcatttttgagaaccatcattttagtatcgacattcggggggcttcttttcggctacgataccggtgtgattaatggggcgctgccgtttatggcggaagctgaccagcttaatcttaccgctttgactgaagggatggtggcgagctccctgctcttgggggctgcgatcggcgcggttttcggagggagattgtcggactataacggcagacgtaaaaatatccttatccttgccgttttgttctttgcagcgacgcttggatgtacactggcgcctaacgtatcggttatgatcatctcccgttttctgctggggcttgccgtcgggggagcatccgtaaccgtaccggcatatttggctgaaatgtcgccggcggaaagccgagggagaatggttacccaaaatgaattgatgattgtaacgggtcagctgcttgccttcacgtgtaatgctatcatcggcaatgtgcttggtgatacctctcacgcttggcgctatatgctcgttatcgcggcccttccggcggtattcttgtttttcggtatgctgaaagttcctgaaagtccgcgctggctggtttctaaaggaagaaaagaagatgctttgcacgttctccggcgaataaggaatgaagagaaagcgaagtctgagctcgctgagattgaatctgcctttcataaggaagctcagatggagcaggcgacctttaaggatcttgccgttccgtgggtgcgccgcattgtgtttatcgggatcggaattgcggtagtgcagcagctcaccggcgtgaattcaattatgtattatggaactcaaattttaaaagatgccggtttcgagacaaaagccgcattaatcggcaatatcgctaacggtgtgatttcagtgctcgcgacttttgtgggaatatggcttctcggcaaagtcggccgccgcccgatgcttatgacggggctgatcggaacgactgcggtgctgcttttgatcggagttctgtctgtcgtgctgaaaggatcgcctgctcttccttatgtggttctttcattaacagtcactttccttgcgtttcagcagggggctgtctctccggtgacctggctgatgctgtcggagatattcccgctgcgattgcgggggcttggtatgggggtcactgtcttctgcctctggatcgtgaacttcattgttggtttaacttttccgatcctgctcgcaaacatcggattgtctgcaaccttcttcatttttgtcctgttagggatagcgtccgttatatttgtgaaaaggttccttccggaaacgaaaggtctgtcgctcgaacagcttgaacaaaacttccgtgcctatgaaaaaacagatcgtaatagcgcagaagccgaggtgagcggataatctgaatagacgcggggttcctgggaatcctgctttttatttattatatagaagggaataataagcgggaaaaaaagtttcataaaagtgttgacctaatttaaagtgcgtggtatattattaaacgtcgctgatgaactaagcgataacgacaaatgagaaaatgatcttttgaaaaaagactttacaaattctcaaaagcgtgtataataaatgaagtcgagaaaaaagacttcgaaaagaaatgaaaaaacacttgacatcataactgattggtagtatgatagttaagtcgtctgataagcgcccgtagctcaattggatagagcgtttgactacggatcaaaaggttaggggttcgactcctctcgggcgcgccaattcaaatgcgggtgtagtttagtggtaaaacctcagccttccaagctgatgtcgtgagttcgattctcatcacccgctccatcataatgatctttgaaaactaaacaagacaaaacgtacctgttaattcaaagttttaaataaatcgcacagcgatgtgcgtagtcagtcaaactaaggtctgcacgatgcagatcacacagacgttactgcaggatgcagtgaacttagtctgtgatccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggatcattccttcaaaacataggaacacctgctaaatgcgccacttcctgtggcaacgcatgtgttagcatgtcctatgcgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacatagggtatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatgggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagcttttctaaaattttatcatcgcggggtggagcagttcggtagctcgtcgggctcataacccgaaggtcgcaggttcaaatcctgcccccgcaaccaaaaattaaatggtccggtagttcagttggttagaatgcctgcctgtcacgcaggaggtcgcgggttcgagtcccgtccggaccgccatttttattgtaaacgaaacgatcatgttttcgttttttttgtgttttcttttaatgctggcagcttggtatctaaccaagctttcttttatatcgttaaagtcttggatattgaaacataatccgatacactagaaagagctgtatttcacaagagcgtcagaaagggagacgggagatatatggatgagtttgagttgattcacagtattacgccgcattcgcattatcatccttccgtcgatgtagggatcggtgatgatggtgcggtttatacagcgtcaccccatatgcagcaaattgtctgccttgatacaatggtggagaatgtccattttaaattagagtattcctctcctcatgatatcggttataaggcgcttgctgttaacattagtgacgttgcggcgatgggaggcattccgaagttttatttggtgtctctagcggttccttcttgctggcagaaagctgacgtccaggcaatgtatgaagggatggcggaactggcgaaactataccaaatggatttgatcgggggagataccgtctccgcttccggtcaagccgtaattaccgttactgtcatcggtgaagttgagaaggattgcgcttgtctgcgaagctcggcaagacccggagatgttgtgtttgttacgggggatatcggctcgtccgcagcaggactgtctcttttgttgggagaaacacttccttctgcttttcacacgagtgattattttatccgaaaacataaacggcccgttccgagagttcaagtcggccgcttctgctctcagcttcagcgcgcggctctgaatgatatcagtgacggattggccagtgagctgcatgaaatagctgcggcaagttcagttacgatagaaattgaagaacaacttctgccggtgcatccggatttgcctgaggcagattccgagtggaagaaatgggtgttattcggcggtgaagattttgaattggttggaacggtttctcagcaagagtggatttctctgcttgattactgcactcaatcgggcattccgattgcgaagataggagcggtatctgaacggaaggaagcatgtgttcttttgacagccaatgatcagagacaaatcgtccttgagaaaaaaggatacaatcattttaaataagacgggtgactcactttgaagacattacaatggagaacgaaaaaccccgaagaaacgaaagccgtagccaagcttgccgcttctttggcaaagccgggagacattttgacactggaaggcgacttaggcgcgggaaaaacgacttttacaaagggttttgccgaaggactgggaatcacgagagtggtaaacagcccgacttttacaattataaaagaataccatgacggttcgattcctctatatcatatggatgtgtatcgtatggaggatgaaagcgaagacttagggcttgaagaatattttgagggacaaggcgtctgtttaattgaatgggctcatttaattcaggatcagctgcctgctgaacggctgcagatcgtcatcaagagagccggtgatgaggcaagggacattacctttacggctttcggaatacggtatgaaacgctttgtgaggagataaataaacatgacaatactggcaattgatacgtcaaattacacgctgggtgccgcgctcgttcgtgacaaaacggtgatggcggagtatattacatatttaaaaaagaatcattccgtgcgggcgatgcctgctgtcaattcattgctgaaggattgcggcctaacaccgcaggaccttacgaaaatagcggtggcgaaaggacctggatcgtacacaggtgtcagaatcggtgtgacgctggcaaaaacattggcatggtcgctgaagcttccggtttccgctgtctcgagcctggaggtggtggcggctaacggacggcactttcaaggactgatctgcccgttatttgatgcccggcgcggacaggtatatacgggactttatgaatatcaggacggccgattacaatccgttcttcctgatcagaatgtccttttgactgattggctcggcatgctgaaagaaaaagcgtctccggttttatttttaggacacgatacagccattcatgaagaaaccattctgcatgaattgacatctcaagcagtgataggaacggctgcacagcataatccgcggccgtcagagctggcgtttttaggcttggaaaaagaagaaacggatgtccacagccttgttccggattatttgcgtctggcagaggctgaagcgaaatggatggaatctcaaaaatagggtgatagggatgaaaacgaaaacggcgattcgaagcatgcggccggaagatattgatcaaatttatgaaattgaaacagcatcctttacttctccgtggacgaaggattcattttatcatgagcttttggaaaatccgtatgcccactaccttgtcattgaaaaggacggctgtctggcggggtattgcggaatctggattattatagatgacgcgcagattacgaacatagccattaagccggaatatcggggccaatcgttgggagaagcgctgtttcgctctgcgatagaattgtgcagagaaaaaaaggcaagaaggctctctctcgaagtcagggtctcaaatcatcccgcccaatccttatataagaaattcggtcttcaggccggaggaatcagaaaacaatactatacagataacggggaagacgcgttattaatgtgggtgacattacatgagtgaaaaacaagatatttatgtattaggaatcgaaacaagctgtgatgaaactgcggcctcagtcgtgaaaaacggaaaagacatcatttcaaacgttgtcgcttctcaaattgaaagtcataaacgtttcggcggagtcgtgcctgaaatagcgtccagacatcatgtggagcagattacccttgtgattgaggaagctctttcaaaggcggagatgggctttgatgatcttgatgcgattgccgtaacggaaggacccggacttgtcggagccctgttaatcggggtcaatgcggcaaaggcgttaagctttgcccatcaaataccgttagtcggcgtccatcacattgcgggccatatctatgcaaacaggctgataggagagcttcagttcccggcgcttgctttggttgtgtcaggcggacatacggaattggtttatatgaaagagcacggttcattcgaggttatcggtgaaacgctggatgatgccgcaggcgaagcttacgacaaagtggcaagaacgatggggcttccctatccgggagggccgcagattgataagctggctgctgtgggaacggattccattccgcttccgcgtgcgtggctggaagaagggtcttacaatttcagcttcagcggcctgaaatcagccgtgattaacacgcttcataacgcctcgcaaaaaaatgaggtgattcctccggaggatcttgccgcaagctttcagcagagtgtcattgatgtactgacggcaaaaacctctaaggccgcgaaagaatatggggttaaacaagtgctgcttgcaggaggcgtagccgctaacaaagggctgagagccgcactgcaacaggaattcagccattcgggagatcccgagcttatcatcccgccgctttctttatgcacggacaatgcagcgatgattgcggctgccggaaccgttgcttttgaaaaggggatccggggctcatatgatatgaacggacagcccggtttggaattaacatcctttgatcgtctcacgttgtaaaacgtgaggctttttttacttattaacagataattctaacatatccacaggattgtgaatatattcagaaatccagtctggataagggactgaaagttgttagtaaagtggataaagtcagaaaattttgtggatagtgtgtataaaacgcttacttaaatggctgacaaggaggatagctgtggataaaaaagcaccccttaaagaggtgcttgactttttctattcttctgaggagagttcctcccattctgctaataagttttcgagctcttgattcagggcttcattctccgcgtgaatggtctgtactttttcatgatcctgatacacgtcagggtcgcacagcagctcctcattggcactgattttctcttcggcggatgagacggccgcttcgatttcttcaatgcgtctcaggcgctgccgttctttcttcttccattctttttcttcctcgtaagttcttttcgtatcctgtttgaccttgccggcaggctgagcctgctctttttcctgccgtttcatttcttccagttccagctgctgggcttttttctcggtgtaatagtcatagtcacccaaatattcttctgcatgatcaggtgacagctccagcactcttgtggcgatcctgttaataaagtagcggtcatgcgatacaaataacagtgttcccgggtagtcgatcagggcgttttccagcacctctttactatccaggtcaaggtggtttgtcggctcatcaaggatgagaaagtttgctttttgaagcatcagcttggcaagcgcgactcttgctttctccccgccgcttaacgaacggaccggtttcaggacatcgtctccgctgaacagaaagttgccgaggcatgttctgatttctttttccggcatgtccggatattcatcccacagctcgtccagcacgcgtttggacgatgtcagttcagcctgctcctggtcgtaatagccgattgtgacattggaaccgtacgtgatcgacccggattccggactgatcgtgttcataatcgttttcagcaaggttgatttgccgattccgttcggtccgacgagggcggcgctttcgcctcttgtaatgccgaaggtcaggtttttcaagagcggcggctggccgtcatagctgatggaaacatcctgtacgcgcaggacgtcgtttccgctctgttttgtaatgtcaaaacggaaggcggcggatttctcatccccgagcggcttggccatgacgtccatccgttcaagctgttttcgtctgctttgggctcttttcgttgtagaagctctggccagattgcggtcgacaaaatcttgaagcttggcgatttcgtcctgctgtttttcatacagcttcaggtctttctcatactgctcggctttttgttctaaataggcgctgtagttgccgaggtattttttgctttctgtccgggagacctcgtacacttggctgacgactttatcaagaaagtatctgtcgtgggaaacgatcaggattgcgcctgaatatccctgtaaataatgctcaagccatgtaagcgtatcgatgtcgagatggttcgtcggttcatccagaataagcagatcaggctgggtcagcagcagttttccgagcgcaagccttgttttctgaccgccgctcaggctttgcactttcacggaatcgtcaaattttccgaagccgagtccgtgaaggatagatcggacgtccgcttcatattgatagccgcctttatccttgaaatcctgctgaagcctgtcataggttttcatcagcgtctcaagctccgccggggcggccgtggccatcttttcttcaatagagcgcatctctttttccattgctttcaggaaatcaaaaacgctcagcagttcttcttttatggtaagctgggattccaagccagtgtgctgggcaagatatcccatcgttaattctttcggtttgattaattcacccttttcatatgaaaggtgacctgcgataattttaaggagagttgatttgccggctccgtttctgcctactatggcgatgcgatcccgagatctgacttcaagctttatattgtttaaaataggatcagcgccaaaagatttggatagctgattaatttgtaagatcatcatattatttcacctctgttataataagttaagtgtagcttatcaacctgctgtcagcaaacaatacattagaattggaacattataggataagacatcagggagaaaatagtgtatgatcagaagtaaggagagtttaaatatgaatggattttctcattttaatgaagaaggccgtgcccgcatggtggatataagcgataaatcttcaacagtccgtactgccgctgcgatatccagcgtacacatgaagcatgacgtgtacagcagaatcaaaaaccgcgagatcggaaaaggtgacgtgctggctgtcgcacaggtggcaggaattatggccgcaaagcagacgtcagcgattattccgatgtgccacccgctttctttaagcagcgtcgacatttcattcggctgggaggaaaaggattccgaagccgttcttcatatacaggcaagcgtaaaaacgaaagggagtacaggtgtggaaatggaagcgctaacttccgcttcagtctgcgctttgaccgtgtatgacatgtgcaaggcgctggataaaggaatggtcatcggcccgacctgcctcatggaaaaaacaggaggcaaaaacggtgattttaaaagagatgcatctgagtataaagtggaggaccaatcatgaacaaggatcaatcaaaaattccacaggcgacggcaaaacggctgccgctttattatcgctttttaaagaatttacacgcctcaggaaagcagcgcgtttcatcagctgaactgagcgacgcggtaaaagtcgattcggccacgatccgccgggatttttcctatttcggggcgctcggcaaaaaaggatacggctataatgtggattacctgctgtcatttttcagaaaaacactggatcaggatgaaacgacgaacgtcattttgatcggtgtcgggaatttagggacggcgtttcttcactataatttcacaaaaaataataacacaaaaatatctatggcttttgatgtgaatcagagtaaaataggaactgaggtaggcggtgtgcctgtctttgatcttaatgatttagagcttcacataaaggatgaacccgtggcgattcttaccgttccggcggttgccgcccagtcaatcaccgaccggctcgtggcgctcggaatcaagggaatccttaactttacgccggcccgtttgaatgtgccggatcacattcgaattcatcatatagatttagctgtagagcttcaatcattggtttatttcttaaagcattattctgttttggaagaaattgaatagcgaaaggaggagctgcacatgatcggtcctggaagcctggcggttatcggtgtggtggcggtgattattttcggtccgaagaagcttcccgaattaggaaaagcggcgggggacacgcttcgtgaatttaagaacgctactaagggattagccggtgaagaagaggaaaaaaagaaagaagaacagtaagataggatgacgcgtatgagagtgaatcaaatgacgcttgtggagcatattgccgaacttcggaaacgattgctgattgtggcgttatcctttacggttttctttattgccggcttttttctggcaaaacctatcattgtgtatcttcaaaaagccgatgaagtaaaagagctcacccttaatgcttttaacctgacggatccgctgtttatctttttgcagttcgcgtttatcatcggcatcattttgacttcgccgattattctctatcagatttgggcgtttgtcagcccgggtctgtatgagaaggagcgcaaagtaacactcagctatattccgatttcgatcgtgctgtttgtcggcggtgtgtcgttttcttattatattttatttccgctggtcgttgattttatgaagcgggtctcgaatgacctggatgtcaaccaggtgatcgggatcaccgaatactttcattttctgctgcagctgacgattccgttcgggctgctgtttcagatgccggtgctgatcatgtttttaacgagactcggtgttatcactccgatgtttttatcgaagatcaggaagtacgcatattttgtgctgctcgtgatcgccgcgatgattgcgccgcctgagctgctgtctcacttgatgattaccattccgctttgcattttatacgagatcagtatcctgatttcaaaagcggcgtatcggaaaaggcagaccggcagtgaatctgaccaggacgtatcagcataaaaaaagccatttctcaatgatgagaaatggcttttcttttattatttttgatttttcttcactttaaatgagaaggcgaacattttaaacgagatgctgatattataagcggcgaaaaccatcagcagtatggaataaaaagaccacatgcttcccggagagcttgcggccaaatacgtaaagatacagccgactgcgaaataaatcaagccccaagtcattgggttcctcatacaaacaatcctccaataattaattgcatttgctcactatgctgttcaatatatttttgggcggggccgagctgcatgaccacgacaatggtattcatcatgacatgggcgaatatcggcacaataatccgtttcgtctgcacatacaagaacgcaaaggtaaagcccatggccgtatacagcagcaggtgcgtgaggtcttgatgcacaatgccgaaaatgacggaactgatcagtccggcgataaagaaattcgttttttcatataatacaccgaagatgatcttccggaaaatgatttcttcaagaatcggcccgacgatagaagaaacgataatcatgagcggcatggctttaataatgttgagaatggctttcgtgttttcggaaccgctgtccacgtgaaagacatactgctcaatcatcccggcgattccctgagaaaataaagcgagccatattcccgcgaccgcccagagaacggacatgccggcggatgctttcttcccgtttcttaatgtctgcttcggcgcggttctcaaaatcaagagaacgataatcaggcagataaaaaagcttacgacggaataaatcccctgagccatggtgagattcgcattcgtagggtgcccgcccgcatagccgaatttgtacattaaaggaatgccgatcaatgcggaaagctgcatgataacatatgtcaaaatgatataccaatactgttttctcaaatgatatgtactcctttatcctataaaatcaacttatttgttcttattgtaacacaagtgaacttgccgtgaaaaaaggagaaaatcagtgtgagagagaatcatgtaagcgtgaaaattttttattcttatgacttgaaattggaagtgagattctttattataataactgtgttagcactctttagagctgagtgctaaaattacatattcatactattgaggaggttattacattgttaaagccattaggtgatcgcgttgtcattgaactcgtagaatctgaagaaaaaactgccagcggaatcgtattaccggattctgcaaaagaaaagccgcaagaaggcaaaatcgtggcagccggttcaggtcgcgtgttggaaagcggagagcgcgttgctttagaagtaaaagagggcgaccgcattatcttctcaaaatacgccggtactgaagtgaaatacgaaggtactgaatacttaatcttacgtgaaagcgacattttagctgtaatcggctaagcaaataaatatttttaaaaattcgaggaggtttcgttaacatggcaaaagatattaagtttagtgaagaagcacgccgcgctatgcttcgcggtgtcgatgcgcttgctgacgctgtaaaagtaactttagggccaaaaggacgcaacgtggttctggagaaaaaattcggttctccattaattacaaatgacggtgtgacaatcgcaaaagaaattgaacttgaagacgcgtttgaaaacatgggtgcgaagcttgtagctgaagtagccagcaaaacaaacgacgttgccggtgacggtacaacaactgcaactgttcttgcgcaggctatgatccgtgaaggcctgaaaaacgtaactgcgggggctaaccctgtcggcgtacgtaaaggtatggaacaagccgtaactgtagcaatcgaaaacttaaaagaaatttctaagccgatcgaaggcaaagagtctatcgctcaggttgctgcgatctctgctgctgatgaggaagtcggaagccttatcgctgaagcaatggagcgcgtaggaaacgacggcgtcatcacaatcgaagagtctaaaggcttcacaactgagcttgaagttgtggaaggtatgcaattcgaccgcggatatgcatctccttacatggtaactgactctgataagatggaagcggttcttgacaatccttacatcttaatcacagacaaaaaaatcacaaacattcaagaaatccttcctgtgcttgagcaagttgtacagcaaggcaaaccgttgcttctgatcgctgaagatgttgaaggtgaagctcttgctacactcgttgtcaacaaacttcgcggcacattcaacgctgttgccgttaaagctcctggcttcggtgaccgccgtaaagcaatgcttgaagacatctctgttcttacaggcggagaagtaatcacagaagacttaggccttgacctgaaatctactgaaatcggacaattgggacgcgcttctaaagttgtggtaacgaaagaaaacacaacaatcgtagaaggcgccggcgacactgaaaaaatcgctgcacgcgtcaaccaaatccgcgctcaagtggaagaaacaacttctgaattcgacagagaaaaattacaagagcgtcttgcgaaacttgccggcggcgtagctgtcatcaaagtcggcgctgcgactgaaactgagctgaaagagcgtaaacttcgcatcgaagacgccctcaactcaactcgcgcagctgttgaagaaggcatcgtatccggcggtggtacagcgcttgtcaacgtatacaacaaagtcgctgcagtggaagctgaaggcgatgcgcaaacaggtatcaacatcgtgcttcgcgcgcttgaagagccgatccgtcaaatcgcacacaatgcaggtcttgaaggatctgtcatcgttgagcgcctgaaaaacgaaaaaatcggcgtaggcttcaacgctgcaaccggcgaatgggtaaacatgatcgaaaaaggtatcgttgacccgacaaaagtgacacgttctgcacttcaaaacgcagcttctgtagcagcaatgctcctgacaactgaagccgttgtcgctgacaaaccggaagaaaacgccggcggcgcaggaatgcctgacatgggcggcatgggcggtatgggcggaatgatgtaaaccgacaaaaaacccttgatttacaagggtttgtcggcaacggacgtcatttttaatgccctcttgatgccatttaacttttcgaggcttctcatgagttcaccgaacttgtgagaagcttctttttttctgtcttgcgggctttcgattaaattatgtaatcgattaaagcttcaaattcaaaacaaaaaacatagcatgttcatcaatgaaatattaacagccgctttttctatagcttaatattatatttgtctataattttttgcatgtactcttctacgtctggtttattttctgggtgtcgttctagatattgatcaacaattttatttaaatatttatagaaattttcgtaatctaaaattacttcttcatcttctttgactgctgggtagtcgaaataaaaagcaataccttcatctccaaagtaatcatcttcccactcttcgtagtcatcagcaaatacacaccagacattctctataccataaccttccccgttggagaatttctctaaaattcgtaaaaaacgttcatcacccatcacctgaaaaaagtagttaattaaatctttacttttattatccatttcattttcactccgaattatttaatcatttaaagttgggaaaaaatttgttatttctccagttgcttcatcaatataaccttcaaacttgagaccgtttttagcgtatccagttacttttctcccgactacttctccatttctcattgcttcttctccccactgcaacatttgttcgtttgagatcttctcgggatcataaactgtctttggagtacgaactttttttagttctccaggtttgatatttccctctctatctaatgcaggtaatccatattcaatttcatagataccatcaattgtggggtgttccctttttgaaattatacaactctttaaatcccaacctttatcaataaatgccttctcaaaactctgtagattgtgaccgccgacaatacctttatttttctttctgactatatcttctacctcaactaaatgggtatcatatccttgcctaaaagtaacatttattttggaaaaagcattatttttttcttcttcaattatactttttaacaatggtgtgtttttaacattgtgagtattctcaatatcttgtgcaattcctacaagtgcaggttcatatctgtttttaaaaaagggattaaaaaaattgttgccttttgtaattcctttatttacatgagcagcagctgttccgctctcaaccactttacctactttagaaagcttggcagtggtttgcactgcggcacctgcaccttttggaccaacgatattaccgaccgcataactgatataatgtgctcttgtgtatgcatcgccatttatcattttatcattccatgaatcgacgatgtttttccaaattattttagggtaggaggggacacttaagactgttgtaatcgtttttgtaagttttagttcaatagggagttgtgaaaattcccatgcgcccacaaccaagtccttgatgccatatatcgtatcatcaatcgcatcgttaagcccatcattaaccccatcgatgatatccaatgccgttttacctgcgttgattacactttcaccgacagccttcagctgttttgcttgttcaagctgtaccacatactgaagctgttcaggggtaagactctcatacccgaccttcttggcaatttctaagtaatcatccgggtccgtcactccgtcagccagtttcttctttaattctttgatttctcgttcttttgcttcatctttcttgatcttcagataagctttagtctgtttctcgatatctcctttcttcttatgtatgtcactttctcgataagcattggcattgtagtgaatgggtgtagcattcttgcccttgcctgtagattcctcaagcttttggaagtctttcttgatgaattgctcgattggctctgactgggcatattcagtaacaagtgcttcgtccacgcttcctaatttatcgactgtttttttacgtttgtcctctgcatctgcaagttcgtctttgaagtcttctgtcgagaacaaatcaagcggaagaatatcattgatatcaagtaggatatctttcattgctttcttctgttcagacataatggattttgacttggtgtaggcattagccagttcgtgttccaggaaggattcttctatgtatgcgccagacaagctggcgtcctctaaagcgcctgaaatgcttgttaaaaaagcaatcttcatatcaattagatcaatccaattgtcagccacaccagcgtgatcatgataaaatgctttgatgttgtcagcgccttttccggaaaactcactgtcatctaaatcagctacggctttgaaggcttttttaagattgaccatctggcttcttaattctttgtattcttttgcacgtttatctgcttctgaaagcagtgttttggcttcaaatactttcatattcatatcctttcatttaaatagatcaacaagattttaccatgggaaaatgaagaaacagacgaaatgtgatacaaaagtgtgaaatgatcaatttgatctgtgttattttacctatatgaatcactttttgggagactggcaatgtcgttagacggttccagttggatgtaaagctgacggctttgatgaatctaagaaaaagcgaaaattgaagaagcgctattaatgaaaaggatccatcttttattaggatctcagagtcgagaaaatttctataccctgtttgcttacatttggtggtgtaattcttaaaaagtacataaaagatgttgacggagtatttttgaagtgataagattcaatggcaatgaaaatcagtaattttaaagaattactttttgaagagggcgggatatgcgacttgaagagattgtgacggttaaaatagggagaaatctttctagaggacacgaaaaaaatgatccgacattagttgcttatacatatgaggatttaataaatgatttagatggctcgtttctagactcacaagttagtcttggtgctgaacagtcaaatcataaagaaagctatttgagcagtgccggggatgttgttttcagctttgtcagttccaaggctgggatcgtgagtaacttacatcacggaaaggtgataaaccaaaactttgcgaaactcatgattgaacacaatgatttggatagtcgatatttatgttatgcattaaatgagtcgcacacaatgaaaaagcaaatggcgatttccatgcaaggaagtactgtgccaaaattgactccagcgatattaaaagaattggagattgaattaccaagtattgagaaacaacggatgattggaaatgcttatttctgtttgagaaagcgtcaagctttggcgaagaaacaagcggaacttgaagagcaactttatttagaggcattgaagagattagaccaacaatagaaaaagtgaggaacacaactatggctgaattacactcaaatttatttagtgccgcagacagcttgcgaagcaaaatggatgcatcagaatataaaaactacttattaggattgatcttttacaaatacttatctgataagttattagaaaaagtcgttgaaatcgcagatgaatctttagaagaatacaacacacaagaaaaacaaacgcaattgtaccggagtttattagcggatgaagagatcaaaaatgatttgatcgagacgttagtcgatacattaggttatgatattgcgccaaagcatttattcaatgtattagccaatcaagcgaaacaaaatacgtttcagctgaatgacttgaataaagcatttatcgatttgtctacgaaatatgaccaattcaacggtctgtttgatgatgtggatttgacctcaaaaaaactgggatcagatgatcaacaacgaaacattacgataacggaagtactgaaagaattaaatgctgtcaatgtaatcagtcatgatggagatgtgattggggatgcttacgagtacttaattggccaatttgcttccgaagccggtaagaaagcgggagagttttacacgcctcaccaagtatctgacatgatggcgcgtattgccgcaatcggtcaagaagacaaaaaattgtttagcgtatttgaccccacgatgggttctggttctttaatgttgaatatccgaaactacattcattatccagacagtataaaatatcatgggcaagagctaaacacaacgacctttaacctagcgaaaatgaacttaatcttgcatggtgtgaataaagaagatatgcggttacgcaatggggatacattgaacaaagattggccgacagatgagccatatacctttgattctgttcttatgaatccgccttactctgcaaaatggtctgcagatgctacattcctagatgattcgcgtttcaatcgttacggaaagttagcgccaaaatcaaaagcagactttgcttttcttttacatgggttctaccatttgaaagattcgggaacaatggccatcgtcttaccgcatggagtattattccgtggagcggcagaaggtgtaatccgtaagaaactattggaagatggcagcattgatgccgtaatcggcatgccggcaaacttattctttggcacatcgatcccaacaacagtcatcatcttgaagaaaaatcgcagcactcgtgatgtgttatttattgatgcaagtaaagagtttataaaaggaaagaaccaaaataaactttctaaagaacatattgataggattgtcgaaacgtataagaagcgagaagacgttgagaaatatgcccacgttgcaacattcgaggaaatcaaagagaatgatttcaatttgaacatccctcgatatgtcgatacgtttgaagaagaagaacctgtggatatggctgcaattggctcgaaaatcaaagatattcgaaaagaaaaagcggaactagaagctagcttgtatgacatggtttcttcattgcaatatgatgaagaaaatgcagaatgggtcaaaggtgcgttagaggtgtttcatcgtgggaaataaacgagtgccagaagtgagatttgaaggatttagtggagaatgggaagagcgtaagttgggggatttcactgaatcttattcgggtggaacaccgagtgcaggaaataaattatattatggtggaagcattccttttatcaggtcagcagagattaattcaaaaagcactgaactgttcataacggaagatggattaaataactcatcagctaaaatggtggaaagaggtgatatcctgtatgctttgtatggtgcaactagcggagaagttggtatagcaaaaatacatggtgctattaatcaagcaatattagcaataaaacctaagttcgatgatgattcatactttattatgcaatggcttaagaaacaaaaaagtacaattattaatacctacttgcaaggcggacagggaaatttatcaggctctatagtaaaagatttaattataccattacctaccaataaagatgaacaagtgaagctaggagattttttcaaaaaaatagacgacacgatcgctcttcatcagcaagaactaaccaccctcaaacaaacaaaacagggattcttgcaaaaaatgtttccaaaagaaggggagtctgtgccggaggttcggttccctgggtttgatggagagtgggaagagcacaagttagattcaattgtggatagagtaaaatcatattctttatctcgtgatgtcgagacgactgaatatacaggatacaaatatatacattatggtgacatccatacaaaagttgccgatataatagatgagtttagcgatttgccaaatattaaagctggaaactatgaacttctgaaaaaaggagatttagtattagctgatgcttcagaagattaccaaggaatagccgcacctgcagtaattactatagatgtgccatacaaattagtttctggacttcatacgatagctttgagaccgaagcaaatagattctttgtttctttactatttgattaactcccaaacttttaggaagtatggttataaggctggaacaggaatgaaggtatttggaattagcgcaacaaaccttttaaggttcgaaagtttgttcccaacatttgaagaacaaaccaaaatcggcaacttcttcaaacaactagacgacacgatcgcccttcaccaacgcgaattagatgccttaaaagtaacgaaaaaagctttcctacaaaagatgtttgtttaacgaataaagagggggagaatcatggcaacgatccagcataaagatgaagcagaggtagagcgccgcctgattgaagtgttaggtgaagggtataatcagtggaattatcgtccagatttaaaatcggaagaagacctatgggagaacttgcgtcaaaaaatcacgcaaaacaacctatcagaaattggggaacatcccatgactgataaagaatttgacaagataaagacagagttattatcgaaaacacagactccctttgatgcagctaagtggctcaaaggggaaaatggaatagctcgaattacgattgaacgtgaagatgtctctttaggttcgatgtctctggtgctatattccaatcaagacattggcggaggaatttctacatacgaagtcgttcaccagatagcgaaacaaaaagcaaacgttgacggtcgagatcggcgatttgacgtgacacttctcattaatggattgcccattgttcaaattgagttaaaacaggccagtgcaaaagacggcgtattccaagcctatcatcaaattaagaaatacgcagaagaaggaatgtttcgaaacaatatcttttctaccctgcagttatttgtcatttccaacgaacaaacgactcgctattttgccaatgcgcttccaaaagatatgcataagaaattgatctttagctggcggacaacggataatcgaaaagtagaaaatctctatgaatttgtgaaacaagtgttaaacattccagatgcacaccgtttaattgccaattatacaattgtgagtgaagaccaagacaacaaagctctagtggtgttaaaaccgtatcaaattcatgccatagaagccttgtttacatccgccatgaggcatcaatccggctttgtttggcatgcgaccggatcaggaaaaacgttgacaagttttgtgtctaccaagttattggctcgcaaaccaggtgtagaccgtaccattatgctgattgaccgaaaagacttagataatcaaacgacgacagaattcaccaaatttgcttccgagtttaataccggtatttcttctggtgatgcaatatcgaatagcttgattgtcggaactggaagtgccaaggagttaagtgatactctactgtctgatgccaattccaatacagttattattaccactcgtcaaaaactagaagctgccttgcgctatgcccaaaggcaagaggagcaaaaaggcactcagcgctttaagaaactgctggggcagcatattgtctttgtcgtggatgaatgccatcgtgcgttaagtgcagaaggcatggaggtcattaaggggttctttccaaattcaacttggttcggatttacagggacaccgatatttaatgaaaataaaaaacaagcgaagggccgattagctcgcactactcgtgaccaatatggagacgttttgcacacctataccattaagaatgcgttagacgatggtgctgttttagggtttcaagtagagcatgaagatacaattgaccccacttcattaaataatcatattttcgaactgctgcgtcatcaagaaaaatacgccaattgtagtgatgatgaaatcaacgatatgattgatcaaatggatggaatcgaaaaagaagcatatcttgaaccatcttcgttccagaatgatgaacatattcaaaaagttattcataagatttttaggccggataatgcctatattaaatttgattttcaaaacggccgcccgcaaaaatcagctattttaacaacgagttccattgatatggcgaaacgttactatcaggcaattaaagaaatgacgaaagatccagattggttaacaaaagagtttgcgggacacccgatccgaatagggcgtacaattgaagatcctgattttcctcggattgcaattacgtattcaatgcaagaaaacgaggaagattccaagcaaactcacgatgaaatgatggagatcatcaaagattataacgattactatcatactgcctggtcgatagaagatattgaacggtataacggcgatattaacaatcggttagctcgtaaaaaaggggaattcaaagaaattgggaaacaaattgaccttgtcattgttgtcgatcgattattgactggttttgatgccccaacgattcaaacgttatttgtggatcggaatttaagttatgccaatttgattcaagcattttctaggaccaatcgtacttatccaggaaagacaaaaggattgattgtgacattccgtaaaccttttacaatggaacaaaacgtaaagaatgcgacgaagttatattctcatgcacaagaggaatctagtcttgtttatccaacgtatgatgaatcgaagaaacgttttaagaaggcccacaaagtcctaactacgttaattcccaatccaatcgatattgatgagcacacatctcttgaaacccgaattgagttcgtaaaagcatttcaagagctaaacaattcttacgaagcgttagttacatatgatgactacaacgatgatatggagaaatcagcagcacttcaagaacaggtgaaaacactagaagaatatattggtatctataacacgattaaaggttcacttatagatgaagagcgtcaagatggaccggagctggacttttcggacattgaattctatggagaaaacgcagtgaagatctatgatattgattcaacgtatattgatcgactattagaaacatactcggccaataaccagaatatccgtgatgagatcgaaagcgcacttcaaaaactggagaaatcagacactgttaaagatgtataccgtgagatgttaaatgccattgatacgaaaaacgtagatgaagaggaagatattcttgtcgtgaaacgaagctttttcacgaaagcacgagacaaagcaattcatgaatttgcaaatacttggtttgtggaagaagatgaactgcatttatctgcagttcaatatgtgataggggcagatcctattccgaatatcgggggaatcatcaatagcaagcaatttgatcggtacaaagccgtacatccagatgcaaaaccattgaaatacggaccagagttgaagcgtcagtggagaaaaacgttagatgaagtcattgtacctttggatggcgagctgagataaagtctatataggccaactactgcgaatcttgagttggcctattctatttattatgaagaaatatcatgagattgctgacagaacgactatgcgtactagtcgttttctttaatcatcttttccagctgttccacctcaccccgaatcccaatcccaggctcccacgaatcaatcagacgaatggctttctgattcgattccatcgctttcgttttctctccttttcggtacaacagctgtgccattccgtaataatagtagatcagttcaacctgattggcgttgtgtttgtcatagagcatttgttcaaaggctttttccgctttttcgagctgatcacacttgacgtaagccatgcccaggttgaaataggcttctatcgttttttcgccgccgtatgcggcgctggttgtgtttgccgcttcgtataatgtgatggcttcttcgtagtgagagcgggcgaaactcaggtcgccgcggaccagaagaaccctgtgccggataatgggggagacgggctgatctttgatgccatccagcattgctgccgctttgtccggttctccggtttttaacagcagcctcgattgcagggcggttccccatactttcaagtcgtcgtgatccggcgcgcctgattgttcgagtatcttcaggccggcttctatttgcctgagggctccgtctgaatcattgacttccatcagcgcccagcctgccgtgtcgatccgaaagtaagcttcccgcgtgtgttcgcctgattgatgggcggcatcggcggcttttaatccgtattcgattcgcaggggcaggttgattctgcttagaaaatggctgatgcggatgatgagtttgatcaggatgtcatgttgtcctgtttcgctcgaccattcgatgacctttaggatgttcggccattcttttttcatttgctctaaattccgtcccagcaggtagctccaatagacggaattcggccgttcccgttttatatgggtttccgcataatcaatataataatgcgcccagcggctgcgggcttcttttgcaaattcgtgattttcggataagtgctgttctccgtaagcgacaacggtttgatgggctgcgtattgaattcttccttcgcttcgttccggctgtattaaagcatatgacctcatttgctcaatcgcgtaatgaaaccgccggacgtctaatccggccgctagagccaagcttttctcatcagggggcttagcgaaaaagcaaagcgtctgccatagttttcgtgtgtcttcatgacatctgtcccatgtgcggccaaagagaacctcaaacaattccaataatgagtagcctgcttgtttaagttcttgaatgagctggggagcggggatgtcgtcgtctgacatgtatgcaatgctcagtgccatggccttcgggttgccggcggctgccgagatgaattcattcttaaggtcaggcgatagccgcagcagctgctccagcttttcccgtttttgcgggaggttgcatgtttgcagacatcggtgcacttcttgctgaaaaaattcaagggcatccgtttgttcaaggccgctcagctggatggccgccagttccccgaggccgtcccggtaagtctgttttacgttttcccgtgccgtaaggaggacttttacgccttgcggaaggccgatgataaattcgtgaatgtcacgttccgctgtatcaatgctgtcaacgatcagcagcacgggtttttcatttgaatgagcggctaatgcattgcggacgacgaaccgtttttcgttgatggatttgtcgatttgttctgcgcgtccgagctgataggcgatcgtgtttaaaaaatcgctgaagctcaatcctttccagtccgcgctgatccagatgatgctgttgaatgccggccaatctggtgaaccgccggcacaaaggtaggctgcttcaagagcgatcgttgtttttcccatgccggcccagccagtgattaaacagaccggtgacggagacagcatccattgccgaatcgcctctatatcaaagccgcgtccgataaagttcccggtccggcgtgacggtaagttatgcgtgacggactgttctgtaagcgcattcgtttcatggcttggtctgtcatgaaacagccgctttactgctttttcaacatcttcatcactcggcgctccgaatgatccgtctttccggcgtatttttgctttttttagacaagacgccgtccaaacgggcaatgcgggtttgatgacaggaatggtggtggtttccagaaggccggtcagccattcaggatccatgtcggtcttttcgataatgatccaaatcaagccgaacagctttccgtcgtcaattcgtccgggaatgtagtttgcgcccatctgtccgatccagcttttgatcgtgttagaggaaacgcctaatcggagtgcgatttgatctatataagactgtcctgttttttcgttctttttccttctgactttataatcaggatgatgtttcagcgatttgacggcaggtgccagcagttctgcaaattgtgtccggttttctagttcagccattagcctgcacctcctattagtactattttatcaattcagtgttttttgtatatgaaaaattaaaaagtacagtgcggctgtccttttatacagcaggaaaggctgttgaacgtatggaaaagcagataaaataggggcagtaatagagaaaacaaaaatgtatgcacttacatttcaaagcagagaaaggattttgccaaatgactcacacagtgcctcaaaacatgaaagcggcggttatgcacaacacgagagaaatcaaaatcgaaacattgcccgtgcctgacatcaatcatgatgaagtgttgattaaggtgatggctgtcggaatttgcggatctgatctgcattactatacaaatggcagaataggcaattatgtagtggaaaaaccatttatcctcggtcatgaatgcgcgggagaaattgccgccgtcggatcggctgtcggtcaattcaaggtgggagaccgtgtcgccgtcgaacccggtgtcacatgcggacgctgtgaggcgtgcaaagaagggcgttataatctttgcccggatgtacagtttttggcgacaccgccggttgacggcgcgtttgtccaatatatcaaaatgcgtcaggactttgttttttcgcttccggattcactttcctatgaagatgcggctttgatcgaaccgttttctgtcggcattcatgcggccgcgagaacgaagcttcagcccggttcaacggttgcgatcatgggcatgggtcctgtggggctgatggccgttgcggcagcgaaagcatacggggcaggcacaattattgtgaccgacttggagccgctgcggttagatgccgcgaaaaaaatgggcgcgacgcatgtcatcaatgtccgggaacaggatgccggtgaagaaatcaaaacgatcacgaatggcagaggcgttgatgctgcctgggaaacagcggggaatccggcggcattgcaatccgcactggcttccgtgcgccggggcggaaaactggcgattgtcggtttgccttctcagaacgagattccgctcaatgtgccgtttattgcagataacgagattgatatatacggaatcttccgttatgcgaatacgtatccgaagggaattgaatttctcgcttccggtatagtggacacgaagcatcttgtaacggaccaatatccgctggagaagacgcaagaggcgatggaacgcgcctttcaatacaaaaatgaatgcttaaaagtgatggtgtatccaaatcgctgagtgaacggggaggatctttgcattctccctcttgcttatcaaaaatgaaaacggattcttggggtgggaaatgatgattgaaacagaaaaagcagcggcagtaaagacgaaacatcgcggcctgtcctggatggaacggatcggctacggattcggcgatatgtcgtacaatattatctttcagtttgtaaacgcatacttattattctactatacagatgtcggcggcattaagcctgcggtcatcgcagctttgtttcttatcgtaagggtgctggacgctatttttgacccgattatgggcgtgattctagacaagacgaatacaagatggggaaaggcaaggccgtatcttttgtgggtggcgtttccttttgcgttatttacgttcttatgcttcacgacccctcatttcggcgagacggggaacatggtttatgcgtacatcacttatattctgcttgggatgtccttcagcatgcagacgattccggtcaacagcttaacgggtcggatgacgaattccgtggaggaacggacggttctgacgacgacccggatgattttggtttatatcggaattctgttgtcgatttcctgtgcgacaccgcttgcggacgccatcggcgggaaagatcaggcgtttggatttcagatgacggcgcttatctatgcggcggtgagcatcgcattgaatctgttcagcttctttaccgtgcgggaacggattcagcctgaaaaaagaaaaaaacaaggaatgaaaaaaacgttgtctgttttgttccgaaacaagcctttgctcattttggtttctgcatttttggcgtttgcgattgggtttaacattaagctcagcacgatggtgtactattttacgtataacgtcagccataaggaatttgtgtttttaggaaccgtgttgtttttcggcgccgcgctgatcagcaatctgtttattcctttcttttctgagaagcggggccggaagcaggtcatgatcatcacggcggcgttatcgctgatttcttatgcgggccttcagtttacatcgtattcctcgattccccttattttcttttggcttttcgtttcgggattttttacgacgcctttaaatacgcttgcttggggaatggttgccgattgtgtcgattatgcggaatggaaaaccggagtccgggctgatggcgtggtgatttcgagcatgagtttcatcaataagctcggagttgcgttagccgggtcattttcggccgtttatctcggaatcgccgggtatgccgcgaataccgaacaggccgcctcgtcattgaatgcgattaaaaatatgaatgcgctcattccgggattgttcattctgctgtctattattcttatttctttttatcctttaactgaaaagaaatatcagcagatgatgtctgatctggagcaaagggctgcaagatgagtatacgtaaaatttaaaatattctatgtaaacggttgtatttatgactgaaagcactatactgaaactataatcgagaattgataaatgagtgtgataatgtgggaagccaatctgttatttgtattggagaattgttaattgatttcttttgtaccgatgtggatgttgatttgacggaagggcgcaatttcttaaaaagtgccggcggcgcaccggcgaatgtgtcggcagccattgctaagctgggcggagacgcggctttcagcgggaaaacaggcaaagatccgttcgggtattttctgaagcagacattagacgccgtacacgtcgatacctctatgctcgtcatggatgagaaagcgcctacaacgcttgcgtttgtttcattaaaacaaaatggggagcgcgactttgtgtttaacagaggagcggacgctttgtttacgctggatgatattgatctggaaaaggtaaacgatgcgaaaatccttcatttcggatcagcgacggcattgttatctgatccgttttgctcagcctatttacggctgatgtcgattgcgaaagacaatggacagtttatttccttcgatcctaactaccgtgaggatttatggaaaggaagagtttcagagtttataaacaccgcaaaaaaagccatcgccgtaagtgattttgtgaaagtcagtgacgaagagcttgagatcatcagcggtgcgaaggatcataaagaaggcgttgcggttcttcatgagctcggggccggtattgtggcggtgacactcgggaaaagcggcacccttctttcaaatgggaaggatattgacgtcattccgagcattccggtgacatcaatagactcaacgggagcgggagatgcgtttgtcggcgcggcgctgtatcagctggcgcgcacggatgaggttcagacggcagccgaagattttgcgaagctgcgtgatattgtctcatttgccaataaggtgggggcgctcgtgtgcaccaaaatcggtgcgattgatgctttgccgagcttaaaagaggttgaagtatcactgtaaagtatggaggatgtttcttgaaagtcatcggacttcgggaagcatcctctttatttaggtctgaaacccttttcgatatacggtatactttagaaaggcatccagtaaattgaaccgctgtgaagtacatacaataatgtttttatccgttctgagtaaaaccaagtttctgctgctgccgtcatgtacagtgtgacggcctgtgatattgaaccgcggaggaatgtttttttatgaaacatgtttttcttattgtgcaatgcgcgttttctgttttttgttttctttgtctcgccgctgtcaattggtatcaggggagtgagcttgtttctgattcgtttgattggaatgatacggctaaattctcaaagcttttgaatgggacggatacgattacaagtccggaacagatttcgcagttggatttctttgtgtatgctgcgaagcattatccgttagtgagcgggttgatgatcgggctgtttgtttattttttgttctcactgtatctgcttgtgaggaatttccgtcggcacaaatgggctgaatgagactattttcatataaaaatacataaattcaagaggaaatgaaacctttttcgaaaaaaacagtatatataactgtgaacttgttactattaaattttgggaggaaaatgaaaaatgagtattttaggaagatttaaagacattatgtcaagcaatatcaatgcgctgctggataaagctgaaaaccctgaaaaaatggttgatcaatatttacggaatctgaacagtgatttaggaaaagtgaaagcggagacagcttctgtcatggctgaggaacagcgggcgaaaagagcattaacggaatgccaggctgatgccgaaaagatggaaagttatgcgatgaaagcgttgcaggccggcaatgaagccgatgcgcggacatttttggaaaggaaaacggctgttgaatcaagactgactgaactgcaaacggcttatcagctcgcttcttccaacgcgtctcaaatgcgcaaaatgcatgacaagcttgtcgctgatatcggagagcttgagtcgcgaagaaatgccatcaaagcgaagtggtctgtggcaaaaacgcaggagagaatgaacaaattggggtcctctgtgtcaaatgcgggccaatcgctgacagctttcggcagaatggaagacaaggtcaaccgggcgcttgatcacgccaatgcgatggctgagctgaacgcgtctccgaaagacgatattgacgagctgacggctaaatatgacagcaatcaaagcagtgtcgacgatgagttggcggcgcttaagcagaaaatgcttttcagtaaagatcaatagacagcgggctgcagttttgtccgatataaagagaaagtgagagaaacagaatgatcatttcttataaatgcccgaactgcggcgatgatatggtctttgacagttcatccggcatgctgacatgtcacagctgcgggcggcaggatcagattgagagcctgccaaaagagtatataacgacgagattttccgaaaatgaggcgaacgagtaccgttgtgagaactgcggcgcagtattaatgactgaggcggaaacgacggccacgacgtgcgggttttgcggaggagccgctgttctcgccgaccgattatcgggaaatctcgcgccttcgatggtgatcccttttacgatcagtaaagaagaggccatgagcgcttttaaaaagtggtgccgaaacggccgtctgacaccgaaaggatttatgactgccgatcgggtgaagagcataaccggcatgtacgtgccgttttggatgtttgacttaaacagcaaggttcaggtcaatgccgtttgtacgagagtgcgtcactatgaagatggagaataccgggtgacggagaccgagtattacaacgcgtaccgcgatatcaatcttgattatctcaaaattccggtcgacgcttcagaaaaaatgaatgatgaattaatggacaaattggagccttactcatacagtgagctgaaggagtttaatacggcctatttagcgggatatatagcggaaaagtacaattataccgatgacgatctttttccgcgggcgaaggataaaatcagccattatattgattcttatatcagatccaccttctccgggtatacgacggctgacattacggatgagcagattcagaccgataaaatcagcagcttttacgtactgcttccggtctggatggtcagctacgactatgagcgggctgagcacatttttgcgatgaacgggcagacgggcaaggttgtcggcaaaccgccgatcagtgccggaaaagtggccgcgtggttcggcggcataaccgccggtgcgtttttagcattaagactcgtctcacttatgataggaggcggtttttaatgaaagtaccgatgaaaaaagcgtgtctcttctgcttcgtcctttttctgatgctgtctttttctttacatacatcggcgtctgccgcggaacagaagcaatatgtttatgacaatgctcatttattaacgaaggatgaaacgaagaaacttgaggaattggccgggaagctgggagaaaagcgccataccgattttatcattcttaccgcaaacggaacgggcggtaaggagatcgaacagtatgccggtgatttttatgacagtcattttagcggaagcacggccatattgacaattgatatgaaggatcgggaagtatttctctccggatataaaaaggcggagacgtatttgaacagcagccggctgaatacgatcagaaatacgatctcgtcagatatttccgcaggccattatgaaaaggcgtttcagacctacatcaagatggcttataaagatatggggaaaagtccggacgacaagtctgacaatctgctgctcacatggtggtttcagctgattatcgctgcagccgcggccggaatcgccgtcaccgtgatggtgtacaattccggcggcaaggtcaccgtcaccggcagcacgtatatggatcacgatacgtctgaagtgctgagccagcatgacacatatatccggaccgacattacaagagaaaaaaagccagataaagataatgacaatgacggcggagtcacgaggggcggcacgagttacagcggaagcaagggaagtttttaatttatatgtaaaggatttgagcatacatgggttttttcagaaatcagttagcaaatgtggtggaatgggaagaattcagagacgacatggttttctataaatggaacaaccgtgaaattaaaaaaggcagccgtctgatcatccggccgggacaggatgccatctttttatacaacgggaagattgaagggattttccgtgatgacggcgattatgatatcgaatcagaaatcattccgtttctatcgacactaaaagggtttaagtttggctttaacagcggcatgcgggcggaagtgctgtttgtgaatacgaaggagttcaccgtgaagtggggcacaaaaaacgccatcaacattccggcggcaggtatgccgggcggtatgccgatccgcgcaaacggcacatttaacttcaaggtcattgactacatcggattgattgataagattgcgggtgtcaaagacagctatttagtagaggacattaaaatccggattacgtctattctcgatcagcttttgatgaaatggatcaccagagaaggaaaagacatgttcaatctgcagtcgaattcatttgaaatcggaaaagggattcaagaagatcttgatatgcagctgatcggagacggcatgtcgattacgggcttcaatattatgagctttaactatccgcaggaagttcaggatatgattacgaaaaacgcttcttacggcatggtgggcgatgtgaaccgctatcagcagatttccatgacggacggcatgtcatccggcaaaatgagcggaagcggcgccgcctcagacatggcgggcatgatgatgggaatgaatgtggcaaatcaaatgatgaaccaaatgaatcaaaatcagcagaatcagccgcagcaagatcaaagtcagcaggatcaggggacggcgccggcaaacagctcggaaggagcggctaagccgaaattctgtccgaactgcggaacgaaaacggaaggcgcgaatttttgcccgaattgcggacagaaacttgcctgatgatatacgaaaaagaggcctttttggggcctcttttttttgtcatgatttcattgtttgaacgatgagggatgtcagtgcttttgatccctcaggtatgagatggacgccgtccggtgtgaagtattcagggtgctgcaatgcttttgcgtgccaatcgacaagcgtcacatttttgcgtgactcggcctgccggcgcaatgattcgtttactttgctttcccactgccgcggtacacgcgtgttgacaagatagatatcggcttttgaaaaggagctgatcagtgattcaatttggctgtttgtgaaatagccattcgtccctaactcgatgatgaccgctttgttcggctgattaaatgacgcatattccgaagtgagctggagtgcttgagagacttgtcttcctacctttccgtcgatggtgacatgagggagggactgccgcaggtatgacgcaatgtccagcatcaccgagtcaccgatggccagcacgtcttgctgaggctgtgcttgttttgaatcagccgttttttgagatgaccgttcctttttctcgtcggttttcttcgtttctgatttgtctgctggttctttcttgtttttgtctgacgcggtatccgttttttcgccgccgtgttttttcttgctgtcttcttcttttgcaggctgatcgtgatcggccgttttgtgcgaagaggcggcggtttcttgctgatcattctgcgcgtacgtccattgcggctgttttttctcttcggctatccctgacagcccgcccgcaaatacgagaatggcggcaagaatgaggccgagcaacattctgctgatgacagaggacgtcttccattccagaaagcggttcagaaacacgcggcgtaaaaatggccggaagcccgcagtgcggatcggctgttcaatgaaatggtaagatagctcggcaagaatgaaagtggcgccgattctgacggcgcagtgccaataaaccggatttccgatttcctgcacgggtgtgctcagtacgaaaaccgggtaatgccaaaggtagattccgtatgatctcgttccgatccagcgaagcggcttccatgaaagaacatgtcccaaaaagctgctcggatggcataaacatgcgacaagaaccgctgcggtgatgctgattaaaagcatgccgcccttgtacaggaagggttcatattcatccgtgtaaaagacgcaaagcagcagcgcggcaaaagcggcaagctccgtcccgtgaagcaggtgtttcatgctgctcggcagccgtttggaagataatcgtttcatcggccacactaaagctaaagcgcagccgatcagcaattcaaatgaccgggtatccgtcccgtaatagacgcggctcggatctccgccgggcacatacatcatactcattacgactgccgaacataacgcgataaacatgaccgcggccgcaagccgggcccgtgttttacatatgtacattcccgcaagcagcaggaagggccatatgatataaaactgttcttcaatcgccagcgaccaaaggttttttaatggcgaaggggagccgaagctgtcgaaataagaaagttgatgaaagataaaccaccaattgcttatgtaaaaaagtgaggagaccgcatctccgcgtacggtatgcaggagctcgctgttaaacaatacgacccaaatgaccgtcgcgataatcatgagataagccgccggcagaagccgtctgatccggcgcacccaaaaatcacgcaaatcaagggtgatgtcattgccctgggcaggcaatataatagatgtaattaaataccccgataaaacaaaaaagatatcaacaccaatgaaaccgccgtcggcccagttaaaattcagatgatatgcgataactgcgaggacggcaaaggcgcgaagtccatccagtccgggaatatagcggtgatgcagtgacttgtctgacatggtattcctccaataatgtgtgcggaaattctcgctgttttgcggatagctatagctgatttctgtacagtcttccatttgttccgttaattagacgcattcggaaggggattttgtttcagaaaaaatgtatgaaatgctgtgattttcttaaacttttcagcctccgtccggcgtctgttatatgaaaagggtcccttatgcatcttggctgttgcgggacgaaagaaaaaatccatgatctgcggatatcatggatttttttctttctttatctgatgtagcggtctccgacaagcagcttggagatgacggaggtcggtattgtaaactctgtaacgcccatatatccgggtgccgcttcgtattcatcaaatgaaataacaagtttgtgcttatctgtaatataaaaattctggtcggcgcggatggctttaaaaggctccgtcatatcatcttcttcgacccagtatattttattcggatcttctttcatctgttttttcatttgttctttaatattttcgctgatgactttaatataacggtcatctttaaataagctctttaacgtaagcacggcctcattctttttatcaatcgtgatgtatctgctttgcgtataagcggaagcttgtgttttttcgatatcacggcggattgagatcagatccgctgtgtcagtaacggtttcataatcgctgtaaatactgaggtggccttttttgctttttgaggtcgccttcataaattcctgatacagctctttgctttctttcatataatgccggttgatgctgtcttcgagtttatgatcggaaagtccggacagagcgggcgttttcacatcaatgcttgattggttcttttcttccttcatctccacgaatgtgatggcttggacgactttgccgatgacggggattttagacatggcttgtgcggcatccgggttgatattgacaacggcggtaaataagacggccgcagcgactgccgcggatgtcggccacatcacgattcgttttttcttcggtttttgctgaagggctttttcgacaatgctgtccagttccttaggaatgggcacacttttatactcttctcttaattgttctaatctcttttccattaagaaagatcctccttcgtcagctgaatgcgcatgagcttcagccccctgtaaaggcgtgttttgacggtgttgatgttttcccccgtgatgtccgcgatttcttctaatttcaggtcttcaaagaaacgcagaatgataatggttttatattgatgcggcaggtcatcaagcgcttcgtgaaggtctgtgtctttgtagtgatcttcctttccgcggcttaaaaactcgatcgtttcatcgtccatcactttcagttttttctgtttgcggagaaaatcaatggccgtgcgcactaaaattttataaaaccagcttttgatcacatcggggtttttgacggattcgaccgatgtcagcgctttttgaattgattcctgaacaatatctaacgcgtcatccttgttctttacgtaactgtacgcaagccggtaaaagtcttccttgcgctcagttatgcacgtcacaagcgacgctttggctgtttcgttcttcattgcttcaaagggctcctttttaaaaaatacgtatcataggctgctgcctaaggatagacgggacagggtgaaaaatagtttgcgcagagggggtcatttttaaaaggaaaaggaaggaaagacgatgagatgaaaaaaagagccggaacggctcttttttggatgtgtctgatattcagctgaacggtttagttcggtttgactaagatttttacttggtttttctctttgattaaagcgccgaagccttcttcaatgagatcgtcgagcacgatttttttcgtgacgagcttatctgctgagaagtagccctctttcatcagtgcaagaacggaagggaagatgtcacggtatccgataatcccttttacggtccgttctttgatgacgatatcgttcggatgaatttccgctcctttttcccagatgctgacgataaccgtttcaccggcaatgtttgttgactggatcgcctggcggagaacgacaggaacgcctgttacttcataagaaacatcaacgccgccgtttgtgcgtttagcgatttcttcaacgacatcgtccgtttttgacggatcaatgatgatagcgccgagttctttcgctttttcctgacgttccggtgaaagttcaaccgcgtaaatatctgtggcgccggccgctttcagggcttcaatcacaagcagcccgatcggtccgcagccaaaaactgccgccttgtcgcccgcttttaatttgctttggcggacggcgtaaagcgctaccgctgacggctcaacaagcgcgccctgttcgtaagaaagctcttcaggaagcttaaacagcaattcttcgtcaaccgatacatattcagaaaatccgccgccgcctccggctaagcctaagaatcccatttgttcatcaaggttataggctccctgatgtccgtgtgtggcaaaaatcggttccacgacgacacggtcgccgacgctgtaatttttgacgccttcgcccacttccacgacttctcctgagaattcgtgacccatcgtgacgggcgccatttcgtttgttaacggatgaggttcgccgaccggaataaagatcgggcctcccaaatattcatgaaggtcgcttccgcaaatcccgcaccatttgactttaattttgactttacccggttctgctttaggttcatcaatgttttcgattcgaatgtctttttgattgtgccatcttgccgctttcattgattatcactcctagtctgattgaaacgagtataggtacatgatcaatatgaaccacggttaaaaggaataaagtgcttcctaaagcctgatttctcaaaatatatcatattatgcaactatcaataggccttataaaaagtccatattgaatgcagaaatactctatgaatattataacgctaatgaattaaattttgtagtataatttaccatggaattatatagaacaggtaattgtgccgtcgttatgtgcatgtctcatcacgttgtaatgaacatgtaaagtgattgaaatattataatcgtcttcttggtgtataattttgcctagaataaagaatcaggaggacgaaagcttgaagaagttattcttagccttattgattttagcaggaagcacgctgggagcgatcagttactcttctgatgcaagtgctaaaaaagtgaacggaaatattacatggtataatggagtcggtaaaaaaggatcttccggtaaaaaactgggacactgggattgcgcgacaaaattaggatttgacgttccgagaaacggaacgaaaatcagagcttatgcgaaagcaaaaccgaaaaaggttatcacagtatacaaaaatgatgtaggccgtctgccgaatgccgtgttggatgtcagcccgaaagcgttcaaagcgctcggatatccattaagcaaaggaagagtatccggacactacagctattaaaatagaccatcttaaaaagcaaggactctgattcttgctttttctgattgacggagagattgataatgaagaagaaacgatggatctggattttgctggccgccgttttggcggcggcggtcatcgcgtccgttttactgattaaaggaaaaagcgacggcggcggaaaagctgttgtctccggcggccatgacaagctgctagtttccattacagacaaagatctgatgacgaaatattacgaggacggccgcgtgctgtacgaggaaaagctttcggcatatccggcgtttgcactcgatgacgcccatcaggtgctctattttgtcgggaataatgaccaaaatgagatgcgtctgtataagcttgatctgaagacgaaaaagaagacggtgctttataaaggaacggcaagcgctgacagtctgtttttatcaaaggatctgacgcacatttatttccgtctcggaaaagcggatgaagatattttccgtctcgcatcttttgatttgaaaacgaaacgttatgaaaatctgtatcctgccgctgatgagaaagacgacagtgtaagcagcttcttttataaccgcagccaaaacgattttgcgcttctgcattattccgtcaaagaggattatcaaaaaacggatgaggcaaatgagaaggggattgaccctgaaccgacgaatatccggtttgcagcaggagcgggcgaacaccttcaggacctgacaaaccttgaacagtttatcagcggcgtggcggtgtcaccggacggtaagaaccttgtctttacatcttatacacaaaaagggacggaacaaaaagcgtccatccgtctgatgaatgtcaaaacgaaaaaagatgaaacgattatctcaaacgggaaggacttcgctccgctgattgatgcccagcctcagttttctaaagacggcagcatcatttatttcatggcggaagcaaaaggcgctaagcgtctgaaggatgaaacggggcggaatgcgaaggtccggaccatttatgcttatcatttggatacgaaaaaatgcgaaaaagtctgggaaaatgacaacggcattatcaatagtttttccgtcatccaatcatgaaaaaaacactcagcgcccgctgggtgttttttaatgaacaaagctggctgcggctgaggcgagccgtttgaaaaaacggagaatcggaacggcaaaatgaagcgtttcgatgaatgactgtgcggcaaggttcattttccgccgttttgccatttccttcagatctttctgctgccgatcgtttttcatgttcattgctcctttgcatcgtaaaaggacatgataacgcaaaggcctctcatgagacatggaggccttctctatgttgagactcgtaaaagggaggtctaacttgatgccgtttgattattgttttggagatttaccaacgaacggacgccgtcgatcattttactgccgcaaagggggcaagtcggggtatcactgccggcaaaattctttctgctccagccgatacagtcctcttttgtgcattcccacgtactgacatcttctttaggcagcggttcctgattacgtttgttgtagtaagacataaagtcacttcttcccttatgaattttcgtgcactccttcattgtctcatacttttccctaatctcctaattcctttttctatccagatttccaatgagggtgcatcgtcttcctgttattacagtatatgcaaataagcgccttcttattttttctttttggataaataaaaaaagccccttctggagaaagggggggatgtttgtttactgcttatccgtgacgtccatcggtctcatcatgtcgtaatcttcgtgctctaaaatatgacagtgccatacgtagcgtccgctgtatggagcgaaagtcgccgcgattctgatgacttcccccgagtgcgcctgcacggtgtctttccagcctttttcacttggaggaggcgggacggcggggcctgtatacacaatgtcgccgaatttgttataacgctctaagtcaaagggacgccggtcaaggatttggaaggaaacaaggtgcaggtgtatcggatgggttccccccatcggattgataatcgaccagatttccgttgtgccaagcttcggcgcttctgtcacaggatcatgccatcgcttgttattcagcgtcaaaacgggccggccgtatttgtcttgcgtatttgtgagtttaagcgtcctgatattgtgtattctctttgatgtcacattaggcattgttgaaagatatttaggcttccggcttgtgtcttctcccttcagcggttttgtgacgcggaattgcatcacattggcgtctgtatccggatcgacgtcgcccccgcagccggtgccgttcgttaaaatgatatgttctccgtcaaaggaggagaaatcgatgagcacatcataccgctctgccggggctaagctgatagattgtgttttgaccgagcggggaagcagtccgccgtcagaaccgatttggataaacttcccgccgttattgagcgagagagaaaatgttctcgtattggaagcattaaggatgcggaaacgatatgtccgcggttcaacttccatatacggccacgctttaccattgacgagaatggtatttccgcaaaaaaacgggacgatggaagggtcgggcagcgtttcggaagggttagcaggtccgctcggataagacaaggaaccgtcgtcatttaacgtgcggtccaaaatcataagcggtacgtcgtactctccggagggaagcttcagctgcttttcttttcgctcgcggatgatatacatcccggcaagcccggcgtacacattgagcctcgtaatcgccatggcgtgatcgtgataccataacagagccccgcgctgtttgtttggataatggtatacctctttctcaaaataaggacccgtttccttaaagtccttcgtgaaccatgcttccgggtagccgtcgctgtccggcggcgttgctcctccgtgtaaatggacgacggttttgacatcggggtcctgatggccgctttctgaatggtgaatggtatgatccacgggcagaaaatgcttatccggcaggtcattcatccatttaatatagacgttttcatctttgttcacgtcgatcgtcgggccgggaaacaaaccgttatacccccaaagccgggtcggcgggagatcgcggtgcagcttgtgaaagcattccttcatggtgacttcataatacgtgctgccgtctgatttcttctgcggctggagtgtttcgataatcggcagttcatctgcaaatttttctagtgccatttttcatcctgtccttatcatttattgaaatcctgtactacagttaatgctgcctagaacaggttggttaaaaaaacacccgcccttttttgagggggggtgtttgcggttattgcgcaacccggctttcggaagcgctctctttcggtttttgttttttgcggaatacatatgaggcaagtaccagcagagtaataaatcctgtcagcagaaattcagaccgcattgaactgataaacagcatagataacaagatggcgcaaatggcgatgatcgtcaggtaggttaagtacggataaaaccacattttgattttaagagattcagggtttgtccgttcgattttctttctcattctcagatgtgagacggcgatgacgagatagacgagcagtgcgatcgcccctgatgaattgaccaggaacaaaaatacggagtcgggagaaaagtagttcataacaacggcaatgtaggagaaaaaggtgccggcgataatggcttgaaccggtacgcctcttttactcagtttcataaaacgccgcggcgcttcatttcgctctgccagtgaatacagcatccgtgacgtcgtataaagcccggagttcaggcaggacagaacggctgtcaggacgatgaaattcatgatttgagcggctgcgggaaccccgatatggctcaaaacggcaacgaaggggctttccaaaatattggctgaattccacggcagcagtgtgaccacaaccgcaatggagccgacgtaaaaaataatgatccgccaaacgactgagcgggtcgcctttgtgacggattcgaccggatttgacgtttctcccgctgcgattgcgacgatttcagatcccatgaaagaaaaaatgacaacgacgatgccgagcagaacggaacttggacctttagggaaaaatccgccgctgcccgccagattttccagcccgaccggcttgctgccggggacgattccgaaaatgaaagcaaatcccgcgattaagaagacaacgatcgtcgctaccttcactaaggaaagccagtattcaaattcgccgaatgatttaactgaataaatattcgtcagtgttaacagcacggtcagaagcagactcgtcagccataacggaatcccggggaaccagtactgtatgattccggcgcccgcaatggcttcaatggcaatgacgatgacccagaaaaaccaatacagccatccgatggtataaccggcccacggcccgatggcgtcatgcgcgtactgtgaaaacgaaccgcttgtcgggttgacggaggacatttcccccagcattctcataataaaaatcactaataatcctgctaaagcgtaggagacaatcgctccgggtccggtggaatgaatgacggatccgcttccgacaaataatccggcgccgatcacgccggcaattgaaatcatggtcatatgccgggtttttaatcccttagataaagagttaggctgattcattctttgcctccttttggtttgtttatgctgaatattccgacaagtattattctatcataaatgctatagacagttgaaaatgatgtaagaaaatatgacatttttttcgcattcgtacagcagaaggcgccgggatgaaagaggaacatgccattgaccattcacacgttcatatggagcctctccagctgaaataaagcttcctttctaaagggagcttttttcctttttcggactggaaacaattcgctggaaacgtttttttatactgtttatattttgtggtaaagttaggttacgataattgaaatttgagagatgactaggaggagaagaatggcttataaagaagagctgcatccgatgctggagaaagccgttgagcatattgaaaacatcatcataggaaaacgggatatcgccatactcagtctggccgccattctcgcaaaagggcatgtgctgctggaagacgtgccgggagtcggaaaaacgatgatggtccgggctttggccaagctgatcggagctgactttaagaggattcagttcacgccggatcttctgccgtcagatgtgacgggtgtctctatttataatacgaaaacaatggaatttgaataccgcccggggccgatcatggggaatatcgtgctggctgatgaaattaacagaacctctccgaaaactcagtcttccctgcttgaggcgatggaggaagggaatgtcacgattgacggaaagacaatgcggctggctgagccgtttttcgtcatggccacacaaaacccggttgaatatgaaggaacgtatccgcttcccgaagcccagcttgaccggtttttatttaagctgcgcatgggctacccgactgccgaggaggagcttcgggttctgtctttgcaggaagggcgcaatccgcttgaaacaatcgagcccgtcatttctaaagaacagtttatcagccttcagcaaaaactggagcaggtgcgggtggatgatggaattaaagcgtacatcgtcggcatcattcagcatacccgtcggcatccgtccgtacatctgggcgtcagcccgcgcggttcaatttcattaatgaaagccgcacaggcgtacgcgctgcttcatgaccgcgattacgtcattcctgatgacgtccagtatttagctccgtatacgctgccgcacagaatgatcttgaccgccgaggcgaaatttaacgatgtgacggcggaagcggttatagaagacatcatgcaaacggaaaaagttcccgttcaaaggatgtcggtccgctaatgagaaagaagatgcattggcttctatatggctggaagctgcttatgttggccgtactgacggcggctgtcttttcttatgccatgtttcagggcggatttgtgagctggtttttattttatgcgtttttgccgtttaccgtttacgccgggctggtcgctgtgtacccgctgcgggcgtttcaggtgacgcgtgacgtgtcctccgcccagttaacctcaggcgacaggctgtctgtcaccatcaggctgacgaggcgcctgccgtttccgctgacatatatggtcattgaagatgtgatgccggaaacgcttggcgagaggcgcagtgcgaaacagcttgtgtttccgtggtttcaaaggaagctgatgttacaatatgagctgccgcaggtgccgcgcggagagcatcatttacatacgatcagagtgcggacgggagatgttctcgggcttttggacaagacggcgtcgttttccgtaacggatacggttctggttttcccggcgtacgggcctgttcactataagccgcaggctgcatcaggagaagagggtgcgggtgccggcgctccgtttcaggtacaccgcacagcaatggctgcgagcgtcagaaattatcagccgggcgaccggttttccgcacttgactggaaaacatcggcgcggcgaaatgaactgatgacgaaggaatttgacccgctgcagagtatgaatatgattctccttttggactgcaggccgtccccttcgtttgaagccgcggtgtcagcttcggcatccctgctttacacggcgcttgtgaagggctctcccgcaggatttatttcattggggagcgaccggactgtatttcccgtccgggagggagagcggcatttcagacagatgctgcgttacctggcatcagctttagaatcggaagaagccgatgcaggcgggcgtttagggaaagaactgggtaaagcttccgttgccgtcgtgacgggcagtcttacagaagaccttctcaaacaggctgatcccggccgtgctgacatgacggtgtttttggcgaaagaaacgaatgccgcgctttcggagaaagaacggaaactcgctctcatcttcgctcagaaaaatattaaggtgcaaatgatcagggacaaacgggtgtcccatgttgtttagaaagagaggtggcgcgccatgccgcatgacgagaaccagggaagcaggctgagtctgctgctgttttattttctcgcttttttattgttatgggaatggctcaggccgctgcacaattttacggatacaaaacataccggttttttcatcgtttttatcggtttggcatttctgctgtcattcttccggatgaggtggtacgtcaccgtgccgtcctgcattctgtttacgttgatcagtattcacatcctgttttataaaggttctatttttcagccggaatggctcgtttcttttttgcgggacgtgatgcaaaatgcccgccacatcggaaccggaagatggaatgatatgaatccgtcattccgcacgttgctgttttttgtgcttttatggctgctcgtgtatttgctgcattactgggtgatctatcagcggaaaatattattcttttttatcatgacggtggcgtatatcaccgtgcttgatacgtttactccttatgatgccgcgtacgccgtcatccggatcgtctttatcggctttttgatgatggggcttttgtatatggagcgcatccggcttacggaacacatagcgtttaaaaaaagattgatactcaaatggtttctgccgctgatgctgtttatctgcgcttccgtcgtgttcggtctggcggctccgaaatcagacccgaactggccggatcccgtgccgtttctaaaaaaaatcacaaaccacaaagaagtgcccgccgccgaaagcaaaatcggctacggcaatcatgatgaaacattgggcggtccttttcaggaggatgatacgccggtttttacatggaagggaaaagaacgggcgtacttccgggtggaaacgaaagatacatacacggggaaaggctgggtggagaccgatcagggcatgtcctataaactgaacggcggcaatgtggaagatgtatggtttgaccggagtgtgcagacgagacggtatacggcacaggtgtccattgatgagaattatctctataatcacgtcatgtatccgatcggcgtctccaatattaaaccgaagcactcgattcagcttgaaatgaacggaaacaccgagcaaattacgccggtcagtgaacaagtgggcaacatccgcaatatgggacggtacacggtgacttttcaggcgcccgtctttaagctgaatgatctcagaaaagtgaaagtgaaacgataccgtgagcagaatcaattcaatgaccggtatttacaggtccccgacagtcttccgggaagagtgagacagcttgcggacagactgacgcggaatcatcataatatgttcgataaagcgaaggcgatcgaggattatctcggatcttccgcattttcgtataatacacaggatgtcgcggttccggagcacaatcaggattatgtcgatcaatttctgtttgaaacgaaaagaggatattgtgataacttttcatcggcaatggcggtgctgctccgctccgcgggaattcccgcccgttgggtgaagggctatacatccggcgaatataaaggggcaggcgaccataacggccacatttatgaagtcacaaacaacaacgcccattcgtgggtagaagtgtattttcccgatcagggctgggtgacgtttgagccgacaaaaggcttcaccaatccgacggagtttacgtcagagcaaaatcataccgcggcaaaagacagcggaggctcagcggggggttcggattcaccgtctgacaagcagcgtcaggaaacaaagccggaaaaagaagaaacaccgaaaaagcgggatcacagcgcggcaccgcatcctgtgatccgcaacaaaaccgcggcacacctgtggccgtatgcagccatcgtcatcgtgatttcagccgcggcggcactcgtctggctgttccgggcgcgctggattccgcacgttacagcagccagattgaagcggcgaacggatgaagacgtctttttcgacgcatatgccgcgctgctccgccagctgaaacgaaaaggtttcagcaggggagacggagaaacactccgcgattttgctgcgaggattgacgaggcgcaccatacaaacgacatgtccgagctgacgctgcgctatgagcgggccttataccgcagggataatgccgcaaagctttggaatgaatcgggacagttgtgggaaaatataattaaaacaagatagtcttgaccgcatatcgtcctgttgttagaataaatgaatgttaaatgggagcccgggagcgttaaaaagccgggcttccggacaagtcttgcgcgacagagggctgaacgtttgtcctccgttttttctgtgtcaaaaacttagaggagattaggtgacaaccatgacgaagttagtgaatgaaatgattcttgttcttgatttcggcagtcagtataaccagctgattacccgccggatccgtgaatttggcgtatatagcgagctgcacccccatacgttgacagctgaggaaatcaaagaaatgaatccaaaaggaattatcctttcaggcggaccgaacagtgtatatgatgaaggatctttccgctgtgacgaaaaaatctttgaactcgatattcctgtattaggcatctgctacggcatgcagctgatgactcattatctcggaggaaaagtcgaggcggcaagccagcgcgaatacggaaaagcgaacattcagattcaaggaactcctgacttgttcaaggatcttccggaagaacaagttgtctggatgagccacggcgatttggttgtagaagttccagagggcttcactgttgacgcaacaagccatcactgcccgaattcagcgatgagcaaagcggacaagaattggtacggcgtacagttccacccggaagtgcgccactctgaatacggcaatgatcttctgaaaaactttgtcttcggcgtttgtgattgtgaaggcaaatggtcaatggaaaactttatcgaaatcgaaatgcaaaaaatccgcgaaacagtcggagacaagcaggttctttgcgcgctaagcggcggtgttgattcctctgttgtggctgctttgattcataaagcgatcggcgaccagctgacttgtattttcgtcgatcacggcctgcttcgtaaaggcgaagcggaaggcgtcatgaaaacgttcagcgaaggctttaatatgaatgtcattaaagttgatgcgaaagacagattcttaaacaagctgaaaggtgtttctgatcctgagcaaaaacgcaaaatcatcggcaacgaattcatttacgtgtttgatgatgaagcggacaagcttaaaggcatcgattaccttgcgcaaggaacgctttacacggatattatcgagagcggtactgcaacggcgcaaacgatcaaatctcaccacaatgtcggcggacttcctgaagatatgcagtttgaactgatcgagccgttaaacacgctcttcaaagatgaagtgcgcgcgcttggcacagagctcggccttccggatgatatcgtatggcgtcagccgttcccgggccctggacttggcatccgcgtactcggcgaagtaacggaagaaaaacttgaaatcgttcgtgaatcagacgcgattctgcgtgaagaagtggcgaatcacggccttgagcgcgacatctggcagtacttcacggttcttcctgacatccgcagcgtcggcgtcatgggagatgcgagaacgtatgattacacaatcggtatccgtgccgtaacatcaatcgacggcatgacatctgactgggcgcgtatcccttgggatgtgcttgaagtgatttcaacacggatcgtcaacgaagtgaaacacatcaaccgcgtcgtgtatgacattacgagcaagccgcctgcaacgattgagtgggaatagtcaaaagaagcttagaatccttggtttataagggttctaagctctttttttcttttatagcaacaattgatccaatattattaattgaaccgtgaattttaaaaactctcttggaacaagtattccttaatgagataataattaatgttgttttagaataaggtttgttcaaattaagcaaattaaaggaacctccttattcaaatacaaccatttcaccgacatctgtaaatccaaatcgcttatagatattttttccatcatctgaagcctgtaataccactggtttttgtttatcctttgtttgatttagaagaaattgaaacatttcactgccaattcctttacctctaaatgtttcttttgtcatcacatcataaataccatagctatctttggtttctattaataaaccagtagttacaggcatttcatctatgcatccaataaacatttgaacttctgaacctaattttacttgtgaaaacctattaaaataactttctaatgcatctttttctggtgttccctcaaataagctcatgaatacgtctatatattttaaaagttcttcatcatttttcacagcagtaatcataagctgatgggaaattctttgcccggcattaagagtattttcaagtttcatcattacattacgttccgcttcttttagatcatattcttgtataagtttagtccaatcctcagttaaatactgagcatcaatccaaatactaaagggatattttttatatgaaaaattatcgattccatgtctgatcttaactgtatttttgatatttggagatttcggcaatattacattgaatgtatcagtaggaatttttgtatttgctatgatgaaatcttcttcctttgtaagctctccgctaactgtatgagtaaatgattttaatttttcttccaaattgtttatgactaattgttgatttgtaatcatgtttttgcacctttcaatttgatttagtgcgctttttttattataaggtcaactaaaacactaaaaatacagtgttcacagtatttcccccctcccataatattcagaacacggggggcaatatttttatggtaacttctaaatgaaggaactgcaaacccccaaaaggcttgatattcaataaattaattcttataatgtttagaaagcattgagtgggaataaatgaagataaaaaacgcctctttttaaaaaagaggcgttttttttttatctttttgaaaccgttttgctccgattcatatctaacagcataggaggtggataaggtgaaggaagaacgattgatcaaaaaggcgaaaaaaggtgatgcctcagcctttgaaaaactgatcacaacccatcaggagactttatataaaacagcttatctctatttgcatcacaaggaagatacactggacgcagtgcaggaaacggcttacaaggcttttcttcatatcgcgcagctgaaggagccgaaatattttaaaacgtggctgatccggattctgcttcatacgatttttgcgatgaggaaaaagcacggagacgtcattccgtttgagccgcagcatgatacgcgcgcggagaataagaacattgaagaatacatagatcttcggaatgccctggaaacgcttgacgaacatatacagctgaccattcagctttattattttcaagatttctcgattgctatgatcgctgaacagaccggaatggcggaaggcactgtaaaaacgcatctgcacagggcgagaaaagcattgaagcaggagctggaaaaggaggataaacacatatggaaaagcatcaaatgaagcaattgtatcagaacattgacgtgccgaaagctgaattgaaaaacgtgatacatagcgccgctgtccgtgccggaaaagaaggcgccgtcagacggagatggggacgaaaagtgataaacggccttgcggttgctgctgctttgtttattctgtatctgtcctcaggcttgttcatgccctccgttaatacggctatgggaaacattcctgttgccggacaaatttacagtctgtttcaggataaggcaggttctgcgctgtttaaaagcaatttggtgacaaaactgaacgagaaagcggaatcacgcggaatcacggtgacagtgaaaagtgtgtattacgacagcggacagctcgtttacaattttatcgttgataatttgaaatcagatgaggagagcatctcttttcaagttgattataaagatccacggaatatgttagcagaggattatgacagcagtgatatgaaaaaaatgaaagacgggcagtacgcggggcagcttcgcctgttcacggacggctcaaagctgaaagacggtgataagcttccgcttgtcattacacaaatcaaggatatccctggaaactggcgctttacacttccgatcaaaaaacaaaagtccgtttctcttgaaggaacgaaagctgtgaatgtaaatcacggattataccgctttttcgatatccgggcggaaaacggaacgatgggatcggctctcctgtattctatcgacttctatgatgcagctaaaaatgataccatctcgattgacgaagcaacggatgatgctggaaaccattatgaaatgacgatgtcgaatattgaacttggcggaaggaagaatcttcctggcggcgggaaaagaatacgcggccaaactcaattcagcaaaccgatagacccgaaagcgaaaacacttttcataacgggcgatataaaaacagaatcagagccgggagaaatcgtgcctctgaaaacaaaactgcccgtcagttataaaacgaaacatcatcatgtcggcatcaccatcaaaaagatcaaacagcaagacagacgggtaattgtcgattatcaattcagcggaattgatgtaagcaaggcggatgaagatcagctgatgaatgtcggtgaatcaatcggtctcggcaatacgaaaaaaatgaaaacttggccatcgcttaatgagtatgaaaaaggctattatctgaaagggaataaggcgaaagtcacgaatcttaaaacgggtgaaatggaatccgtttttgaattagatgattcatccgataaagactattcattgcgcgatttctcattcgattcatatgctttgtacgtcaatcaaacggttatgaacttgctggcggatgacaaggggatcatattcgcggtgccggttcggcctgcggacggaaaataatgtcgggaaggcggcttttgccgtcttccatttttggtcaattaacgaataaaccaaatttttttaacgggattgttcgttttttttattgagttttcaaaattgaattgatacaatagactcagaaatcaaatatgcagatatcgtataatggcggggatatggcccgcaagtttctaccaagctaccgtaaatggcttgactacggatcaatctcaatcgtttgatataaataatccattcttatttattcagactgaacgtatgtagtcaagcgtcccaaaatgttatttggggcgttttttatttggcggataacgggcagaataaatgggagagaatgaaggaggcaattggcttgaagcaattttttcagtttgatgagctggggacaagctatcgtaatgaaatcatcggcggtttaacgacctttttgtcaatggcgtacattctgttcgtcaatccgctgacattgtctttaaacggtgtgaaaggatttcccgaagcattaaaaattgatcagggcgcggtgttcaccgctacagccttggcatctgcggccggctgtattttaatggggcttattgcaaagtatccgatcgcgattgcgccgggtatgggattaaatgcgttttttgctttctctgtcgtactcggcatggggatttcatggcaggctgcgctttccggcgtcttgatttccggaattatcttcgtggcgctttcgctgacgggattgcgggaaaaaatcattaatgcgattccgcctgagctgaaattggcggtcggcgcgggtatcggtttgtttatcacatttgtcggtttgcagggttcgggcattattgaagcgaactcatcgactttggtgtctatcggcaatattcacagcggccctgtgctgctgacggttttcggtgttattgtgacggtcattctgatggtgcttcgcgtaaacggcggcgtgtttatcggaatgcttctgacggcggttgccggtatgatctgcgggctgattccggttccgacacacattgtcggcagcgtgccgagtcttgcgccgactttcggacaggcgtggatgcaccttccggatatcttctccgtacaaatgctgattgtcattttaactttcctgttcgtcggatttttcgatacggccggtacgctggtagctgtagcgacacaggccggactgatgaaggaaaacaaacttccgcgcgcgggaagagcgcttctggcagattcaacatcaatcgttatcggagccgtgctcggtacgtctacaacgacttcttatgttgaatccagctcaggcgttgcggcgggggcgcgctccggcttcgcggctgttgtgacgggcattctctttttgctggcgatgtttttctcgccgcttctgtcagttgttaccacgaatgtgacggctccggctttaattatcgtcggcgcgctgatggtggcgccgctcggtaagatcgcctgggataaattcgaggtggctgttccggcatttttaacgatgattatgatgccgctgacgtacagcattgcgacggggattgcgatcggttttattttctacccgattacaatgatctgcaaaggaaaaggaaaaagcgttcacccgattatgtacgggctgttcgtcatctttatcctgtatttcatcttcttgaaataacggaaaaaccggctgaggacagccggttttttgtttttgtcctattccgtaaaaccaatacatactataaaacgtcatgtgggtgtccgggtgaagaaaaccgcttgactgtttaaggccgcttcggtaccttatataagtgttttattttcttgctaaacaaattccgccgtatttttttgataggagttgctgacatgacggaagaaagaaaagaaacgttggaagaagaaaaacagcatcagggaactgatgaagaaccgctgtcgagaatgtccagaaatgcgggacgttatcaaaagcaaaagaaaaaagaaaaggaacggcgcccggctccggcttttacagaaaaactcgcttctgcatgggccgcggtcaaacgttattgccgtttcgcgctgcgcattttgacatcaccggtgaaggtcgttggggaagacggcttttcccgctttaaatatgctcttatttcaatgcttgtattcagtatctttttctcaatcggaaattggtttcagctgagggcaagccagcaaaggcctctcggatacggggagcggcatcatacgttttttgacggctttaccgtcgttctcgtgtacacgctcgtcttttttgccgctgcggcgggcgcggtctggcttgtatcacgttatatgatgaaacagaaaattacgatgcgggatgcggccgcgggggtcggatcgcttttggttccggctgtcgcctgctctatcgtgtggatgattttcgcgatattgaatctgccggtcatcaccgtggtgtttacggcgctgaccttgtttctggccgcctcggcgatggtgcagtttgtgcagattctatacaaatcggctgaaaagcctgcggctgacgtgatgtactgtatttccgcggcggtcatcatcatgctcgtttttacggctgtgacatggccgctcatttccgagtactttactgcttcgctgattcctttataagtcgaaatttgtctttcacaatgtttacaaatttttctaataaagcgtgttgttttgaggacccggccgagatatgatgagagcaacagcaattcgaaagcggcactactctttatgattcggaaagggatgatgaagatggccccgttgttgcgagaagccattaatcggaaaaaacagcacctgaggacaaaactgatccgctcagggttttatcaagaccatgttcaggaactgtccggatacacgctgagtgaacttgagaaggaatatgaagctgtcaaacgattgaaaaaagccgagcttcactgataagagcttgaaagtctgccttgcggggcgggcttttttttcttttgaaaatgatgaaaagagggtaaactatccttaattgaaagattggcttttcaaagtcagaggaggggaatcagtgatgcagacaattttatccaacagtataggtatggttctcattattctcatcattaacattatatatgtctctttctttacgatcaggatgattctgacattaaagggacagcgctatttcgccgcaggcatcagtacgattgaaatccttgtgtatgtgaccggcctgagtctcgttctcggcaatctgaatcaaattcaaaacgtcattgcctatgcgctcggctacggcctcggcgtcatagtgggaatgaaaattgaagaaaaactggcgctcggctacataacagtcaacgtcattacgaaagagcttgatctggacctgccgaaacagctccgggaaaaaggatacggtgttacaagctgggttgcgggcggacttgaaggagaccggaccgccatgcagattctgacgccgcgcaaatatgagcttcagctttatgatacgattaaaacgcttgatgaaaaagcgtttatcatcgcctttgagccgaaaacgatccacggcggattctgggtgaaagcagtgaagaagaggagaattaaggaatgacaaagccaaaaaagaaacggtttgaagtaacggaagatgaaacgattgacaccattctcactttaatgaaggaagagggttatacgcccgtccggcggatggaagagccgatctttacagaaaagaaagaaaatggatcaattcaagtcgttccttgcgggaaaaaaatcgtatttgaagggaaattgatctaaacacgaacattaaaagaaagaatttttatatcgttcgataatgtcgttgacattatccaagtccgttgttaagataaacatgaaatcaaaacacgacctcatataatcttgggaatatggcccataagtttctacccggctgccgtaaacggccggactatgcaggaaagtgataaacagctgacatggatatcgcagaagcgaacgactgacgatacgcgcgccatgcccggtttgtattgcttcctcatagttgcaatataagccgggcttttttttctgaaaaacaaagcatgagaaggtgggaacagaatgcagccgctagcaggaatcatcatgggaagcacctccgattgggagacaatgaaacatgcatgcgacatacttgacgaacttcacattccttatgaaaaacaggtagtatccgcgcatcggacgcctgatttgatgtttgaatatgcagaaagcgctagagacagaggcttaaaagtcattattgccggagccggtggagcggcgcatctgccgggtatgacggcggccaaaacgacactgccggtgatcggcgtaccggttcagacaaaatcgcttaacgggcttgattctcttctgtctatcgtacagatgcccggcggcgtgccggtcgcgacgacggcgatcggaaaagcgggcgcagtgaacgcgggtctgttagccgcgcagattttgtcggcatttgacggtgacattgcggataaactagaggcgagaagaaatgcgacaaaacaaacggtgctggaaagcagtgatcagcttgtctgataaaaaaacgatttatcccggcgccgtcatcggcattatcggaggcggacagctcggaaaaatgatggctgtcgccgcaaaacagatgggctataaagtcgcagtcgtcgatcccgtgaaagactcgccatgcggacagatcgccgatattgagattaccgcccagtataatgaccgtgaagcgattcaaaaattggccggagtcagtgacatcattacgtacgaatttgaaaatatcgattacgaggcgctcaactggctcaaagaacatgcatatcttccccagggaagcgagctgctgcttatcacccaaaatagggaaacggaaaaaaaggcgatccagtcagcaggctgtcaagtcgctccttatcggatcgtaaacagcggacgggagcttgaggaagctgttcaggcactggggctcccggctgtgctgaaaacatgccgcggcggatatgacggcaaaggccaatttgtcattaaggaagaaggacagacagatgaagcggccgcgctgctagaaaacggcacgtgcatactggaaagctgggtatcattccggatggagctttccgttatcgtgacgagatcggtgcacggtgagatttcaacctttccggctgctgaaaatatccacaaaaataatattctgttccaaagcatcgtgcccgcgagagcggaggaaacggttcaaaagcgggcagaggcgcttgccgttcagctcgcggagaaattggagcttgtcgggccgcttgcggtggaaatgttcgttacggaagacggagaccttttgatcaatgaactggcgccgcgtcctcacaactccgggcattatacgctcgacctttgtgaaacgagccagttcgaacagcacatcagagcggtctgcggacttcctctcggcagaaccgatcttctcaaaccgggaatgatggtgaatctgctcggtgatgaagtgaagcttgcggaggagcatacggagcttttaaaagaagccaaactgtacctgtacggaaaacatgagattaaaaaaggccgcaaaatggggcatatgacatttttgcggaagcctgatgaaacatggattcaggacatcacgaacatatggatgaaaagagacggaggacgagcataatgatcgaacgttattcaagacctgaaatgtccgcgatctggacggacgaaaacagataccaggcatggctggaagtcgagattttagcctgtgaagcctgggctgagcttggcgtcattccgaaagaagacgtcaaggtcatgcgcgaaaacgcgtcttttgacatcaaccgcattttggaaatcgagcaggatacgcgccatgacgtcgttgcatttacccgcgcggtttcagaatcattaggcgaagaaagaaaatgggtccactacggcctgacgtcaacagatgtcgtggataccgctctttcctatctattaaaacaggcgaatgagatcttgctcaaggacattgagagatttgttgacattataaaagaaaaagcgaaagaacataaatacacggtcatgatgggccgcacgcacggcgtacacgcggaaccgacgacattcggcctgaaactcgcgctttggcacgaagaaatgaaacgcaaccttgaacgtttcaagcaggcaaaagaagggatcgaagtcgggaagctttccggcgcggtcggcacatatgcaaatattgatccgttcgtagagcagtatgtctgcgaaaaactcggcctgaaagcggcgccgatttccactcagacattacagcgcgaccgtcatgcggattacatggcggcactggctttgatcgcgacgagcattgaaaaattcgcagtggaaatccgcggtctgcaaaagagtgaaacacgtgaagtggaagagttttttgcaaaaggacaaaaaggctcatcggctatgcctcataaacggaatccgatcgggtcggaaaatatgacgggcatggcgcgcgtgatccgcgggtacatgctgacggcatacgaaaatgtaccgttatggcatgagcgtgatatttctcattcatcagctgaacgcatcattcttcctgacgcgacaatcgcgctgaattacatgctgaaccgattcagcaacatcgtcaaaaacttaacggtattcccggaaaatatgaaacgcaacatggaccgcacactcggtttaatctattctcagcgcgtgctgctcgctttaatcgacacgggtctgcctcgtgaagaagcatatgacacggttcagccgaaagcgatggaagcttgggaaaaacaagtgccgttccgccagcttgtcgaagcggaggaaaaaatcacgtcccgcctcacacaggaacagattgccgattgctttgactacaattatcatctgaaaaacgtcgacttgatctttgagcgtttaggtttatagaagaagccagccggaggcggcttcttcagccgccgtagattgaatattcccaacattcgggttaggaggccttccgtgaatattgtgaacaataatcttctttatgaaggaaaagcgaaacgaatttatcaaactgaagacgaacagattctccgcgtggtctacaaggattccgcaacagcctttaacggtgagaaaaaagcggagatcagcggaaagggccgtctgaacaatgaaatttcaagcctgattttcaaacatctgcacgccaaaggaattgacaaccactttgtggagcgtgtttcagaatcagagcagctcatcaaaaaagtgagcatcattccgcttgaagtcgtggtcagaaacattgccgccggaagcatgtcgaaacgtctcggcatcccggaaggaacagagctcccgcagccgattatcgaattttactacaaggatgacgcactgggtgatccgctcatcactgaagatcatatctggctcttaaaagcggcggctcctgagcaggtcaaaacgatcaaatcgattacaaaccaggtgaatcaagaactgcagcatatttttgaagactgcggcgtcagattaatagattttaagctggaattcggcttagacgcagagggacgggtgcttttagcggatgaaatttctcctgacacgtgccgtctgtgggacaaagacacaaacgaaaagctcgataaagatttgttcagacggaacctgggaagcttaaccgacgcatatgaagagattttcaaaagactgggaggcatttcataatgtataaagtgaaagtttatgtcagcttaaaagaaagtgtgctcgatcctcaaggaagcgcggtgcagcatgcattgcacagcatgacctacaatgaagtgcaggatgtgcgcatcggaaaatacatggagctgacgatcgaaaaatctgaccgcgatcttgacgcgctcgtgaaagaaatgtgtgaaaagcttcttgccaatacagtcattgaagactaccgatatgaagttgaggaggttgtcgcacagtgaaatttgcggtgattgtgttacccggctccaactgtgatattgatatgtttcacgccgtaaaggacgaactcggcgaagaagtcgagtatgtctggcacgaggaaacaagccttgacggatttgacggcgtactcatccccggcgggttttcatacggcgactacttgagatgcggcgccatcgccagattcgcaaacatcatgccggccgtgaaaaaagcggctgccgaaggaaaaccggttctcggcgtctgcaacggattccagattctgcaggagctcggacttctgcccggcgccatgagacgcaacaaagatttaaagttcatctgccgcccggttgaattaatcgtgcagaacggcggtacgttattcacatcttcctatgaaaaaggacaatcgataacgattccggttgcccacggcgaaggcaatttttactgtgatgacgaaacgcttgaaagattaaaagaaaacaatcaaatcgccttcacatacggcggcgatattaacggaagcgtcagcggcattgccggcgtcgtgaatgagaaaggcaacgtattaggcatgatgcctcaccctgagcgcgcagtcgatgaactgctcggcagcgcagacggtcttacattgttccggtctatcgtgaaaaattggagggaaattcatgtcgctactgcttgaaccaagtaaagaacaaataaaagaagagaaactctatcagcaaatgggtgtcagtgatgacgagttcgcactcattgaatctattatcggaagattgccgaactacacggaaatcgggattttttccgtgatgtggtcagagcactgcagctataaaaactcaaaaccggttttacgcaaattcccgactagcggcgaacgcgtgctgcagggtcccggagaaggcgcgggaatcgttgacatcggtgacaatcaggcggtcgtgttcaaaattgaatcgcataaccatccgtcagcgcttgagccataccagggtgctgcgacgggagtgggcggcattatccgtgacgttttctcaatgggcgcccgtccgatagctgtattaaactctcttcgatttggtgaactcacttcacctcgtgtgaagtacttgtttgaagaagtagtggcgggaatcgcgggatacggaaactgtatcggcatcccgacggtcggcggagaagtgcagtttgacgcaagctatgagggcaatccgcttgtcaatgcaatgtgcgtcggcttgattgatcataaagatattaaaaaaggccaggcgaaaggtgtcggcaacacggtcatgtacgtcggcgctaaaacgggccgcgacggcatacacggcgctactttcgcatcagaagaaatgtcagattcatctgaagaaaaacgttctgcggtgcaggtcggcgatcctttcatggaaaaacttctcctggaagcatgccttgaagtcatccaatgcgacgccttagtcggcattcaggatatgggggcggccggtctgacaagttcgagtgctgaaatggcaagcaaagccggctccggcattgaaatgaatcttgatctcattccgcagcgggaaacgggtatgaccgcttacgaaatgatgctttccgagtctcaggaacgcatgcttctcgtcattgaacgcggacgtgaacaggaaattgtcgatatttttgataaatatgatcttgaagcggtttccgtaggtcatgttacggatgataaaatgcttcgcctccgccataacggagaggttgtttgcgaacttccggtcgacgcactggcggaagaggcgcctgtataccacaaaccgtcagcggaacctgcgtactaccgcgagtttcaggaaacagaagttgccgcgcctgaagtgaaagatgcgacagagacgctttttgacctgctgcagcagccgacaatcgccagcaaagagtgggtgtatgatcaatatgactacatggtgcgcaccaatacggtggtcgctcccggctctgacgcgggagtgctcagaatccgcggcacgaaaaaagcgctggcgatgacgacggattgcaacgcccgttatttatatcttgatccagaagaaggcggaaaaatcgccgttgccgaagcggcgcgcaacatcgtatgctccggcgccgaaccgcttgcggtcacggataatctgaatttcggaaacccggaaaaacctgaaattttctggcagatcgaaaaagcggccgacggcatcagcgaggcgtgcaatgttctcagcacacccgtcatcggcggtaacgtatcactttataatgaatcgaacggaacggccatctacccgacgcctgttatcggcatggtcggcttaattgaagataccgctcatattacgacacagcatttcaaacaagcgggggatcttgtatacgtgatcggcgaaacaaaacctgagtttgccggaagcgaactgcaaaaaatgacagaaggccgcatttacggcaaagcgccgcaaatcgatcttgatatagagctgtcacgccaaaaagcattgcttgacgcaattaaaaaaggcctcgttcaatccgcgcatgatgtgtctgaaggcggcttaggcgtagcgattgctgaaagcgtcatgacgacggaaaaccttggtgccaacgtgactgttgaaggggaagcggcattattattctctgaatctcaatcccgcttcgtcgtttcggtcaaaaaagaacaccaagcggcgtttgaagcagctgcggctgatgcggttcatatcggtgaggtaacggctgacggacttctggcgattcaaaaccaggacggacaacaattggttcacgcgcaaacgaaagaacttgagcgcgcgtggaaaggagctattccatgcttgctgaaatcaaaggcctgaatgaagaatgcggtgtgtttggcatctggggacatgaagaagccccgcaaattacgtattacggcctccacagcctccagcacagaggacaggaaggcgcgggaattgtcgcgactgacggcgaaaaactgacggcgcacaaaggccaagggctgatcactgaagtatttcaaaacggcgagctcagcaaagtaaagggaaaaggcgcgatcgggcatgttcgttacgcaacggctggaggaggcggatatgaaaatgttcagccgctcctgttccgttcgcaaaacaacggcagccttgcgctcgcccataacggcaacttggtcaacgccacacagttgaagcagcagcttgaaaaccaagggagcatttttcagacttcctccgatacggaagtgctggctcatctgattaaacgcagcggacacttttcgctgaaggatcagatcaaaaattcgctgtctatgctgaaaggcgcttatgcctttttaatcatgacagaaacagagatgattgtagcgcttgacccgaacggactcagaccgctgtcaatcggcatcatgggcgatgcttatgtggtcgcttcagaaacgtgcgcatttgacgtcgtcggcgcaacgtaccttcgcgaggtagagccgggcgaaatgctgatcatcaacgatgaaggcatgaaatcagagcgcttttccatgaatatcaaccgttccatctgcagcatggagtacatttatttctcaagacctgacagcaatatcgacggcattaacgtgcacagcgcccggaaaaacctcgggaaaatgcttgcccaggagtccgcggttgaagcggatgtcgtcacaggcgtgcctgattccagtatttctgcggccatcggctatgccgaagcaacgggcatcccgtacgaactcggtctcattaaaaaccgttatgtcggcagaacgtttatccagccgtcacaggctctccgtgagcaaggcgtcagaatgaagctgtccgccgtccgcggtgttgtcgaaggaaaacgggtcgtcatggttgatgattccatcgtgcgcgggacgacaagccgccggattgtcacaatgctcagagaagcgggggcgacagaggtgcacgtcaagatcagttcaccgccgatcgctcatccgtgcttctacggcatcgacacatcaacccatgaggagctgatcgcttcctctcattccgtggaagaaatccgtcagatcatcggagccgacacgctttctttcttaagtgtagacggattgttaaaaggagtcggccgaaaatttgaagacaccaattgcggacaatgcctcgcttgttttacgggcaaatatccgacggaaatttatcaggatacagtgcttcctcacgtaaaagaagcggtgctgacaaaataaaatgtgaaaatgacataaaggcagcgggaattcaggctgcctttctctttctgccttttaaggagaaacgaattgacaaggagtgatagggatgtctgatgcttataaaaatgccggagttgacatcgaagccggatacgaagccgtcaaacgaatgaaaaaacacgtggagcgcacgaaaaggctcggcgttatgggaagcctgggtggttttggcggaatgtttgatctgtcagagcttccgtatcaaaagcctgttttgatttccggaacagacggtgtcggcaccaaactgaaactcgcattttcaatggataagcatgacacgatcggcgtcgatgcggtcgcgatgtgtgtaaacgatgtgcttgcccagggagcggagccgctgtttttccttgattatttggcggtcggcaaggctgatccggtgaaaattgagcagatcgttcagggtgtggcggacggatgcgagcagtcaggatcagcgcttatcggcggtgagacggcggaaatgccggggctgtatacgtctgatgaatacgatattgcgggcttttcagtcggcgtcgcggaaaaagacgaaatcgtcaccggtgaacatatcgaagaggggcatctcttaatcggacttacttcaagcggccttcacagcaacggattttccctggtgagaaaagtgcttcttgatgacggcggacttgatttggatactgtctatgaaccgtttgcgcgtcctctcggcgaagaattgctggaaccgacgagaatatatgtgaagccggtgctcaaggcggtgaaaagcggtaaggtggacggcatggcgcatgtgacaggcggaggattcatcgagaatatcccgcggatgctgccggacggattgagcgcggaaattgatcacggatcatggccgatcccgccgatttttccgtttctgcaggagcacggcaagctgaaagaagaagaaatgttcaatgtttttaatatgggcatcggttttgtccttgccgttaaagaagaaaacctgacagacgtcatcggcacgcttgaagctcagggcgagaaggcttatctgatcggccgggtcaagcggggcgaaggcatttctttcggcggtgcggctctttcatgaaaaagtttgcggtatttgcttcaggaaacggatcgaacttcgaggccattgccaaacgcatgagagaagagaagtggaatgcggagctctcgcttctcgtgacggataagcctcaggcaaaggcggtggaaagggcggaggctttacatatcccgtcattcgcctttgaaccgtcatcttttgaaaacaaagcggcctttgaacgggccattattgaacagctgcgtctgcacggggcggaattaatcgttctcgccggctatatgagactgattggagatacgctgcttgaagcatacgggggccgcattattaatatacatccctcgcttcttccggcattccctgggattgacgctgtcggacaggcgtatcgggccggtgtgaaagtggcgggcattaccgttcattacgtcgacgaaggcatggacaccgggccgattatcgcgcaaaaagcattcgaaatacaggaaaacgatacgcttgaagacatagagcatacaatacacgagcttgagcacaaatggtatccgagcgttgtgaaacggctgctgggactaaataacagaggtgaaaaggcatgacaatcaaacgcgcactaatcagtgtttctgataaaaaaaatctcgtacctttcgtaaaggaactgacagagctcggcgtcgaagtcatttcgaccggaggaacaaaaaaacttcttcaggaaaacggtgtggatgtcatcggcatttcggaagtgaccggatttcctgaaattatggacggacggttaaaaacgctccatcctaatattcacggcggtctgcttgccgtaagagacaataaagagcatatggcgcagatcaatgagcatggcattgcaccgattgaccttgtggtcgtcaacctttatccgtttaaagaaacgatttcaaaagaagacgtaacatacgatgaagcgatagaaaacattgatatcggcggtcccggcatgctgcgcgccgcatcgaaaaaccatcaggatgtgacggtcatcacagatccggccgattacagctccgtgctcaatgagatgaaagaacacggcggcgtttcgctcaaaagaaaacgcgagcttgcggccaaagtattccgccataccgcggcatacgacgcattaatcgctgattacttaacacgcgaggccggtgagaaagaccctgagcaattcactgttacttttgagaaaaaacagtcgctccgctacggtgaaaaccctcaccaagaggcggttttctaccaaagcgcacttcctgtctccggttccatcgcagcggcaaaacagcttcacggcaaagagctttcttataacaatattaaggacgcggatgcggccgttcaaatcgtccgggaatttacagaacccgcagctgttgccgttaaacatatgaatccatgcggagtcggtacgggagcttcaatagaggaagcattcaataaagcgtatgaagctgataaaacctccattttcggcggcatcatcgcgctgaaccgtgaagttgatcaggcaacggctgaagcccttcacggcatctttttagaaatcattatcgccccttctttcagtgaagaagcgctgaacgtgctgacggcgaagaaaaaccttcgtctgctcacgcttgacgtgaccgcatcaggaaagaaagaaaaacagctgacttccgtacagggcggtcttttgattcaagatttagacgtccatggatttgatgacgccgacatcagcatcccgacaaaaagagagccgagcgagcaggaatgggaagatttgaagctggcctggaaagtcgtcaaacacgtgaaatccaacgcgatcgtccttgcaaaagaccatatgacggtcggtgtgggcgcaggacagatgaatcgcgtcggttcagccaaaatcgccattgagcaggccggagaaaaagcaaaaggcagcgcgctcggatcagacgcgtttttcccgatgccggatacagtcgaagaagccgcaaaagccggtgtcacggcgattatccagcccggcggatcggtccgcgatgaagattcgattaaaaaagcggatgaatacggaatcgccatggtattcaccggcatcagacatttcaaacattaagggggaacgaagcgtgaatgtattgattatcggaaaaggcggcagagagcatacattggcttggaaagcggcgcaaagcccgcttgttgacacggtgtacgccgcgcccggaaatgacggtatggcagactgcgcgacgctggtcaacattgaagaaagcgatcatgccgcactcattgcgtttgcgaaagaacatcatgtcgggctgacgattatcggccccgaagttcctctgattgaagggatagccgacgagtttgaaaaagccggactgcttgttttcggaccgtctgaaaaagcggctattattgaaggaagcaaacagtttgccaaggatttaatgaaaaaatacggcattccgacggcggagtatgagacgtttacttcatttgaagaggcgaaagcatatgtacagcaaaaaggcgcgccgattgtcattaaagcggacgggcttgccgccggaaaaggtgtcacagtcgcgatgacggaagaagaagcgattgaatgcctgcacgattttcttgaggatgagaaattcggggaggcgagcgcatctgttgtcattgaagagttcctcgccggcgaagaattttctttaatggcgtttgtaaaaggggagaccgtctatccgatggtcatcgctcaagatcataaacgcgccttcgatggagacaaagggccgaatacgggcggaatgggcgcctactcaccggtgccgcacatttccgatgatatcgtcagaagcgcagtcgaaacgattgtgaagccggcggcaaaagcaatggtgaaagaggggcgctccttcacgggcgtgctgtacgcggggctgattctgacggaagacggatcaaaagtcattgaattcaacgcgcgcttcggagatccggaaacacaggtcgtcgtgccgagaatggaatctgacctcattcaggtgctcttagatcttctgcatgagaaggatgttgacctgagatggaaggacacggccgcggtcagcgttgtgctggcttcagaaggctatccggaaggctatgcgaaagggacgccgatcggcagtttgacgtccgctgaagacgggatcgccgtttttcatgccggaacgaaaaaagacggcggacaatttgttacaaacggcggccgggtcgccaatgtcacggcatttgctgaaacatttgaagcggcgagggataaagtgtacagcgccgtttcagggctgacaaaacccggactgttttacagaagcgatatcggcgcccgtgcgctgaaagcatcgcagcgataaagaggaaacccccgcgtcttaaaagatgcgggttttcttctgaatgacgactaagattgtcgatttgccgtgagagatggttcttctcggaatcgtgataacaggagaaaataaaataacaagccgaaacggcttgttatttttcttgctgatggctgtcatcctgattcattcctgtctggaacatatatgtcaccggacagaagcggaggatgccggacgccgctttcatcgcgcccatcatcatacagaagagatgcatcttgcaccaaggttttctcgtgtatttcgctgaagcggcagacaaaatggtgaggccgcaagtgatgcgcataacggcatttaataaactgatattcggtttcatcatttcagctcccttagaaaaagtttttcattcatcttcaataatttgtaacgttttagccgtgcgataattgtgcggatgtgatacgatgggtctaatataagcgaaggagagtatgtgaatgtccgaacgtacctttaactggaaaaataaagacatcagatcacaggcggatgttgtagactcaaagctgcttccaacgctacttttacgggatgctctcgtattaaatccttttttaaaacaatggctgaaaaagaacgtctggatttacggagaccgaattgtatatgttggtcatgagcttcctgatgcagcagagtacattcataccataaattgtgaaggaaaatacattgtgccaggttacattgaaccgcatacacatccttttcaaatatataatccccaaacgctcgccgaatatgtgtctcaattcggaacaacgacgtttgttaatgataacttgttttttcttttgcacagcggtaaaaagaaagcgcttactatattggaagaactaaaaaaacagccggtgcaatatttctggtggtccagatatgatctgcagactgaagtgctgaatgaggaccagctcctttcttttgatgtccgcaagcaatggattgagcatccggatgtcattcaaggcggagaattgaccggatggccgcgcctcatggacggcgatgacttgatgcttcattgcatgcaggcgacaaagaaactgcgcaagcggatagaagggcattttcccggagcctctgaaaaaacactgacgaagatgaaactgttcggggctgattctgaccacgaggcgatgaatggcgatgaggtgatgagacggcttgaattgggttactatgtttcgctcagacattcatccatccgccctgatttgagaacgattttgcaggatctccatcaaaaaggcttccggcattatgatcatttcttttacacgacggatggagcgacgccgcatttttataaaggcggcatgacgaatgaattaatcaaaatcgctttggaggaaggggttccggcgattgacgcctacaatatggcctcctttaatatcgcgaaatattatcagatggatgactttctcggtgtgatcggtccgggccggcttgcttcattgaacattctcgatgacccgatgaatccggacccggtcacggtgatctccaaaggcatcctgctgagggaagacggccgaaatatgaaggcgtttacagaaacggattggaaaaagggcggtcttgtccctcttgagctttcatatgatatgacgatggatgatttacagttttcaatgccgatgggtgtgataatgcgcaacgccgtcattatggagccgtatatgattgcgattgataattctgttgaccagctttcttttgatcatgatgaatgctatctcacgcttctcgataagcatggaaaatggcgggtcaatacaatgctgaaaggttttgccgatcgggtgcagggctttgtcagttcctacacgacaaccggagatattatcgctgccggaaaaaataaagaagatatcctgctcgctttctcacggatgaaagaaatcggcggcggaatcgtgcttgccgaaaacgggaagattctgcatgagatccccctcgccttaaacggttctgcatccgcggagaattatgaagaagtgcttgagaaagagcaaaaactgaggacgttgctggaggagcggggctaccgattctgcgatccgatctatacgctgctctttttgcagagcacacacctgccttatatccgcattacgccgagaggaatattcgacgtgatgaaaaaaactgtactctttccatcgataatgcgttaaaatataaaagcagggagccgacatatgaaaagatggaaaaccgtttgtatgctttgttttgcgtttttgctgcttgccgcctgccggcagaacaatgccgatcaggtgcagccgaaagaagcggaagctcctttaacggggctgaaaactgagcagaagcttgcagaacgccgtccgattgcagtcgcagtgaacaatcatccgaaggcgaggccccaatccgggctgtcaaaggcggatgttgtcatcgaagcgctcgcggagggccggattacgcggtttctcgcgatttttcaaagtgagatgccggaaacggtcgggcctgtgcggagcgcgagggaatattttgtcacgctcagcagcgggtttaacagcatatttgtccatcatggctggagtcccggcgctaaaaagcagctggagtccggaacttacgattatataaacggtttggattttgacggcagcctgttttggagagccgatttcagcaagccgccccacaattcctacacgtcgtatgacaatatcaggaaggcggcggaacaaaaaggatacaagctgaacggaaaaacagaaccgctcccatttcagacatcagatgcaaaacccggaaacgaaacctacaatattcggatagattatggaacacaaaacgttacaaatcttgtcgaatacgattatgataaaaaagctgatgcttatacaagaagctctgatggtgtgaaagcgacagaccggaagaccggaaagcctttagccatgcacaacatttttattgttgaagccggccatcgcatgacagacaaagatggaaggcgggccatcgatattcagtcaggggggaagggcctcctgcttcagcacggcgatgttatagagtcagactgggaatataaagacggccgtattctgcccgtaaaaggcggtgagattcttccgtttgtgccaggaaagacatggattaatatcgtgcctgatctcgatgcagcttccattagtaaaggagaaggtgtttgacgatgcaaatcgataaattacgcggaaaagaactggaccagttatttttatctattttatcgctgaaagatctggaggaatgctatcgtttctttgacgatctttgtacgattaatgaaatccaatcgctggcgcagcgtttggaagtggcgagaatgctccgcgaaggaaatacgtatcacaaaattgaaagcgaaacgggtgcttccacagcgacgatttcccgggtgaagcgctgcttaaattacgggaacgacgcctatgaaatggcgcttgaccgcgtaaacaaaggagaatcctcctcagctacgtaaaaaaccgctctgccgatgacggcaggcggtttttttatgcgtgctgattcaaaaggccggaaagttccctcaggcttccgtcttcctcccggtatacgatgtgttcagctgagaaatgaatcggcgagctgatacccgccgccgcggcaaggtgaaacagcccttcacgcaacgagagcacgtagttgcagacgcggtgctgtttatcctcgatactgagcgcgcgctgaagttttggatcggttgtcgctactccgacaggacaatgattggtgtggcatacttgagcgcggatacagccgactgaaaacatcattccccgggcaatattgacaaaatccgcgcctaacgcgagggcaacggcaatcttatccggagtgagcagctttccggatgcgaaaattttcagcttatctcttataccgtatgtcttcaaaaggccgtcaacaagggggaggccggtcagaatcggcaggccgacggaatccgccagttcatggaaagaagctcccgttcccccttcactgccgtcaatcgtaataaagtcgggaagtttgcctgatgaactcatacaggaaataaggtcttcaaggtctttgcggctgcccgggacaattttgatgccgaccggtttttcaccgacagttcttaatttctcaatgaaatcaagcatgtccggaacatttgagaattcgttgaagcggtttgggctgtcaatggattgtccgggctgcacatttctgatggcggcaatttcttcggtcacctttgaaccgtcaatatgaccgcctcttgctttcgccccttgcgcaagctttaattcaaaggctttaatctgctcgaggcggctttttttcttaaattcttcccatgaaaattctccatcttcagtgcgcacgccgaacagcccggggccgatttggcagataatatccgcgccgcctttcaagtgatactcagacaggccgccttcgcctgtattcatccatgtgccgccggcctggtgcagcccttttgacagggcggtgattgcccggtcgccaagtgagccgtagctcatcgctgattgtccgattaacccttttacataaaacggtttcttgcatgtgtcgcggccgatcacttgcacatcgtccggatgcaggtaataagggtccgcttttgctttttcacggtgttcgctgcgtttcagcaggttgtctttgtcaatcttgtataccatcgtgtcgatcttcggcgtctgatctgtgcgcagctcctccctttgtttcgggaagagggcgttacggatataatagcccggctgatcgaaatcccgttctgagccgaagcccatcattctgcttttatactttcccgacatgaccgtctgttcatattctctccgggaaaacggctgttcttcgttatcattgctgaataaatactgccgcagctcaggtccgattttttcaaatatatagcgcagttttcccgctgcgggataattgcgcagcactgaatgttcttcctgcttttcgtctcttatgtatatccagagaaacaatgcggcgggaactaaaataataaaaatcaatatacaaatcagtacgataatggcttgttccattgagaccagactccttgccttttttctctttgacattccacatattgtctgttttcaaacatagacgtttcccatcgggcggagcgcaatctttttttgtgaatcaggtgaatgacgtctttttccgtttttccgggccaaacgaatttgttataatgtttaaatggcaagaaacgaatggaggaacgaaaacgcatgtacgatgttaacgagtggaagcatgtttttaaactcgatccgaataaagatttaccggatgaacagctggaacggctttgtgaatcagggactgacgccattgtgatcggaggaagcgacaatatcaccgaggacaatgtgctgagactgatgtcaaaggtgcggcggtttttagtgccgtgcgtacttgaggtgtcgacgattgattccattgtgcccgggtttgatctttatttcattccgagtgtgctcaacagcaaaaaggcggactggattgtcggcatgcatcatcaggcgatgaaagaatacggagagctcatgtcaatggaggaaatcgtgacggagggctactgcatcgtcaaccctgattgtaaggcggccgctttgacggaggcggatacacatatagaaacagaagatattctcgcctatgcgcgggtcgcggaacatttgcttcatctcccgattttttatctggaatacagcgggatgctggcggacatagaaacggtggagaaaacgaaggctgtgctggacaagtccgtcctgttttacggaggcgggattaaagacgcggaaacggcggaacggttcggccgtcatgccgatgtcatcgttgtcggaaatgccgtatatgaagattttgatcaggcgctcaaaacggtggcggctgtaaagacaaagtagccaagcgaacgaaattgatttatgatagaacatatgtttgataggcggtgaacggatatgaattacattagcaatcaattattaagcggattaaatcccgttcagcaggaagcggtcaagacgacggacggtccgctgcttctgatggcgggcgcgggaagcggaaaaacacgtgtgctgacgcacagaatcgcatacttaatggcggaaaaacacgtggcgccatggaacattctggcgattacctttacaaataaagccgccagagaaatgaaggagcgggtggagagcattctcggacccggcgcggatgaaatctggatttccaccttccacagcatgtgcgtgcggattctgcgcagggatattgacagaatcggcatcaaccgaaacttttccattcttgatacggctgatcagctttccgttattaaagggattttgaaagagcggaatatcgatccgaaaaagtttgatccgagaagtattttaggctccatcagcagcgccaaaaacgagctgatcgaacctgaggaattcgcaaaaacggccggcggctactacgatcaggtcacgagtgacgtgtataccgattatcagaaaaaactgttgaaaaaccaatcgctcgattttgatgatttaatcatgacgacgattaagcttttcgatcgtgtgccggaagtgcttgagttttatcagcgcaaattccagtacattcacgtagacgagtaccaggatacgaacagggcgcaatacctgcttgtgaagcagcttgcggcccgccttgaaaatatctgcgtcgtcggtgactccgaccagtccatttacagatggcgcggggcggatatcgcgaatatcctttcctttgaaaaagattatccgagcgcaaacgtgattctgctcgagcaaaactaccgctcaacaaagcggattctgcaagcggctaacgaagtgatcaaaaacaactcaaaccgcaagccgaaaaacctgtggacggaaaatgacgaaggcatcaagctttcttattacagcggcgacaatgaattcggcgaaggccaattcgtcgcgggcaaaatttatgagctgcacagctcggggcggcggaagctttccgatatcgcgattttataccggacaaacgcccagtcgcgcgtcattgaggaaacccttttaaaatccggtctgaactacaatatcgtcggcggaaccaagttctacgacaggaaagaaattaaagacattcttgcatatctgcgccttgtgtcaaatccggacgacgacatcagttttacacggatcgtcaatgtgccgaagcggggcgtcggcgccacttcgctagaaaaaatcgcgtcatatgcggcgatgaacggaatgtcaatgttccaggcgatcaaacaggttgatttcatcggcgtcagcgcaaaagcggcaaacgcgcttgacggctttggcgcgatgattgaaaatctgacgaacatgcaggattacctgtccattacggaactcacggaagaaattctcgaaaaaacagaatacagagaaatgctgaaggctgaaaaatcaatcgaagcccaaagccgccttgaaaatatcgacgagtttctttccgtgacgaaaaacttcgaacaaaaaagcgaagacaagtctctcgtcgcgtttctgaccgatctggcgctgatcgcggatattgaccagctcgaccagaaggaagaagaagcaggcggaaaggatgccgtcactttaatgacactgcacgccgctaaggggcttgaatttccagtcgtgttcttaatgggcatggaagaaggcgtgttcccgcacagccgctccctgatggaagaagccgagatggaagaagaacgcaggctcgcatatgtaggcattacgagggcggaagaagaactgtatttaacgaatgccaaaatgcgaaccttattcggccgcaccaatatgaatccggaatcccgctttatcagggaaatacctggcgatttattggagaacctaaatgagaagaaaacacctcgcatgcagccgggacgaaaagtgcagccgaaacgcgggcccgtatcccgtcctgtttcctatgcgaacaaaacaggcggcgactcgctcagctgggcggtcggcgataaagcgggccataaaaaatggggcaccggaacggttgtcagcgtaaaaggagaaggcgagagcaccgagcttgatatcgcattcccgagcccagtcggcgtgaagcgtctgcttgcagcttttgcgccgattgaaaagcagtaacctgaagaggaaaggaagaacatgatggacaaagaaacagcgaaacaccgggcaaaagaattgcgccgcaccatcgatcagtacagttatgaatattacaccttagatgaaccgagcgtgccggattccgagtacgacagactgatgcaggagctgattgccatagaggaagagcacccggagctcagaacgcctgattcgcccacacagcgggtcgggggagcggtgcttgaatcttttcaaaaggtgcagcacggcacgccgatgctcagtctcggcaacgcatttaacgatgatgatctccgcgattttgaccgccgcgtccgtcaggctgtcggtgacggcgtcgcttacaatgtggagctgaaaatagacggtcttgctgtttctctccgttatgaagacggctatttcgtcagaggcgcgacaagaggagacggaacgacgggcgaagatatcacggaaaacttaaaaacgatccgcaacattccgctgaaaatgaaacggaatctttccatagaagtgcgcggagaggcgtacatgccgaaacagtcatttgaagcgctcaatgaagaaaggctgaaacatgaagaggagccgttcgccaatccccggaacgcggctgcgggctcactcagacagctcgatccgaaaattgcagcgaaacgaaatcttgacatcttcgtctacagtatagcggagcttgacgaaatgggtgtggaaacacagagtcagggcctggattttctggatgagctcggttttaaaacaaaccaggaacggaaaaaatgcgccacgatagatgaagtcattgaaatgatcgaagagctgcaggcgaagcgggccgatctcccttatgaaattgacggaatcgtcatcaaagtcgattcgctcgaccagcaggaagaactcgggtatacggcaaaaagcccgcgctgggcgattgcttacaaattcccggcggaagaggtcgtgacaaaactgctcgatatcgaactgaatgtcggaagaacgggcgttattacgccgaccgccgttctggaaccggtaaaagtcgcgggaacgacggtctcaagagcatcccttcataacgaagatttaattaaagagaaggatatccgcattctcgataaagtggtcgtcaaaaaagcgggcgacatcatccctgaggtcgtcaatgtcttaattgaacagcggaccggggaagaaaaagaattcaatatgccgaccagctgccctgagtgcgaaagcgaacttgtccgcattgaaggggaagtcgcgctgcgctgcatcaatccggaatgtccggcgcagatcagagaaggcctgattcactttgtctcacgcaacgcgatgaatattgacggactcggagaacgtgtcatcacacagcttttccgtgaacatctcgtccgtaatgtcgctgatttgtataagctgacgaaagaacaggttatccggcttgagcggatgggggaaaaatcaactgataatctgatcagctccatccaaaagtcgaaagagaattcgctggaacgcctgctgttcggtctcggcatccgttttatcggctcaaaagcggccaaaacactggccatgcattttgaaagcctggaaaatctgaaacaagccacggaagaagagctgcttgcggtagatgaaatcggcgaaaagatggccgatgccgttgtcacctatttccgcaaagaggaaatgcttgagcttttgaatgaacttgaggaactcggtgtgaacacactctacaaaggcccgaaaaaagtaaaagcggaggacagcgactcttattttgccggcaaaaccatcgtgttaaccggaaagcttgaagagctgtccagaaatgaagccaaggcgcagattgaagcgctcggcggaaagctgacgggatctgtcagcaaaaaaacagacttgctgattgccggagaagcggccggaagcaagctgacaaaagcgcaggaattaaacattgaagtatggaatgaagcacagctattgggagagctaaagaaataagaggagtgttttctattgaaaaagatgttggcattggcggcgacggcaacggcggcagtactcatgctgtcggcctgttcgccgagtttcgggggaaaaaaagaggaagagatcacgcagaaaacggcaaagtcttctgaaaaagcgatcataccgaaatataatatctctgattcctactataaaatggtgctcccgtttaaggccggaaaagcgcgcggcctgaccgcggaccggctgaacacgaggctggacatcgatgaattcgagacggggctgatgcggctcgctcaagacacgttcccgacggatgactatttgtatcaggaaggccagtatttagatgaggacacggtactcagctggcttgaccgcaaaaaagaaggcagtgatctgaaaaaggcgaaaaaggcagacgccaatttccagaatctcggcttaaacccggtactgccaagttcgggatcggcaaaagagaaaaacgaaaacagcccgatttacttagcgtccatgcttgagcaggattacttagtaagaaaagataaaaattccatccagcttggaggtgtcatgatcggtctcgctctcaactcagtatactattaccgcgaaaacacaggtgatccgcagcaggaagtggagctcagcgacaaaacgatccgcaaccacggtgaagaaatcgcacaggaagtcgttaaccgccttcggaaaatggataacctgaaaaatgtgccgattaccgtcgccctttataaacaagcgccgaaaacatcaatcgtaccggggaattacattgcgaaaacagaagtcaaggccggctcatccaccatttcaaactgggatgatgtcaaagaaaagtacgtcttctatccggcggatacagacacggcaaagaaataccctgatgattccgaagtgtttaaacgcttcaaaaacgccatcgacagctacttcccgaattacaccggagttgtcggaacggcaatgtacgaaaacgatgaaatgagaaaaatgaagattgaaatcccgatgcaattttacgggaaaagcgaagtcatcgcctttacccaatacttaacaggtgagctgatggattattattcaaaaggctcagttgatgtcgaaattaacattacctcgtctgacgggcaggaagcgctgatcgtccgcaatgcgggtgacaaagaaccgaccgtccatatttacgattaaccaagatgcccttgttcatttctgtatgagcaagggttttttagtgtgaatatcgttggagagaggaatgaggtatgttaagatatttgtataattaggaattaacaggaaaacatatttcatttctaagcggatgttacgaatctgctgtgaaaaaagaagggcaggaatgttgatgaatgacatttgctgagtacacacaccgcctacaaatgttatgaaaagggtgaatcagcatgcataaagatattaaagcgatttttgaggaagataaggtactggctgaggccggtgaaatatacggatttaccaagtttcaatttattgcggacgcagagaactacgtatatgaaattgtgaaagataacgaaccgtatatcttaaaaattacgcatacgatcagaagaacgccggaatatattctcggggaaatggaatggcttcatcatctggcaaagggagagctttcagtagcaaagccgattccttcattaaatggcaaagatgtcgaagaagtcccggatggaaaaggcggagcgtttttattaagagtctatgaaaaagcgcccggacgaaaagtggaggaatcagactggaacggaacgctgttttaccagcttggaaagtacacggggaacatgcaccggctgacaaaaagctaccgtctgagcgatccggcatataaaaggcaggaatgggatgaagaggagcagctgaagctgagaaaatacgtgcccgcagatcagcatctcgtatttgagcgggcggatgctctaatggaaaaactgcgccgtttgccgaagaatcctgaaaactacggccttgtgcacgccgatctgcatcatggcaattttaattgggacaacggaaaaatcactgcatttgattttgatgatatcggctacaattggtttgtgaatgatatcagtattctgctgtacaacatgttgtggtatccggtcatcccgtatgaagacaaggccgcgtttacgggtgaattcatgactcactttatgaaaggctacagggaagaaaatgaccttgattccgcatggtttgaacacatcccggatttcctccggctgcgccatatgctgatctacggattattgcatcaggcgtttgacctcaattcactcggggacgaggaactcgggatgctgaaagccttcaggcgcgatatcgaaaatgaaacaccgattacggagtatcaattttctgcattcgtataaatagaaaaacgccggctgaatccaacccggcgttttttataacgtatcacatttcactccgacgacgccctgaatttctttaatatcataatagacgtcagtggtgtagcggcttttatgaacactgactttcacttccataatcggaaattctttttcacccagatcatcaatccggacggagtgaatgcggagctgtttgcttttcatttcctttaaaatctcggtcattttgtctttatcggaaagagacattctcacgcggatatccttttccttcaagcggttgggaccgatttttctgatcagccacggaagaaattcgacactgatcaggataaacaagaggcttgcgaacgcctctttataaaagccggcacctgtagccagacccagcccggccgcgccccagatgatagccgatgtcgtcaggccggatatgacgtcattgcttttacgcaggatcacgcccgcgccgataaaaccgacgccggaaatgatttgggcgggaaggcggagcggatccatcatgatacggtaatattttgggaaatgatatgccgcattaatgctgacgatcgtcagcatacaggagctgacggcgatgacgatacaggttttcagtccgagcggtttgtttttcagttctcgttcaagaccgatgatcatgccgatcagcgtggcaatgcccagctttaataaaatgtctggttcgataggccagctcaatttgcacagcacctccgcaatttttcttataataaattgatatgattttctcacagtatttatagcaggacaagtgcggaagaaaaaagccgtcagggataaaatctgacggctttttgtctatttcttgtttttcaaaagagcttccatccggctgaacagctgataagaagcatcggccggttttttggtcagcaggctgacggcaataccggcaatcagactgaggaagaatcccggaatgatttcgtataccccggttgaagcggcaagccctgtcgtaatccagattaaaacggccgcggccccggtaatcatcgccgcaagcgctccccattcattcatccgtttccagtacagactgagcaagagcgccgggccgatagccgaaccgaagccagcccacgcatatccgaccagatcaagaatggtgctgttcggattcatggaaagcaggatggcgataacggccacgatcaataccgacaggcgtccggtcatgaccaattctttatcgctcgcttcccgtctgaaaaaggcgcggtataaatcttccgtaatggcgcttgccgttacgagaagctgtgaggaaatggaactcatgatcgccgctaaaatcgcagacagcaagaagcccgtaatcagcgggtggaacaagattttagaaaaaataatgaaaatcgtttccggatcttttacggagaccccgaagtgatgagaatacgcaaccccgataatcccggtcagcaatgaaccgacaactgaaataaccatccagctcatcccgattctgcgggcgggttttaaatctttcacttctttaatcgccataaatcgtacgatgatatgaggctggccgtaatagccgagtccccatgccaaataagaaataatgctaatgacgctcgcgcctttaaagatatccaatagtttcgggttaacggcgttgatcgaatcaatcgtcgttgaaacgctcccgagctgggtaaaagcaacgatcggcacaagcactaatgccgcaaacatgatcgctccctgtacaaagtcagtcagactgacagcgaggaaaccgccaaacagcgtgtaaaggacaacaacacccgccgttaaaaacaaaccgaatttgtagtcggcgccgaatgccgattcaaataacctgcctccggataccatcccggacgatgtgtacagtgtgaaaaagatcataataatcacggcggaaacaattttcagcaatgatgacgagtggcggaaccgtttatcgaaaaaatcgggaatcgtaatcgcatcatccgcaacttccgtgtaagcgcgcagcctcggagcaagcagcagataatttgaatacgcgccgatcgtcaaaccgagcgccagccataaggtcgataaccccgttgcgaacattgcgccgggaactcccatcagcatccatgcgctcatatccgccgcacctgcggacagcgccgttacgaacgggccgagtcctcttccgcccagcatgtaatcattaatattcgttgtcttcctgaatgcgtaccagccgattaacagcatggcagcaaagtaaatgccaagagatataattaattcaatactcacgtttttggaccctctcttctttcatgtaaatgttgcatcacctctgtagattagtagtgccggaatatgcgccggcgatccagcctttagtcatcattccatgcgaatcacatatttagtgccggctatggttactaaacctaacaaagtatccccgatcaatcaactctcgaaacctggcccgctcaaggaaaaaatccccgccaacatagaacagcttagagatgaaaacgctaccaataaattataaaagtaaaaattttctgacatataattcgtttctctttctccccgatttaggataaaatagagagggtttcatcatgcctcagaaggcggcgttttgttgctttagagggctcgtttttgatatgatcagtattatatgacgaaacggagaattatgcggaggtggatcttatgtcacgaatttctatagaagaagtaaagcatgtcgctcatttggcgagactcgccattacggatgaagaagctgaaatgttcacagaacagcttgacagcatcatctcgtttgccgaggagcttaatgaagtggacacggataacgtggaaccgacaacacacgtgctgaaaatgaaaaacgtaatgagagaagatgaagcgggtaaaggccttccggtcgaggatgtcatgaaaaatgctcccgatcataaagacggctatgtccgtgtgccatctattctggattaaaggagggagacagtatgtcattatttgatcacaaaatcacagaactgaaacaaatgatacataaaaaagaaatcaagatttccgatcttgttgatgaatcttacaaacggatcgcatccgtggatgataaggtgcaggcatttttacagcttgatgaagaaagagcccgcgcttacgcgaaagaacttgacgaagcggttgacggacggtctgaacacggtcttctcttcggaatgccgatcggcgtcaaagacaacatcgtgaccaaagggcttcgcacaacatgctcaagcaaaatcctcgaaaacttcgatccgatttacgatgcgacggttgtggagcgtcttcaagccgctgaagccgtcacgatcggaaagctgaatatggacgagttcgcgatgggttcttctactgaaaactccgcgtacaaagcgacgaaaaacccttggaatctcgatacggttcccggcggatcaagcggcggttccgcagctgcggttgcagctggcgaagtgccgttttcactcggatctgatacgggcggctccatccgtcagccggcttctttctgcggcgtcgtcggattaaagcctacatacggacgcgtgtcacgttacggattggtcgcttttgcgtcttcattagaccagatcggaccgatcacaagaaccgtagaagataacgcattcctgcttcaggcgatttcaggcccggacaaaatggactctacgagcgccaatgtcgaagtgccggactttctttcttcattaactggcgatattaaaggcttaaaaatcgccgtgccgaaagaatatctcggagaaggcgtcggcaaagaagcgaaagaatcggttttagccgctttaaaagtgcttgaagacctcggagcgacatgggaagaagtatctctgccgcacagcaaatacgcgcttgcgacgtattatctgctgtcttcttccgaagcgtctgcaaaccttgcgcgctttgacggcatccgctacggctaccgctcagacaatgcggacaacctgattgacctttataaacagacacgctcagaaggcttcggcaacgaagtgaagcgccgcatcatgctcggcaccttcgcgctcagctccggctactatgacgcgtattacaaaaaagcgcaaaaagtgcgcacgcttattaaaaaagattttgaagacgtatttgagaaatacgatgtcatcgtcggaccgacaacgccgacaccggcattcaaaatcggcgaaaaaaccagcgatccgctcacaatgtacgccaacgatattttaacgatccctgtcaacctcgcgggtgtgccgggaatcagcgtgccgtgcggatttgcggacggactgccgctcggactgcaaatcatcggaaaacacttcgatgaaggcactgtataccgcgtcgctcatgcttttgagcaggcaacagatcatcataaagcgaaacctgaactgtaaggggtgaaatgaagtgaactttgaaacggtaatcggacttgaagtccatgtggaattaaaaacaaaatctaaaattttctcaagctcaccgacgccattcggcgcggaagcgaatacccaaacgagcgtcatcgacctcggctatcccggcgtgctgcccgttttgaacaaagaagcggtcgaattcgcgatgaaagccgcaatggctttgaactgtgaaatcgcaacggatacgaagtttgaccggaaaaactatttctatccggacaacccgaaggcatatcaaatttctcaatttgacaagccgatcggcgaaaacggctggattgaaatcgaagtcggcggaaaaacgaaaaaaatcggcattacccgtcttcaccttgaagaagatgcgggaaaactgacgcatacgggcgacggctattccctcgttgacttcaaccgccagggcacgccgcttgtcgagattgtatctgagccggatatccgcacaccggaggaagcttacgcatatctcgaaaagctgaaatcaattatccaatacacaggtgtttccgactgtaaaatggaagaaggttcactgcgctgtgacgccaacatttccctccgtccgatcggccaggagaaattcggcacaaaaacggagctgaaaaacctgaactccttcgcgttcgtgcaaaaaggacttgagcatgaagaaaaacgccaagagcaggtgcttctgtcaggcggagtcattcagcaggagacgcgccgctacgatgaagcgacgaaaaaaaccattttgatgcgtgtcaaagaaggttcggacgactatcgttatttccctgagcctgaccttgtcgagctctgcattgatgacgaatggaaagaacgcgtaagagcaaccattcctgagcttccggacgagcgccgcaagcgttatatcgaagagctcggtctgccggcttatgacgcaatggttctgacgctgacgaaagaaatggctgatttcttcgaagaaacggtcaataaaggcgcggaagccaagcaggcatcaaactggctgatgggtgaagtctcagcttacctgaacgccgaacaaaaagagcttgcggatgtcgcactgactcctgaaggccttgccggcatgattaagctgattgaaaaaggaaccatctcgtccaaaatcgcgaagaaagtctttaaagaattaattgaaaaaggcggcgacgcagaaaaaatcgtcaaagaaaaaggccttgtgcagatttctgacgaaagcgtgcttctgaagctggtaacagatgcgcttgacagcaacccgcagtcaattgaagacttcaaaaacggaaaagaccgcgcgatcggcttccttgtcgggcagattatgaaagcctcaaaaggacaggccaacccgccgatggtcaacaaaatcttacttgaagaaatcaaaaaacgataaaaaaagcagccgtctgaaagggcgctgctgacacggagaccggtaagcgccggtctctttttttataagctgaaataggtttcaatggaagcccgcagcgtttcaatctgctcatttccgctgcctgccaagttggatagcattcctttaataatcggttttcgcggctcttcctttgcgtattcctcttcaatgacttcaagcgatacgaggacgtcctcaggcagcccctgctgtgcttttatcttttgaatatccgcaagcagtctttctctgtccgccgccggctgagtgaagatatcctcaggcagcagcggatcgggattgtctcttatcagtcccataatcaggtcatcgattctggcaatcagaaaggccgccacgttttccgtccggaatgccgtatgttcattaaaaatcaagaaatgaatataggagctcactattccttgcgccataacggacgcatccgctataaacggtatgacggcatctccgtaaacggagagcaaagcatcccggtacagcatgttaaattgaatattggcctcatgaaaatactgtttgaccttttgattttcaggaatgaccttttcgctcagcaagagaatgataaagtccttgtgctccataaattcctggaattgataagcgatttgttttcggaatacgtccttaggcgatttatgctgatgttctgttttgattttctttatttcttccatagacatgccgatgtaatactcacatgctgagagcaaaaggtcttcttttgatttaaaatgaagatagaaggccccttttgaaattccgcattcaccggcgatttcctgaatggttgttgaagaaaacccttttttggcaaataaatggatgcctgtttttatgattttctcttttttttcgttcatgacgtgcttccccttaatcctgaaaaatttagaaaaatttactgccttattagttgacgatgttgagttataccgtttagtattatatagaatgaccagtcagtcaataaaaattaacggaggacatgatgaaccacattattaactttgtactgaagaacaaattcgcagtttggctgatgacgattatcgttactgtagcagggctgtatgccggtatgaatatgaagcaggaatccataccggacgtcaacatgccttacctctcagtaaatacgacttatcccggagctgctccgagtcaagttgcggatgacgtgacaaaaccgatcgagcaggcggtgcagaatttagaaggagtgagcgtcgtaacgtccacatcctctgaaaacgtctcatcggttatgattgaatatgattacaacaaggatatggacaaggcgaaaaccgaagtcgctgaagcgctggacagtgtcagccttcctgatgacgcgaaaaaacctgacatttcccgttacagtctcaactctttcccgattttgacgctcagtgtgacaagcggcaaaagctcgcttgaagatctgactaaaaatgtggaaaacactctcgttcctaagcttgaaggcattcagggcgttgcgtccgtacaagtttccggacagcaggaagagcaggtggaattctctttcaaagataaaaaaatgaaagagtacggacttgatgaagataccgtcaagaaagtgatccaaggctctgacgtcaatacgccgcttgggttgtacacattcggcaacaaggaaaaatcagttgtcgttaacggaaatattacgtcaattaaagatctgaaagatatgagaattccggtcacatcttcttctgccgctcaaggtcaagcgggcggagccggtgcggcatctgcggcggacgctcaggctatgcagcaggcacagcaaagcgcgtcagcaggggtgccgacagtcaagctttctgacattgccgacattaaagatgtgaaaaaagctgaatccatttcccgcacgaacggaaaggacagcatcggaattaatatcgtaaaagccaatgacgccaacacggtagaagtggccgatgcgattaaagatgaactgaatcaatacaaaaaagaccataaagggttcaagtacagctcgactcttgatatggcagagccgattacagagtcagtggatacgatgttaagcaaagcgattttcggcgcgatttttgcggtcgtgatcattctcttattcttaagagatattaaatcaacgatgatttctatcgtttccatcccgctgtcactgctgattgcgcttcttgtgctgaatcagcttgatgtcacattgaacataatgacgctcggtgcgatgacggtcgccatcggacgggtagtcgacgactcgattgtcgtgatcgaaaacatttaccgccgcatgaggctgaaagatgaacctttacgcgggaagcaattggtgcgtgaagcgacgaaagaaatgtttaaaccgatcatgtcatcaacgatcgtaaccattgccgtattcctgccgcttgccatggtcggcggacagatcggtgaactgtttatgccgtttgccttaacaatcgtcttcgcgcttgccgcatcactgttgatttcgatcacactggtgccgatgcttgcgcacagcttattcaaaaaatcgctcacaggcgcacctgttaaagcgaaagagcataagccgggcagattggccaatttctataaaaaagtgctgaattggtcattaagccataaatggattacatctatcatcgcggttctgatgcttgtcggaagtttgttcctcgtacctctgatcggcgcgagctacctgcctgcgcaagcggacaaaacgatgcagctcacatacacgcctgaaccgggcgaaacgaaaagcgaagctgaaaaagctgcccaaaaagcggaagacatgctgcttaaacgcaaacatgtcgataccgttcagtattctttaggctcgcaaagtccgctcggcggaagttcaaacggcgcattgttctacgtgaaatacgaggatgacacgcctgattttgacaaagaaaaagacaatgtcttaaaagaaatcaaaaaaacatccagccgcggcgaatggaaatcacaaaatttcagttcgtcaggcaacaacaacgaattaacgtactatgtgtacggagattcagagtctgatattaaaggcacggtcaaagacatcgaaggcatcatgaaaaaggagaaggatctgaaagacgtcaactcaggcctttccagcacatatgatgagtacacgttcgtcgctgaccaggagaaactcagcaagcagggcctgacggcttcgcaaatctcccaagccctgatgtcccaaacgtcacagtctcctttgacaacggtgaaaaaagacggcaaagagcttgacgtcaacatcaaaacagaaaaagaccagtataagagtgtaaaagaattagaggataaaaccatcacatcgcctgcaggccaagaagtaaaaatcggcgatgtggcgaaagtgaaaaacggcacgacatccgataccatttccaaacgcgacggcaaagtgtacgctgacgtaacggcaaccgtcacttctgacaacgtcacgaaggtgtcatcagccgttcaaaagaaagttgacaaactggataagccggacaatgtatccattgataccggcggtgtatcagcggatattgcagattcctttacgaaactcggcttagcgatgcttgccgcaatcgccatcgtatacctcgttcttgtgatcacgttcggcggagcattagcgccgtttgcgattctgttctcgcttccgtttacagtcatcggcgcattagtcggactgtatgtatccggagagacggtcagtctgaatgccatgatcggtatgctgatgctgatcggaatcgtcgtcacaaacgcgattgtcttaattgaccgcgtcatccataaagaagcggaaggcctatcgacgagagaagcgctcctggaagccggctctacgagattgcgtccgattctgatgacggcgatcgcgacaatcggcgccctgcttccattggcattgggctttgaaggcggaagccaagtcatttctaaaggactcggtgtcaccgttatcggcggtttaatcagttcgactctgctgactcttctgattgtgccgatcgtatatgaagtattagcgaaattccgtaagaaaaaacctggaacggaagaagagtaagacagcgggccttggctccttaaacggagccggggccttttttcttctggcaattcctgtacatattgttgcgattttctcaagtcatagtataattaaaggttgttagtgttaataatggatcggatactcttaagtaggatgatgagataatgaaacgtgcacgcataatatacaatccgacttcaggacgggagctttttaagaaaaatcttgcccaggtcctgcaaaaatttgaacaagccggttatgaaacctccacccatgccaccacatgcgcgggggatgccacccacgccgcaaaagaagccgctttgcgggagtttgacctgattatcgcagccggcggagacggaacgattaatgaagtcgtcaacggtcttgcgccgttagacaaacgcccgacactcggcatcattccggtcggcacgacaaatgatttcgccagagcgctgggcattccgagagagaatatactgaatgccgctgataccgtcattaacggcgtggcccgcccgatcgacatcggacaggtgaatggtcagtattttatcaacatcgccggcggaggccgtctgacggagctgacgtacgatgtgccaagcaaactgaaaacgatgctcggccagcttgcttattatttaaagggaatggaaatgctgccttcacttcgaccgacagaagtcgagattgaatatgacggcaagctgtttcaaggcgaaattatgctgtttttagtgacgctgaccaactcggtcggcggattcgagaagctggcccctgattccagcctgaatgacggcatgtttgatttaattattttgaaaaaagccaatctcgcggagtttatcagagtcgcgagcatggcgctcagaggcgatcatattaacgatcagcacattatttacacaaaagcgaaccgtgtgaaagtcaatgtatcagaaaagatgcagctgaacctggacggcgaatacggcggcatgctgccgggcgaattcgtgaatctgtatcggcatattcacgtcatcatgccgaaggagaaagcggaacagctggatgactaatacgcggacaaaatcctaaaacagtattcgttttaggattttgtcatcttttcagcgtgatcggaaacctttgaaggctgacattgaatttgaaggtttgccagcacgctgaaacaaggcttttggtaaaacgagaggtgattatagatgaaaatgaaacccccgatagaaaaaaatgaatactatgacgtgacatttgaggatttgacgcatgaaggagcgggcgtcgcaaaggttcagggcttcccgatcttcgtgccgaacgccctgcctgacgaaaaagcgcaaatcaaagtgacacgcgtcaaaaaaggcttcgctttcggccgtttgatcgagctgaaggaagaaagcccgcacagaacggatgccccgtgtccgatctacaaacaatgcggcggctgccagcttcagcacatgacctatgaaggccagctcttgtttaaacagaaacaagtcaaagacgtcttagaacggatcggcaagctggacctctcaaaagtcaccgtgcacccgacgctcggcatggaagacccgtggaactacagaaacaaagcgcaggtgccggtaggagaaagagaaggcggactcgtcgccggattctatcagcaaagaagccatgacatcatcgacatgagcgcctgcctgattcagcaatccaaaaacgatgaagccgtccaagccgtcaaagacatctgtgcagcatacggtgtcaaagcctataacgaagaacgccacaaaggctggcttcgccacatcatggtcagatacggcgtcgtcacgggcgaaatgatgatcgtcttcatcacaagaacaagcgattttccgcacaaagcgaagatcatcaaagacattacggcgcaattcccgcacgtcaaatcgatcgtgcaaaacatcaacccaaataaaacaaacgtcatttttggggacgaaacaaacgtcatctggggcgaagaatacatctacgacctcatcggagacgtcaaattcgccatctccgccagatcgttctatcaggtcaacccggaacagacaaaagtgctctacgacaaagcgcttgagtacgcagagctgcaaggagaagaaaccgtcatcgacgcctactgcggcatcggtaccatttctctatttctggcgaagcaggcgaaaaaagtgtacggcgtcgaaatcgtgccggaagccatcgaggatgcgaaacgcaacgctgagctgaacggcatcacaaacgcggaattcgcagtcggagaagcggaaaccgtcattccaaattggtacgaagaaggcatcacggccgacaccctcgtcgtcgacccgccaagaaaaggctgcgacgaagccctcctgcggacgatcatcgacatgaaaccgaagcgggtggtgtatgtgtcctgcaatccaggcacgcttgcaagagacctgagggtgcttgaggatggcgggtatgcgacgctcgaagtgcagcctgtggatatgttcccgcatacgaatcatgtggagtgttgtgcattgctcgtaaaaaaatagaagatatataagggtccgagaatcggtaatggattctcggactcccatctgtttttgttgaagtaatcccttttctaattttaacttttccttatttagtttagcgagttggataccattatcctgaatgagcaatctgtattcttcttgttgggctttaccccgtatttttctgcaagtgcagccgttttgtctttctttatgttttctatctccttgagaatgttagtgggttgtttgtgatcccactgaattaagtttgtttgcagcctttttatcaatgtctttttgaatagattttgtagagagtgttgaaaacatttgctttatatcatttgaaattgcttcaatcagtccattttctcttacatgatgatctgaacattttgtatgaccatacttattttatgccccacaaatatatcccttacgattggctttatagtacattctcttactacaatcagcacaaggaggaaatatttgttagtgggtgttttttagcttattgtccgtttgcgttttctttcagagattaactgttgaacaacatgaaaatcatcttttgagataatagacttatgagtgttttcgatgacaacgtaatttgctggattaatctttttacgcttttcagttgttacactaattgaaatttccttttgttgaaccaatttgatcctctcaactataaaaggtagcacgataactggcagtgttgatggtgaaggtagatttggaaagtaaaaggtacggagaaaaattaaaagaggtgtttctcatgttggacaataatgtagttgaatgtataaaagaaatcacagaatcctcaaggaatggaaaacttgtcttttttgttggcgcgggagtttcaacactttcagattatcctcaatggtggaggttggtagataagtatcatgaagagctctatgggagtccaaagaaagaaaactattcttctgatgaatatcttcgaattcctcaaatattttataatgtcaaaggtgaaatgacatttgatggtatactaaaagatttttttcaggtagataagcctacgaacccgatacatgacaagatattagctatgaacccagcacatgtaattacaactaattatgataatttgattgatactgcatgttggaagagagggaaatattttagtgtaataagtgctgaagaagacgttgctaatgctacttcatcaagatatttactaaaggttcatggggattttagacggggctttaaaggggaaaatgtagttttaaaggaagatgactatctgaattatgatcagaattatcctcttatcagtaatctcatgaagacaataattgcaacgcataccattgtttttataggttatggtttaggagattataatattaatatgttgttaaattgggtaaaaaagttacaaaaggacagttttcataaaccgttttttattagaacagatccttcgcccattgaaattgagacttcaatctattacgaaaataaaggattacgaataattgatgcagctagtttggtagatagtaatgaatatgattatttagaacgttattcagcagtaatggatcttcttattgaatcaaaagaaaataaatttatcactaaagatgacgaagtaattgattatatatacggaaaaataagcccattatttgcccttcagtatattcgtaaaattgatctcaaacatgtctttgaatacgattattactttgaagtcaatggtactgttgttcggcacaagaataagggatttggttacatggagcgtttttttgaattaagagagagctgcaatgagagaagtaaactttccaaaaaacaatctgaaaggtttaatgctctttctaatttctttgagaagaatggagttatctgtatggcgaaagatgcaagtactctaaatatttcaatagagattaatagtttggcgtatcacggcaaatatgatgaaatgaagaaatttattgaagaacaatcggtaagtattgaggatgattataaaaaagcattttttcttgcgtgtttaggtaggtgggaggaatcctatgacctttattcaaaaatcatcttaaattctatagaagatgagccaaattggtgtgtatattatctatcacaaataaatagatataggatctatcaatcaataacacaagctgtaacgcagtttaatggttctggtttattaatattcgggaggaattataaaccatttactgatgattttcttgctaggatcgaaagagaaatgacaaattttagtatcggtgatttgtttaatggtatgtcatttgagtttcaaaagaaatataagatacttgagtttttaagtgataatcagtttttatatgatgatactgtaaaactttttgagttgactaataaagtgcgttctgaaatgagtaaaggatcttattcttttggaatgtcgtctgatattgttgttcttcttcggctttatgataatttacggtttttatatgaaaattgcttatggtctgtttcttttcatgaatttcatcaatatatgcgaaactcaatgagcctactaattgaaaaggctgaatatgagcgaacgagggatatagatgaattaggattctctttttttggaacaaaaacaggtttttttattgaatattacgattttgttaatatatcaagaaactttaaaattgatgacataaagaaccttgagagaagttgctcaattgataaaattaagtttggtgaacaggaaaaaatagaagaatacttagttggtatagcagaagaaattactaagcaattttctgctaatggaatgaacgtcgttttttatactcagtttatttcagaagcaaaagcagcactctattttgctaaatatgtaaaactatctgaagagggacttgggaaaatagtgaaagcattgttgttttattttcctgagagagatttggatataggaaaacgctatgtatggttagagaggttaactaaatttaatggtttacctaagtcaataatttcaattattgatgattttctagtgttacatgcagagaaacatattgatcaaaattattcagaggtatcatcaaatggtttatattccagggactatggtgctttaattaagcattttgagaagaatttcatttcaaaaagattatcagaaatcaccttatgtttaacacaagataagcaaaaacaatttgattttttgtttaaattattacccatactttccactaatgcaaaaagtcatctattaagttttaaaaaagttgaaaatataaatgatttaatgaatgggattagaataggcttaattgatgagttcactccggagtatgaagaattaattattgaatatctggagacacgaaaagcaaattatattgttgaaaaggggatacaaactttttcttctaacgactatatgagtacctttggtctatggtattttcttgaggaaataaataattcaaaaatggaagaatttatcggaatggatgatcagtatgacttttttgtagacccagagaactttgattacaaaaagtttataccttcgtggctaaaaaattataatgataaattacttggtaaaatcgctggaaataaacatatgaaacatcatgtgattgaggtactaaaagaaagagttaaaaactcaaatgataagaggtatttggaaattttaatgaaccactttatctaactcgttgtaaatctttactaaaggcgaattccactgctcaagaaaatttgctatgatttgtctacacctagctctctacgcatgtggagtgtgtggctggactggaacttagagaagggcagctaacctctttgtggggtgttgccttttttaaataaatttatatttaaatcactaatttctgatatatgccattcaagtgaggtcatcattttggggatctcaagcagaagtttatcaacatcttgaacattgttaggattagtgtgttcactcttcttgagaagtttgtccatggcggctaataatacagataagtcggttaggttgtcttgttgttctttgaattcttcaacaggcagtatatttgtttgaccattgttatttatcttttctaaaaggtttacaatttcttttaattggttaaactttgctttctcttatcttgttttttaagtcttttattttgtttcattcatagtggtagtgaaaatcataaactctgtccatcgattcaaaaaacgccagagtccctgttggtagagcaatgaaaaatgcttgtttaggcaatagattttatattatgtgtcaaggtgataaagcattaaatgtttgagattcttaaaggacgatctggaaaataggtttctcttttccactatttaaaacttcttccactatattcagtaaataggcctatagctgatcaactaggtcccgatatataaccatccaacatatactgattcctatatttgaattgaatggctccgtttatatagttgaaatcaagatcgggttttacttctcttagttcatggaaattatcaatttgtataaaatatgtatcggtcttattaggcaaatcagataaattggttatggttttgtttggtctacatatgagagtttgaatataaaacattctatcaccttgtcatcgtaaacttatgaaaaagagatgcagcctaagctgcgtcttatcctttttaaattccacttaaacataggaaactgcaccaataaatttaaatgaatagttttttgcagttatttctttctccctgccgtcatattcaaaattatataaaagaacagcagcattgatttgttcagggagtgcgatacctaccatgttttcgaaacgaggtaagatgacactatcgtatgaacagccgtcaattagtgcaggtaaattgttacgattattttcatgtgcaactttttctataaaatcctcatctaaatcatcgatatctatatcaaagtcaattaaaaattgtgaaggaagaaaatcaccttcatcttcattgtaaactaattcaacatatttacttaatgattcattatcctttatacttccaatccacaatgatacgtaattttggcgttccatataaacctcctattatttaatcctcaatccttttggcagggcttccactccacctttaagtctatagtttgcccaattattcaatctgcggacaaatatattatagtttagagaggaatcaataattcctagcaattcattatgggcagctgtagaacccaatcccccgtgtttaccaacaggatttacgaactcaacttcgtttatggcagttcttaaatctcttatttgttccgctgtaatattccaatgtttaaaggaaggagctcgggaaactaaatgccattcgtgcatgccgctgggtgctcttagttgtctttcaattgctcttctaacttttttatctgcccaaagttcattaagttgggaaagattaagaaacttatcagagactgtgcaaacataggaatagggtttccctgaatctataaagcctcaatattcttttcgattttttgaatgacttgtccgagccatagtattggggatagtccgtaactattgatatctacaccatctgcagactcgtctataaaattatttttttcttcatctgggtaatcgctatttataaacgttttgagtgctactacatcgttttcttgttcttttttaggtatctctgctaagtattcttctagagctgactcaggagtgtctatatcttgatggaaaatacctcctaaaaattgaaatgcaggttcagaaatatttgtttcaatcattgatttcacctcgtgggatagcctgttaatataaagctaccatcattattctttttcaatataattttagcattagttaagtcagaaatttcggctgagcctttggtaattcctctgcctaacacttctgatcctttataggagagaactaaaggttttttcacatcataattatttaaccattattctattttatctttattatttaataaagtaatattagcaaccttttctgcagttgctctatccttaaaagatgatgatccggatattttcttgttactcattttgcttttttcaagccttttcaggagttcttggtcagtcttaccaacatgtctttctataaggtgtccgccttttgcctcgtgagcagctaaacccccacccggtgcgagaggactgctgtctccttgtttaacactatgtatatcgctattgccagaattcacagattttctgagaacactctctttctgctcttcaataatacttttcaataaaggcgtattcttcacattgtgagtattttcaatatcctgtgctattccggcaagcgcgggttcgtacttgtttttcgaaaaggaattgatgtagttttgtcctttttcaatcccggtttttacatgttttgcagtcgctttttcaccggcttccaagacgttatccactttggcggcgcctgttttggcgagcttgtaggtcattgtcattacagccatcatatttaccgtcatatctattttcatatttaaaaaacaaaataaatgacctcttcagaccatacataacgatgtaacaggcagcacccgtttactggatgctgcctgttttgtttatcattattctcgaagccattacttaatatttagataatccttaacaaattccttgtcctcttcatcttcggggaagatacccaagttattgaactcccaaatcatttgtctttcgtattcgtccaaatcagactcaataacatcttcatagtcataatcaattgaaaacgttccagagctttcaagattcagtgtcaaatttgtccatgcttcaggattattttctttaaattcattgtgtaactgtttaaataactcttgaagatctaataatagttctgtataaatttctttactaacttgaaattgttctggaatgtcatgagagtatatatattcatcgttttcgggtgtttgaaagaaaaaatacacttctctggaaccgtctagtatttccgcataaagaacaactttgctccattcggaagggatcatatcattaatttgttcagcaatcttttgatatagcacttccatcttttttgtttccattagattaaccccctggtttattttctatagtaacttgtctcgctctacgattacctatcttatattcaacattaaataatacaggtcttagtgaatctccctgataaacgggttctatattaacttttacttgcttaggaggttttccgtttaatgcctttgaccacacttgctccattttataccatttcccgccgctcctattaatctgagaattcatcggcacgatgttgtcaaattggcctgagcctttgaattgggtggcgattaggtgacctccgtcgtcatctgtcagacggtctggtttacctgcttttgactgtgcatattggttgcgttttgcttctcccagctgtaagtctgctttgacacttgtaattctaccatagttgtcagtggtgtacgtgtagccttcttttgttttgtagatgacattcggcttcaatactttctttctggtccatttcgcaaaatgctcgccgtatttgaccgttaccggcggtacatgcggtgccggtgtccgtctgccgcttgcggaggttccgtacggtttcggcaggatgaccttggcgaatttctgcagtccctctttaagtgtgaccccgttgactgcgttgtaaggaacgcctgccggcactaagtcgtgacgcggatgataggggagaatatcagccagggtgagatctccaatttgatttaacttggttttgacacgtttttttgatacttccatgcctgtgtttactttttgtttgatgtgatcaacggtttgttttgagaccgttatcactttttgtgctgcggcggatttgcttgctgctgttttgactttggttgtcactttggcggctgtgcctgtttttgagacggctccgacgccttttgtgccgaggactgatgtcacaacggtgcccactgcatatgatacccatcttgctctggagtaggtgtcgccattcaccatgtctttttggtacgattcttcgattgccgctgaaatggcttcatacgttttgatcgggtgagccaccgctcctgtaatggcttcaaccgttccgcccggatctgtgaccatatcccataagcctgtgaccgcgtcttttccggaatcataaaggccgacggcaacgcctttgaatccgtctgtgagttcacgcgtgttttcaatttgagtgaagtagcgcttctgttcttttgtcaggtttttatagccgattgttttggccattgagtagaattcatcggcattcgcataatcgtagtttttcagtctttctttcagtttttcaatctctcgttctttcgcttcctctttcttcatcttcaaataagcatccgaatgtcttgcgatatcgccttttttcttatggatgtcgctttctcggtatgccttggcattgtagtgaagcggcgtggcgttttttcctttgcccgtagcgttttgaagctgttgaaagtcggcttggatgaactgttcgtttgcttcggtttctgcgtattcttttgttagatcgtgatcaagcttgccgagtttatgtatcgtttcgcttctttttttgtcagctgaagacagcttttgatctgtgctttcggttgaaaacagatcaagcgagatgatgtcttcgatctcaccgaggatggagcgcatgtcttttttctgctcttccataatcgcctttgatttactgagggcgtgggtgagctcatgctccaggaaagattcctccacatgcgaattggaaagtccggcgtcttcgaccttgccgggaaggcttgtgagaaatgcgattttcatatcgatcagatcaagccagctgtctgtgacgccggcgtggtccttgaaaaaagctttgatgttgtcggcgccccggcctgagaaatcgccgtcaccgaggtcagccatgccttgaaacgcttttttcaggttgaccatctgaccgcgcagttctttgtattcacccgcgcgctttttggcggcggccaggagggtggttgcttcgaaaactttcatgaccatatcctttcttttattcgatatcaaaattttaccacgtgagtcaggatatacagtgtaggaaataggtaataagaataaaatgaatcttttggcttgcgacttccttcctgtatgaagggggcttttttatgttttgtacaataatcctcaaattcggcttactgcgctccggtgattttaagcgtgcctgttttttctaatgtcttacactcgaaacaacccaaccgctgaggtataatagaagcagagtatttatcatacagattcaattcgtgaaagagagtggaacaaaatgggccgtaagtggaacaatattaaagaaaagaaagcatcaaaggacgcaaatacgagccggatttacgcgaagttcggccgtgagatttatgtggcggcaaaacaaggcgagccagatccggaatcgaaccaggcgttaaaagtggtgcttgagcgcgcaaagacgtacagtgtgccgaaaaatattattgagcgtgcgattgaaaaggcgaaaggcggcgcggaggagaactttgacgagctgcgttacgaaggtttcgggccgaacggttcaatgatcatcgttgatgcgttaacgaataatgtaaaccgcacggcgcctgaagtgcgcgccgcattcgggaaaaacggcggaaatatgggtgtgagcgggtctgtcgcttacatgtttgatgcgaccgccgttatcggcgttgaaggcaagacggcggatgaagcgctggaattgctgatggaagctgatgtggacgtgcgcgatattttggaagaggatgacagtgttatcgtatatgccgagcctgatcaattccatgccgtacaggaggcattcaaaaatgccggcgttgaagagttcacggttgcggagctgacgatgcttgcgcaaaatgaagtcgagcttccggaagatgcgaaagctcaatttgaaaagctgatcgatgtgctggaagacctcgaagacgtacaacaggtttatcacaatgtggatttaggcgaataaagacaaaaaggccgggacggcataagttccggcctttttattttgcttatgcggccggcctgtatcgtatttctccgtaagcaattattgattatttcaccaaaactgggcggatgcccatacgtttccttccgcatgtcataaactggactgtaacctatgtgaaggagcgataaatcatgaatgaaagaagaccgatttacggcggcggctatggaggctacggaggctacccggggtacggttttggcggctacggaggctacggtggctacggtggctacggcggcttcggaggatatccgggatacggtttcggcggaggctacggctacccgggatacggttttggcggttacggcggttttggcggctacggcggcttcggaggatatccggggtacggttttggcggctatggcggaggctacggcggctacccgttccatcatcatcatcatcgggacagccaatttatctgaccattcgggaaaagcactcttggaacagcaagagtgctcttctcatgttcttgcagctgtgttacgattggagcaaaatcatcaagtacataggacttttctgtaaatcatgagcaagttgtttataaactgaaaagcatgatctgtaaaaatctctttatcgggaggttttacatgtgagaagtgaagacgaaatgatgaaattgattcttgatattgcgatgaaggacgagagaatccgtcttgtcactttagagggatcaagaaccaataaaaatgtaccgagagacaaatttcaagactatgatatttcttattttgtgaccgatatggactctttcacatctgacgaaagctggctggatcagtttggcgaaagaatgatgatgcaaaaacctgaagatatggaacttttccctccggaactcggagactggttctcctatctcatgctttttaaagatcatcataaaatcgacttaactttgatccctctgagtcaaacagaggattattttacacagagtgatggtttggcggaaatagtattagacaaggatgaccgaatcaacagtaagatgattgcgagtgatgaacaatatcatataaagaaaccgacccccagagagtttgatgattgctgcaatgaattttggatggtttcaacctatgtgattaaaggattaatgcgtaaagaaatactgtttgcgctggatcatatgaatgacattttaaggcctaatgttttgcgtatgattgcgtggaatatcgggatagagcatcagttttcattaagtgtagggaagaattataagtatattcaacattacatgaatgcgaaagattgggaaattctgctgaatacttatgtcggcaatacgtatgaaagcgtgtggaaggcattgtttgactgccaggatctcttcagagcatattcaacgtcagtggctgttttattgagatatgaatatcctgaatatgatcagcaaattacggaatatacaattaaacattatcagcgctttcaatcagatttttcattatgattttttacttcaaattccagatgagctgcattgagtccgtttttaacgggctttttttattttcttacagggcataaatgccgatacggattcatacctattaaggtcatgtgtttaggaaaggaggatcgtaatgaaagaaaatcagccgtttacaccggtcaaatcctataaacccttccacagccggtttgatccctgcccgccgatcggaagaaaatactacagaacgccgccgcatctttatatgcggtttcagccgtatcacttggagcagttttctccgatggaggcattgagaaaaggaaccctttggaaggatctttacgatttctatgataatccttatcgggggggaatcgaatatggcgaaaaagattgatgatgaatactatcggctgctggagcaaattcaggcggcggactttgtcttggtggagctgacgctttatctggatacgcatccccatgaccgtctcgcgcttcagcagtttcatgaatattcccggtactcaagacagctgagaaagcggtttgagcctgagtacggaccgcttctgcaattcggcgtgagtcaggtcggcgctcaatgggactggggccgcggtccttggccatggcaagtataaggagggatctgtaaatgtgggtatatgaaaaaaagctgcagtatccggttaaagtgagtacatgcaacccgatgctggctaagtttctcattgaacaatacggcggggcggacggcgaattggccgcagcgctccggtacttaaaccagcgctacacgattcctgataaggtgatcggcctgctgacggatatcggcacggaggagtttgcgcatttagaaatgattgcgacgatgatttataagctgacaaaagatgcgacaccggagcagctgcgtgatgcagggctcagtgatcattacgtcaaccatgacagcgcgctgttttatcacaatgcggccggagttccgttcacagcgtcttacatacaggcgaagggagatccgattgctgatttatatgaggatattgcggctgaagaaaaggcgagagcgacgtatcaatggattattgatatttccgatgatcctgacctgaatgattcactccgttttctgcgtgagcgtgaaatcgttcactctatgcgtttcagggaagcggttgagattttaaaagaagaacgtgataagaagaaaattttttaaacggccctcaaacatgacggctgtttttttcctttctgcgtttggtctataataaaggtgtcaaatattctgattacaggaggattttatgacaccatttacgattacggaggagaaggcgggggcattccgggccacctccgcccggaaggatgatgaagaagaggttatggatctgctcgtgcaagcggcagaatggcttcgcgataaagggtcgaaccagtggaacggccttctgcaaggggaagatacccacaatatgcgggaggcgatcgccaaagggtatgtttttttattcaggcagaatgaagagctggccggcgtcgtcatgctgcttcccgaagcaagcgggtgggacagacgtctatggggcgatgaaggacatgaggagtccgtatatctccaccggctggcgattaacaggcggtttgcaggcgcggggctcggccggacaatcatgacttgggcggagacgggtgtgtcttgtccgggaaaaacgaaaatccggctcgactgcgtggccgaaaacaaggcgcttcagtcgttttacagcggaatgggttacgaatcaaaagggctcgcgccgggttatcatttgtttgaaaaaaaggtgagtaaataaaaagctccttatgacggaggtgcaaaagacatggggtttttttatctgatctgtctggccgcattttgtcttaactttgccgtatcggctgtgctccgtaagaaatggccgaaaaagatgtggcctgagtgccttttggcggtgctgggcctgactgctttcggtacggttgtttacagcattttcggtgtcggcggctgggaaggaatgggcttagggcttgccgcgatgtttgccggttccggagcggcagccggttatgccgctgaggtgtgcttacgggtcgtcagatcgaatcaaaaacagtaagcagaagtgaaaaaaacgcagcctcggctgcgtttttttgtgtattgccggccgctgtatagaaaacaggcggatgtccataatggtaatgacttttaagaagaaggtgcgaatatgggacatttacttacagtggcttgggagttagtatgcggcttgggtattttatttgtgattttaaaattgcttggaaaaacccaattctcgcaaattacgccgtttgattttatttccgcgctcatcctcggcgaactggtcggaaatgcggtgtatgataaaggcgtcaggattattgaaatcatttttgcttctctgttatggggggttttaatttatctcatcgaactgattacgcagaaagtaaaaagctccagaaagctgttggaaggcgagccgagtattatcatacataaaggaaaactgaaatatgatgtgctgaaaaagaataagctggacattaatcaattgcaaagccttctcagacaggcgaattgcttttccatacaggaagcggagtacgcgattttagaaacaaacgggatggtcagcgtcctgccgaaattccaatatgacacgacgaaaaacggcgacatgcaaataaagccgaagcaggtctctttgccggtcacgctgattattgacggcgaagtgctgtatgaaaatctgaaagaagccgggctggaagaaaagcagctgactcaggagctgaaaaagctgaacatcaaaagaacggaggacgtgctgtatgcggaatggaagcccgataaaccgctgtttgtcctgccgtatgaggagaaaaattaaaaagagcattgccctggggcaaatgctctttattatttttcgtgtacgcctgttttaacggctctgacatgatacataccgacatccgttccaagcatataatcaggtttcggcttgccttggtttgctttgtgggccgcgatgtggtcttcgcttttttcccattgtttccaatggtcttcagactcccagcggattaacacgacgacttcttcatcaccgcggcggacttttttttccagaaccgttacgtctatcaaaccttcctgcttttcaatcacgccttctgaactgaagcgttcgattactttgtcggcatgtccttcttttacggtcatttttctgatttgcacaaacatctggcagctctccaatccttttcacgttttatccaacattttaaatgaaaatgattctcaaagtcaattgagatgcctgacggattacgatttcaggagaaagacatgaccatcctcatctttaaattgcacgaagctgccccattccatttgtttcggttcatctaaaaaggtgatgccgttctttttcatctgttcgtatgcggcaaagacatcttcacactcaaatacgatagaagccttcatatgctcggcgcctttcatcatcgatttcggataaataaccaaatgagtggcggcccctttgggcgctacctcaagccagaaggcgcccggtcccatcggatgctcggcgacggtttcaaaccccgctttttccgtccagaatgttttcgctttttgctgatcatcagtgtatacggcaactgtcgcgatttttttgatcatcatactgacctcctgtttcatttcttttatagtgtgtcctcctgccgaaaaaagcaatcaaaagctttaatgtgccggctttttttaatttctctagtgcgattggcgattccgatttataatttagacaaaagtacatattcttgaaagaggagacggcagtgaacaaagaccaattacttcatgattatattattacacattcggcagagctgacggaaaaatggcttaagctgagacggaagctgagagggcgtttttattctgcggatcaattaagtgaggaaatgaaacggctgctgatcgagcagcatacctttacaaacacggtcatcgcaagcgcttttttggaagatccggccgtttttcagcataacaaagaaaaatgggccgcacaggtagcgaaaagcagagtggagcaagacgcggaggttcatgaggtcgttgaggcgatcggcaattcaagaaccgtcttttgggaggcggtcacccgttttatggatgagcatcaggacattgtaacaaatgaggatgcccgccgctggaattacattgtcaacggctcgtttgatcagctgatgacggattttactgaacagtttcagaaattaatgatcgcgaggctgtcatctcagcaggagcttatttccgaattgagctgtccggttattttgatcgcggatacgatcggcactctgccgcttatcggcgcgattgatacaagacgggcgcgtgtgattttggagtcggtgccggaaaactgtgtcgccaaacggatcacaaaccttgtgattgatctgtccggtgtgcccattgtcgatacgatggtggcgcagcaattgtatatgctgtcgaaaacgttatttctcctcggcatcagaaccgtgttttccggcattcggcctgatgtggcacagacttctatccaattgggacttgatttttcagagtatcaaacttacggctccctggagcaggcgctcgccagcatgggtgtcacatgtgtgatcgaggaagcaaaagcatagaaaaaaggtgctccggccagaggcggggcgctttttttgtcagcggaaaacaatttaaatattctaaaacttagttgacagctagggatagtttgaattattcttatacacatcgaaccggcacaaatagctgatcgtacacaaacgaaagctggccgttctgtccaaatctgataccggtataattgcccatcagtcaactgaaggcatattatttcccttttttgaaaggggataatatgcctttttttatgcggaaaaagagaggagaaatcaggcacatgaaaaaaacagcggcatttttagtattgatcttattggcaggggcgctgtcagcctgtcaatctgagtccggcagcgcgtcatcagacggaaagaccgttcagctgctgaatgtatcgtatgatccgacacgggagctgtataaagagtataatcaggccttttcttcctattggaaaaagaaaacgggtcaagatgtaaccgttcagcagtcgcacggaggttcggggaagcaggccagatccgtaatagacggactcgacgctgatgtcgtaacgcttgctttaggttatgacattgattcgatagcagaaaaagcccggctcattgatcaaaactggcagtcacgtctgccggatcaatcaactccttacacgtcaaccatcgtattcttagtcagaaaagggaatccgaaacacatcactgattgggctgacttggtgaaaaaggacgtttcggtcattacgcccaatccgaaaacatcgggcggagccagatggaactatttagcggcatgggcatatgccgatgaaacgtatcatcatgacgacacgaaaatcaaacagtttatgaaagacctctacggcaatgtggaagtgcttgattcaggggcgcgcggagccacgaccagttttacagaaagagggatgggggatgtgctgatcgcctgggaaaatgaggcctatctcacactgaaggaattcggcaaggagaaatatgagattgtcaatccttcaatcagcattctggctgagcctcctgtctctgttgtcgacaaaaccgccgataaaaaaggaacaaaaaaagcggctgaagcatatttgtcctacctctacagcaaaaaagggcaggagatcgccgcgaagaatttttaccggccccgcgataaagaggttctgaaaaagtatgaaaaacaattcccgcagattaaaacggtgacggtcgaaaaggaattcggcggctggaaaaaagcgcaggaaacccatttcaatgacggcggaacctttgacagcatctatgagaaatagaaagaggaaacgagtatgagaacgttacttttcaaaaaaacaaaaccgtccgtgattccggggttcggattaacgatgggatttacatttttatatatggccgttttggttatcgtgccgctgtccatggtgttttttcatacgatgtcaatggggcccggggacgtctggcatatcatttctgagccgagggccgcggcttcctatcggctgagcttcttgacggcgggctgcgccgctttgatcaatgcggttttcggcgttgtcatcgcctgggtgctgacgagatatgactttccggggaaaaggctggctgacggcctggttgatctgccgtttgcgctgccgaccgccgtcgcaggcattacattaacggcaatgtattcaccggacggctggatcggacagttgtttcctttccgtatttcctttacaccgatcggcattgtcatcgcattgacgtttatcgggctgccttttgtcgtcaggatggttcagcccgtcttagaaaatctccaaaaggaaacggaagaagcatctgcgtcacttggagcttcgaaatggaaaaccttccaaaaggtcattctgccggagctttttccttctattatatcgggtttcgcattatcttttgcccgcgccctcggggagtatggttctgttgtatttatcgcgggcaatatgccgtttaaaaccgagatttccccgctgatcattatgacgaaattagagcaatacgattatgccggggcaacagctgttgcggcagtcatgcttgtcatcacatttttcattttattcatcatcaatggattgcaatggctcaccgcgagaaaatacgcaggaaggtaggggatatgccatgcagctggaaacagcgaaaacagccgtgcctaagcgggagatacgggaatcacccgttgtgaaatgggtgctgatctcagcagttctgctctttttgtccatatttttaatcatgccgcttgcatttatatttattgaagcttttaaaaagggagcggaagcatatatcctctttgtcacgcatccggattcccttgccgcgatgaaattgacgctcctcgtcgttttcatcacggttccgctgaatacgctgttcggcgtcgccgcggcgtgggctgtgaccaaatatgaattcagggggaaaagtctgtttttgacactgattgatctgccgtttgccgtgtctccggtaatcgcgggcttaatctttgtccttttgttcgggcttcacggctggcttggtccatttttacttgatcaccagataaaaatcgtcttcgcagtcccgggaatcgtgcttgcatccttgtttgtgacgctccctttcattgcccgggaattaataccgcttatgcaaagcttgggaaatgctgaagaagaagcgtccgtcacccttggtgctggtggctggagaacgttctggcatgtgacgcttcctaatatcaaatgggggctgatctacggggtgattttgagcgcggcccgaacaatcggcgaattcggcgccgtatcagtcgtttccggtcatatcaggggtgttaccaacacgctcccgcttcatatcgaaattttgtacaacgaatatcagtttacggccgcttttgcggcggcctccgtcatgtcggtttttgcgattatgacactgtttttgaaaaacatcattgaatggaaagccggttatcgttctgtcaaagccggatgaggaaggagtcattatggagattacgatcgacactatttctaagcattacggaaactatcaggcattgcgggatatcaatcttcacgtcaataatggcgagctggttgcgcttctcggcccgtcaggctcaggcaaaacgtcattattgagagtcattgccggcctcgagcaggcagatgggggacgtgtcctgttcggaaaacaagatgtgacggatacgcatgtgaaaagcagacatgtcggttttgtgtttcagcactatgcgttattcagcaagatgacgatttttgaaaatgtcgcctacggattaaaagtccgtccgcgaaagcagcgtcccgccaaaaaggaaattgccgaaaaggtgagagagcttctggcgcttgtgaaactggaaccttatgaaaagcgctatcccccgcagctgtcaggcggacaaagacaaagagccgccctcgcacgcgccttggccgtagaaccgaacattctgctgttggatgaaccgttcggcgcgcttgacgccaaagtaagaaaagagttaaggcaatggctcagacggcttcatgatgaattcggcatgacaagtattttcgtcactcacgaccaggaagaagcgcttgatgtggccgaccgcatcgtcattatgaatgaaggtgcaattgaacagatcggaacgccgcaggaggtgtatgatcaccccgcaaatccgtttgtgtacgactttctcggcagtgtcaacgtatttgaaggaagagtggaggaaggaaagctgatcaccggaaacgcagcaatacctgtcgggcatgctgatcaggacaaggggatcgcttatgtgaggccgcaccattttaccgtagaaaaaaaaccgtccggtctgcattcatttgaagcaaaggcggctcatatccgtgccatcggaccgtccgtcagattggaagccgtccgtaccgacacaggccagcacttggagattgagctctcaaaagagcaatatgacgccttgggggcgggcgtcggcgacacggtttatgtcaaagcgaaggaagtgaaagttttcgcaaagaaaacatatccgaaaattgtgtaaatgctgttgatttctgaatgaaaacataatagtataattatatatttcttatcagaatagtatgaattaaaacactcattgtcaaaagacgaacggccagacataaagggggagcatgatgacgtccaaaggaaacgtagatccgcatgtgatcgaaaagattatcagtgcgctggaaacgctcgatttcgggactgttcagattacggttcataattcccaagtgacacaaattgataaggtggagaaatatcgattttccctgaagagcaaagaagtaaaacaatcttaaaaaacagccaatgacaggaggcggtacatatgaagcattcaactgttcctttccgggagagccggtatctgcacctgcccgaagtgcgctttctgcattggtgcacgaagcaatacggcataaataaaggcgtgctcaatacaattgacggctggttttatgatgcgggcgtcattccgattcccgtcaggcgtctttatgtgctggcattccttgatttcgtgaaaacgccggggcagaaggggaatatccgattcgggcacggcggattgacgaaaaaactgcatgatttcatggatatgcaggagtgcgcagcaaaacgtcaggcctgacatccttaaaatcttcttaagatcatgcaaatttctcccattttatttataatagacctatcacgatcattttttgggaggacttttgacatgcaaactgctgcttatgagagcaaacaatctattatgcagcgcattataacggtatttgtgtttacactgttagttgcgacaatcggcctgtatacgggccggttcattccgccggcattgatgctgccgctgtcggtcttagaggtcgtcatgatcatcgccgcattttggctgcgccgaaaaaaagccgtcggatatgtgtttgtcttttcattcgcttttatttccggaatgacgctgtttccgatcatcagccattatgcgtccgcagccggagcctatgtcgtattggaggcattcggttcttcgtttgtgatttttgcggtgctcggcacgatcggcgctaagacgaaaaaggacttgtcgtttttatggtccttcttgcttgtcgctcttatctcgcttctcgcagtggggatctttaatattttcagcccgctgaattccgccgccatgatggcgtattccgtcatcggaacgattgtgttttcaatgtacatcttatacgatctgaaccagatcaagcaccgggacatcacggctgacctgattcctttgatggcattgacgctttatatcgactttatcaacttgtttatcaacctgcttcggtttttcgggattttaaacagtgatgattaaccgcgcgaaaaaggcgccctgctgagaggggcgcctttttatgttctgtctccggaaaacagcagaagcttatcaaataaaacttcaagcatttttgtcaattccgctttttctccagcagtgaagctttccatgactgctgaaatgttggagaagtggccgggaagaaacagcatcagcttttcttttccttcccttgtaagttcgatgctgatttttcgtctgtcaccggtatgccggctgcggtttacaaagccgtcccgtgcgagtccgtcgatcaatccggtgatggtcgctttggtgacattggattttttcgccagctccgtcggactcaggctgtggccgggttcgtcaaacagaaacattaaaattttgaatttcccttcggacaatccgtgacttgagaaataatgctccatgacctgattcatttttttagacatatcaaataacgtcaaaaatgttttcaatgattcagcatccatatcggcgtaaatctcagcgcgtccggcaatctgcgagtaatccggcaaatgtctcaactccatttttgtaagcctccgtaccattttagtgattcaaagtataagcttgccggattcaaaaggcaacctataaagattgacagtttttcagcctatatagtaaggtgactaatagttaatgaatgataaataaatagagaaggcggtatcgtgatgaaccatgaagtgaaaaagatcatcatagcgggcggagggatcggcggcctgtccgcagcgatttctctcggcagagcaggttttgaagtaaccctttgcgaggcggcgtccgacatgcgaaaaagcggagcgggcattcttcagcctcaaaatgcgcttcgggtgcttcgggaaatcggtgtgtatgatgaatgctgtcaacacggctttcaaacggattggctgaagcagcatgatgaaaacggaacgctgcagtttaaagtgagtgaggcgtttttagatgatacattgccggggcggaataatatattgcggcaaacattaaacgatatcctcaggaagcatgctgaagcggcgggagtcacgattctgcccggtaaaaaagtcgtgtcttacgaagaaacggcagatgaaataacggtgcattgtggagacggaaccgcgatgacggctgacattctcgccggctttgacggcatccgctccgctgtccgcgatcaaatgctgcaaagggaagtgaaaacagagtatctcggcatgggagcgcacagattttacatttcttttcccgagccggtttttcatgattcaacactgatgtataaaaaagggcagacgcaggtcggggtcgtgccgctctctgaaaaaacaggatacgtatttatcatccggccgtatgacgctgacttcagggatgacgaggacacacgttttgaacgggtgagagacttgctgcgcggaattccgggagtaaagtttgtgacagagaatatgtcaagggaatatcccgttttgtttcataagattgagcagatggcggtcaaagaaccgtggcacagaggccgcgtcgttctgggcggggatgccgtccatgcaggagcgccgacattggcgcagggagcggcgatggcgattgaagacgcgattgtgcttagtgaagaactgcaaaagcacgaaaactatgaaactgcatgtcaatcatactttgaaagacgggcggagcgggcattacaggtgcagaatctctcatctgaaatcgtccgccgcgagataaagggaacgcccggcgtccaagacatcatcggtgaatgctatcgattgctcaaagagccttattaaataaagaaagtccagaacatggcgtctggacttttgtcagtcttgttcagatttattccgtatccgctcaatcacctcatgcagcccctcaggcttgtgaaactccaccggcgaactgcctttttcaaacgagatcgtctccgcctcaatgagcgcgacatagcgcccgttcacttttgcgagatggatggattcgccgaaatcagccagtaatcctttaatctctgtttctccgactttcattttcagctcggcttccggcgtgtgttcaatgatctgcgcggatgcctcgatgacttgatgggtgtcgaggcgctcctgaatttcccgcttttcactcgcttcccaaatttcaatgtcgtgctcaaactgctgaagctcttcgctgttttcttcaaaagtttcatacacgtgctcctgcaccatgttcatgacttggtttttcatgatttccggcatcgattcgccatattcgacaaatttgagaaaatcttcgaaataacgggcgtgcgaggcctggtggattttcagctcatgctcttccgtcatgccttcttccggcacatacggatattgaatgcttttcatgttttttgtcgtgatggccatttcgacctttttaatgagagacgaggcgtctgagatgcgggcgaccttcggctcgaaatcgcatttcatcataaagacgaatttgtcctcaaaatatttgcgcggaacggccgatgccacgataaaaacaccgccgcgcacggcgctcgtgtcaagataagtacggacgaactgctcgcttgcctcgataaatgcttccttcgtatccgcaagtctggcgcggttgaaaaggttgtaattcggatttgaatcaagctcatggcccggctccgtgataaaatggccgatttttgtggggacctgctcggattgcggatgccgttcggctttccgtttgacgattttcttcaattccccgtcaagaaaatccttcagctcgctttcttcaaattcttccgtgtcaagggtctggaaatgtttgaactgtttatttgcctgttcgtcttttccttccacttgaatgacataaaacgataaaaacttgatttcaaaatccatatgtgaactcaccttatttctgtatttgacaagcctctccagtatagaaaaaaccgttattgatcgtcaatccggggattgatccgtaacggcggataatcggccggtgaaaagggcactgtagttggaaggaacgcatcaatgtgtaagaaagggtgttattcatgaaggaaacaggtccgattccgcagccgaagacattcggtccgctcggcaatcttcctttgcttgataaagacaagcctacaatgtcgctgatcaaactggcaaacgagcaagggcctatttttcagctgcataccccggcgggcgccattatcgtcgtgtccggacatgaactggtgaaagaggtttgtgatgaagagcggttcgataaaagcattgaaggggctttggagaaagtccgggcgttttccggtgacgggctgtttacaagctggacgcatgagcctaactggcgaaaggcgcataatattctgatgccgaccttcagccagcgcgcgatgaaagattatcattcgatgatgactgatatcgcggtgcagctgattcaaaaatgggctaggctgaatccggatgaggccgttgatgtgcctgctgatatgacccgcctgacgcttgatacgatcgggctttgcggctttaactatcggtttaacagctattacagggaaacgcctcatccgtttatcaacagcatggtgcgcgcccttgatgaagcgatgcaccaaatgcagcgccttgatgttcaggataaactcatgatcaggacgaagcgccaatttcatcatgacattcaggcgatgttttcgttagtagacagtattatcgcagagcgccggtcaggcggacgggatgaaaaggatctgctggccagaatgctgaatgtggaagacccggaaacgggcgaaaaacttgatgatgaaaatatccggtttcaaatcatcacgtttttaattgccggccatgaaacgaccagcggcctgctttcctttgccatctactttctgctgaaacatccccgtgttttggaaaaagcctatgaagaagccgatcgggttttgaccgatcccgttccttcttataaacaagtactggagcttagttatatccgaatgattttgcaggagtcattgcgcttatggccgaccgcgcctgcgttcagcctttatgcgaaagaggatacggtgatcggcgggaaatatccgatcacgccgaaagacagaatttccgtcttaattccccagcttcaccgtgataaagacgcgtggggagacaatgcggaggaattttatccggagcggtttgaacatcctgatcaagtgcctcaccatgcgtacaagccgttcggaaacggtcagagggcgtgtatcggtatgcagttcgccctgcatgaagcaactcttgttctggggatgattctgcagcattttacctttatcgatcacaccgattatgagctcgatattaaacagacactgacgatcaagcccggcgactttcatatccgggtgcggccgagaaacaaaggagccgttgcggcagctctcccggcggctgaaaaagcggcggaagacgtcgaaaaagaaaaacgggaaacaaaaggcgcatccattatcgggcttgataaccgaccgcttctgattttgtacggctcagatacgggaaccgcagaaggcgtggcgcgggaacttgccgatactgccgggatgcacggcgtccggactgaaacggcgcctttaaatgaccggatcggaaaactgccgaaagaaggagcgctcttgatcattacgtcctcttataacggaaagcctccgagcaacgcgggacaattcgttcaatggcttgaagaagtcaaacgcggggaactggaaggcgtccgatatgccgtcttcggctgcggtgatcataactgggcggcgacatatcaggctgtgccgagactgattgatgagaagcttgccgaaaaaggggcggaacgcttttctgcccgaggcgaaggggacgtcagcggcgattttgaaggaaagcttgatgaatggaaaaaaagcatgtggacggacgccatgaaggcattcggtctcaagctgaatgaaaatgccgaaaaagagcgaagtgcgctgggtcttcaatttgtcagcgggcttggcgggtctcctttggcaaagacgtatgaagcggtttacgcatccgttgcggaaaacagggaacttcaggcgccggaaagcggccggagcacaaggcatatcgaaatcactctgccgaaagaggctgcctatcatgaaggggatcatctcggcgtgctgccggtaaacagcaaagagcaggtcagccgtgttctccgccggttccatctgaacgggaacgatcaagtgctgctcacggccagcggacagagcgcggctcatctcccgctcgatcggccggtcaggctgcatgatcttctgagcagctgtgtcgaattgcaggaagcggcatcaagggcccaaatccgggaaatggccgcttatacggtctgtccgccgcacaaacgggaattggaagattttcttgaggagggcgtctatcaggagcaaatcttaacatcgcgcgtctcgatgctcgatctccttgaaaaatatgaagcgtgtgaactgccgtttgagcgatttctggagcttttgcgcccgctgaagccgcggtattattcgatttcaagttcgccgcggaaacatcccgggcaggcctcaattaccgtcggtgtcgttcgcggccccgcccggagcggtttgggtgagtatcgcggagtcgcttcgaattatttagcggaccgcggccctgaggatggtatcgtaatgtttgtccgcactccggaaacacgattccggctgccggaagatccggaaaaaccgattattatggtcggtcccggcacaggagtcgccccgttccgcggatttctgcaggcccgcgcggcgttaaaaaaagaagggaaagagctgggggaggctcatctgtatttcggatgcagaaacgatcatgattttatttaccgtgatgagcttgaagcttatgaaaaagacggaatcgtgacgcttcatacggctttctcccgcaaagaaggcgtaccgaaaacgtatgtgcagcacttaatggcgaaagacgccggcgctttaatttccatcctcggccggggagggcacctctacgtatgcggcgacggcagcaaaatggcgcccgatgtagaggcaacgctgcaaaaagcgtatcagtcggtccacgaaacagacgaacggcaagcgcaagaatggcttttggacctccagacaaaaggcatttacgcaaaagatgtttgggcggggatttgaccgatgtgatgaaaaggactggatgactccggtcctttttcctttaataaaatgaattgctttccaatcgatatacattcggcttgtccaaccacacctggtcaagatatcttccctgcttgactcccggaccttctattttggtcatttctaaaacctgcaaaaattgtcatcagaagtgtggcttaaaagttttaccgtatgttcctccgttagccagaaattcagacagccattgcatgctatctattgagttgaagatcagcaggcttctcttttttattaggatgcttatataaaggacgtctcatgctgtaatggaagcataccggcgcaaagagtcccatctgctgttcccaagactaaatagttgcgcctattttggataaaacctctttacaaatatatggaattagaatatactctgtttcacaaagtactttgcgaaaagaggagcctgtcttatgtcaaatcagaattttcgtgaatcagagatagctgaaaacttatctcatatcaaagtcttgacgaattacaagactgagtactcaaggcaaaccagtccatatttcattatttggggctgtatatggattattgcgtattccgtttctttatttaaggtactttctgtagtccttgcttgtgtctggttaatactggcagtattaggatggatactgactttgaagacatatcttaagcagaaacaatttgatcctatgcccactttcttaaagaatcaattaaaatatgcttggattggattcatattagtggtatgcatttttgttttcctgtttttaatgggattattgccgcgaacaggagaatttctatcgtttttgattgttttaatggtgtctattatgtacatattcttaggcatcgtgttaacaaaagagatttttgttatgggattttggctgagcatactcggtatgcttacattctgcctatttcctgatgcaatgaatattgtttttgcatttattggcggaggcagcctattacttacaggaatgattttgaaaagaaaagggcaaggaaatgagtaatgttaacaatatcaatgatttaatacatgccaaagtgcggttgggaattatgagtttattgatgacttatgatcaatgtgattttactttcctgaaaaagtcattagacatcacagatgggaatttaggttcgcatctgaaaaagttagaagatgcagcttatatagaactaaccaagaagttcgtatccaaaaagccgaagactattgttcagatcacgaaagaagggaaagcagcctacaaggagtacattaatacgattgaatccatatttaaaataaataacagtgggggcatggtgtaaatgctgcaagttgaacatataagtaagcgctatggcacgactctggctttggacaatgttgctttaacaattccgaaaggagtctgctatggacttgttggaccgaacggatccggcaaatctaccttaattaagatcatctcgcgcatcatccgcgaatatgacggtaaggttgaatttgtcggcaaggaaaatggcaggctgggttatgttccgcaggatatcagccttgaagaaaaattaaccgcaaaaaccaatatggaatttttcggaaagttacacaggctgaatggcttaaaactaaagcaaacaacaaaaaaactgttagaagatatcgggttgttagaaagggcaaacgacgttgtggagaacttttctggaggaatgaagcgccgtttaaatatcgggtgtgcattaatgcacgatccagacttaattattctagatgagccgacggtaggtgtggacccgcaatcacgccgctacatttttaaaatcgtaaatcgactcaaaaaagccggtaaaaccattatttatgtgagtcattacatggaagagattgaaactctttgtgactatgtagcttttatcgacagagggcaaattatcgatgaaggagaaataaatgaactgcttaaacgacatgaagaatcatctattatgtttaactcctcattgtctcctgaattaataaagagccatggttttgagttttcagtcgttaattcagggttgataataaaaaccaaagaacctttagaaaccatggagcgcttaattagggtcagtaaggaaaacaatattgtgcctcatcagttgtttttatataagccaaaattagaagatgtattctttaaacttaccggcactgatttgcgtgatgaagaataaagggggaatttatcatgttaccgctcgctcaaattgaaacgctaaaacagttaaaggataagtctctgtttttttggacgattatattacccattgtgtccatcatattgctgattgagctatttacgacagacagtgcaaacaaaactttagtagcttctcaatctgtaaccggcatgagcgtattcttttcaacattcattattatctccatcgttataagttttgtaaaggatcgggaaaaaggaattgtatcaagactggcaagtactcctttaaagccttataacttcttcttaggaaaaagtatcccttttttagtcataacttttatgcaaattcttctcctttccgttctgggaatatttctgtacgatattgaaattaataattttccggcgtatttgtgggttgttgtgttgatatctttactagttacatcctggggagttgctatttcggtctttgcaaagactgaaaataccggcttggtcatgacaaatgtgattgcattaggtaccgctgttgtatgtggtttatggactccttatgatcaattgccaagctatcttcaaactattggaatgctcttccctcagtactgggcgcatcaagggttaattcaatcggtctcgacgatatcgggaggagaaagtctagtatgggtaacatttgttgtactgggctatacaatactaggatttatagtttctctaattggatacagacattacattaaaatggcgagaaattaaacctccgtgagaattaagatattaaaacgcagctgggactaaaaggagagcgggaaatgattagtgaaaaactaaaactgtatgtcgaggctcaatttaaaaagtatgaaaaaaactcgttgttgaacagaaaaaaaacggagctaattcctttattggcgggtttgatgaaaccagttcacaatttttttcgctaatgagaaacagaaatttgcaagacgccttaaggaccagtgttggagaacagtttaagcagtcacaaatgccagctctgctgcatggttggattataaaaaacaaaaggtatacgtgaagaaagcatttttgtatatctttagggtctaagcgataatttgacagggaaaggactggatgactccggtcctttttttacctcacaaaaaaaaccttcaagtttttcagtccctttgcatacaataacttcagcccgcctgttgggcggctgtctttgatattcatttttcgtttttagaagtttgtgttattcttatatttggtatctcctagtttcagaccgggtctgatacggtaccttttaatgccagaaaaaaatgtgaaacgaagaacggatatcctgcgtctaatggctggcgggataagatgttcaatgggcatgacacgaatgataaatatatcgttttttaaaatggtgtgtttatggggctgtgtgatgctttcgttttgctcggaaagcaggaattgaagcaaaaagtaagaatacagatttaaagtgtttaggaaagtagaggttgccatgaagaaattattttcttacagacttagtttttttgtactggctattattttgttttgggccaaaacgtatttagcctatcatgctgaattcaaccttggggtgaagggtccgacgcagcagtttctgcttgtgatcaatccgttctcaagcgccattttctttttaggactggcattgtttgcgaaaggccgcaaatcagcgattatcatggtgattattgatttcatcatgacgtttattttgtatgcaaatatcctattctatcgattcttcgatgatttcttgacattcccgaacttaaagcaatccggtaatgtcggaaatatgggagacggcatcttcagcattatgtccggccatgatattttatactttgttgatattattattttaatcgcgcttctggtgtggagacgtgagctgaaggaattcaagctgaaaaaacggtatacgtcattaattatcgtgacgggtattgtgttgttcttcgtgaacctggcgattgccgaagaggaccgcccggagctgctgacaagaacgtttgaccgcaattacattgtaaaatacttaggcctttataattacacgatttatgacggcgtacagacggcgcagacggaatcacagcgggcatatgccagcagcgatgacctgacgagcgttgaaaactacacatcgtcgcattatgcgaagccgaacgccgagtatttcggcaaggccaaaggcaaaaacatcattaagattcacctggagagcttccaatcgtttttgatcaattacaaacttgacggaaaagaagtcacgccgttcctgaataaactcgcccgcggcggagaggacatgacgtactttgataactttttccaccaaacgggccaaggtaaaacatctgacgccgagctgatgatggataacagtctgttcggactgcctgaagggtcagccttcgtgacaaaaggggaaaacacgtatcaatcgcttcctgccatccttgaccaaagtgagggctatacaagcgccgttttacacggtgactacaaatcattctggaaccgtgaccagatttacaaacatatcggctacgataaattctttgacgccagcacatacgatatgtctgatgacaaccttgtcaatatgggactgaaggataaaccattcttcaaagaatccataccgaagcttcaatcgctgaaacagccgttctacgcgcatctgctcacgctgacgaaccattatccgtttacgcttgatgaaaaagacgcaacgatcgaaaaagcgaaaacgggcgacgcgactgtggatgactatttccagacggcgcgttatctcgacgaagcgcttgaacagttctttaaagatttgaagtcatccggtttatatgacaactcggtgattatgctttatggagaccactacggaatctctgaaaaccataaccgcgcgatgaaagaaattctcggcaaagaaattacgccttatcaaaacgcgcagaatcagcgtgtgccgcttatgcttcgcatccccggcaaaaaaggcggggtgaaccatacgtacggcggtgaaatggacgttgtgccgacgatccttcacttggaaggcatcgattctaagaaatatattaatttcggcaccgatctcttctcgaaagaccatgatgatacggtgacgttccgtaacggagattacgtcacgccgaaatatacttccatctccaatgtcgtatacgatacgaagacaggaaaagaactgaaaggcaatcaggaaacgaaaaacctgaaagccagagtcacagagcagctgaagctgtctgacagcgtgatgtacaaagacttgctcagattccacaaattgagcgactttacgccggttgatccgtctaaatatcattacggcaaagaaaagctgaatcaggataataaataatagaaagagccttacggaatttccgtgaggctctttttttgtgtgtatcttcaccaatctgaaaaaagagagagcttttggtcacaaagggcgccaatctctcatatcttacagtagattttgaaaccggtgatagagaatcggacaaattatcgggttggtttctcttatacgggcggtttcgaatccaatattcacagagaagaggggtagagatgaaagcagtcattctctgcggcggaaaaggaacgagaatgagcgaaatcaccaatgaacgtcccaaaccgctcgccatgataggcggcaaaccgattctatggcatattatgaaactctatcaatactatggcgtgaacgaatttatcctgcttcttggtttcaaaggagagatgattaaggaatatttcttagattatgactggaagaatcacagcatgacgctggacagctctaccggagaagtgcggatattgggaacatccgagccgtggaaaatcacttttttagacacgggggaacacacgcagacagcggggcggcttttacaggcgaaggacatcatcggtgatgaaacctttcttatgacgtacggggacggactggcgaacatcaacctgtttcatctgatcagctatcatcaatcaaaaggggctgcggcgaccgtcaccggtatagaaaagacctcgcaattcggaacgctgacggttgaagacggtatggcgaaaagcttttctgaaaaaaactcaagtgacggcatcatcaacggcggatttttcgtgctcagcccgaaggtatttgattatctgccgaaagacagggacgtcatgtttgaagaagaaccgctgaaggagctggcaaaggacggcgaattggcggtataccggcattacggtttctggacggcgatcgatacgtataaaaacctgctggaaatcaacaagatgtgggaccggggacaacatgtatggaaggtatggtgatcaagtttgagtttctggaaaaataaaaatgtgtttgtgacgggatgtacaggtcttttaggaagcagcttggtgaaggaactgatcgatcagggggctaatgtgacggggcttgtccgtgacactgtgcccaagtcgaacctgtatcagggagaacaagtgaagcaaatgaatatcgtgcacggcgcgcttgaagatctggatgtgattgagcgggcgctgggcgaatatgaaattgacacagtctttcatttagccgctcaggcgatcgtcggcgtcgcaaaccgcaatccgatttccacatttgaagccaatattctcggcacatggaacatccttgaagcgtgccgcaggcatccgctcatcaaacgggtgatcgtcgcgtccagtgataaagcgtacggcgaccagccgacactgccgtacgatgaaaacatgcctcttcagggcaaacatccgtatgacgtatcaaaaagctgtgccgatttattaagccacacatattttaatacgtacggacttccggtctgtattacgcgctgcggcaacttgtacggcggcggggatttgaacttcaaccggattattccgcagacgattcagctcgtgctgaacggtgaagcgccggaaatccgcagcgacggcacatttatccgtgattatttttacatcgaggatgcggtcgaggcataccttttgctggcggaaaagatggaggagctcaatcttgcgggagaagcgttcaacttcagcaatgagattcagctgacggtgctggaacttgtagaaaaaattcttaaggcgatggacagtgacctcaagccgaaagtgctcaatcagggaagccacgaaatcaagcaccaatatttatcagcggaaaaggcgaggaagcttctgaattggacgcccgcgcataccattgatgaaggattggaaaaaacgatcgaatggtataaagccttttttcaaaagtaacagaaacagaggtgagagaaagacgtgacaagcgcatattgcacagttttatcaaaaggaaggctgtatcaggctatcgctttgttcggctcattgaaagcggttcaggcggacgcccccatttttactttgtgtatggatcaagacacctatgacgtgcttcaggcaatgcggccggataatgtcaccttgattcaggtgtccgcactggaaaatgaggagctccttgaactgaagcggacgagggatcagagcgaatactgctggacggtgaagccggtatttctcgaattcgtgctggacggacatccggaattagagcgtgtcacgtacattgatgccgatttgtttttcttcgctgatcctcgcgcgatttttgacaatcagccggattgttcggtgcttctgtcacggggcgatatcgtcattccctcatttgaaaaacaggaaatcgacatgctgcagcgtcttttaggccggtataattccggttttctcagcttcaaaaccgacagtgccggcacagattgtctcagatggtggaaagaacgctgcctggaagaatgcaaaaatgcgccgggcgaaggaaaattcggagatcaaggctacttggattacatgtccggcctgttcccgaatgtgtgtgacatcaccacgcccggcgtgaatatcggccattggaattacggccgccacacgttttcatggaaggacgggcgtcttgtgctcgaagacggaagtccgctgattttctatcatttcagcggataccggatcgtcacagccagcgacattcggcagattcatgagacggaccggaccgacctgccgtttgtccatcagctttatcaggacattctgaagcgggtgatcgggacggtcagcgccgtctgcccggagttcagcggctttgcatctgaggatgataacaaataaatgatcatatacaggaagtgaacgaaaagtgaaggcaagcgtcattgttcccgcatataattccaaggagaggctttataacagcctgctgtccctgaatgaacaggaatgcacagagccgttcgaagtgattgtggctgacaacggttcggaagacggaaccttatccatgcttgaatcattcagcgcgaattttccgctgatttttgtaagaattaaagaaaacagagggatcgcttacggccggaatcaggcggtccgcaatgccagaggcgatattttgattttccatgacagcgacatgcttgccgaaaaggatttggtggcgaagcatatcaaggctcatgagaaccgggacgatcttgtcgtatgcggtatgttctggaagcggatttacagcttttattatgaccgttttgaaaaagagcataaggaaaaactcgccgaactgtatgaagagctgccgggcgataaagaggcgctccttgatgaaagtgacatcagagacggaagctttcttgaccgatgctttgatttagataccgactttatccgggtgctgaaaagcattttggaaaaatacggagatgatttgaacggctaccgtctgccgtggcgttttttcattacgaacaattcatcagttaagaggcagcacgtggcagatctcggcctgtttgatgaaggcattgtcagatacggctttgaagattatgatctcggcatcaggcttcatcagtcgggaatgagatttcagctgcggcgcgatatcatgagcgtccatcaggagcatccgagcaactgcgcttccgttgatgacatcagggcgaatatcgcgtacatgtgcgacaagtacaatgacattcattcgcttgacgtgcacctcgcgtttaacggaccgtttgacgcggagttaaccaacagcatgatggcagatatcgaagtgctgcttgattatgagaaatatgaaagcctgctgcacatttttctcgagctgctgcacgcggttaaagaccgcaaccttgacccggactggaagacgaaaagcccgcggatcacggcgaacagcttccagctgccggaggtcggaaagcttttggcaaaagcggaaaaaaagctgggcgtcacgcactttgcaagggcgttcaaagcgctgactgctgatttactgcatgtggatcttaaataaattggatgtgatatggtgagtaaatatcatttttcaaccattgtttccagaacgcatatctttaaactgatgccgatgattcattctctccatgagcattgccgggattttcatctgtatgtgctgtgtgtcgatcagaaagcgtacgaactgcttcagcaggtgccgtgggaacatgtcacggcggttcagctccatgaaatggaggacccggagctgcttgaagcaaagggcggccggacgtttcatgaatattgctggacgctgaagccggcttttctgttccatgtgatgacggagtatgatgaagccgaatattttgcccatttggacaccgatctctttttcttctcagatgcgggcgagctgtttgcggaaaagccggatgcttccctttttctgacggatcaccgcaattcagaacggtttgcgtcttattacaagctgacggggcagtacaacaccgggtttgtcggcgcgcggaataccggggaagcgtatcgggcggtctggcagtggagacaggattgcatctcctattgtacggtggagatgaatgaagaaaaaaagacatacggtgaccaaaggtatgttgaaaagtggcccgcgcagtttgaacacgttcatgtcacggagtcgatcggcgcgaatgcggcgctgtggaatattgagcaatatgacgtcagcctgcgcgacggggctgtatatgtcaatgacaccccgctgattttttatcatttttcaggctttacgctcgtcacggagaacgaattcaatctctgctggtactatcacattgatgacgaggcgacagtcagtatgatttacgtcccgtacatcaaaaacgtaaaaaaatggattgatgaaattcaaaaagcgtttcctgatttcagagacgggtttattccgaaatatgcggttcctgacactcatttttatacggttgaaacataaaatccctgccttttcggcagggatttttttatgaatgccattcttttaatgttttgtcgctcggcaggacaaaggcgagcagacctaaaacgggcagaaaggcgacggctgtcatggtcggcgtcaatcccgctgaatcaataagagctccgagcgcaaccgctccgatcgcgcccattccgaaggcgagcccgaccgtaagccctgacatcgttccgattttgccgggaacaagctcctgcgcgtagacaaccgtcacggagaagctggacatcagaacaacgccgatcagcgccagtacgccataggcgatgacaggtcccgcaaacggaaggaaaatcgtcaagggagccgatgccgtcatggaaacgatgatgacgttccgctttccgaaacggtctgcaagcggcccgccgagaaacgttccgacagctccgaaaaataaaaagacgaagatgtagctctgtgcctgctgaatgctgacatgataggcattcatcgcatagaacgtataaaagttgccgatcgcgctcacataccaggagcgcgcgaaaattaagaagataatcatgataagggcgagaataatcggttttgtaatgacggtctgcacagcggcggccggtgattttttacttacggcgcgcaaatgaatcaggcggcctttataccatttggcgatataaatgagaaacagcacagcgattgcggcgacaagcgtaaaccagacagagccgaattgaccgagcggaacgagaatcagcgcggtaatcaagggcgccatcgcctggccggtattccctccgacttggtaaatcgattgcgccaagccgcgcttttcgccggcggccatgtaagcgacacgcgatccttcaggatgaaagacggcggagccaaggccgataaaaaagacacagcataaaatcgtcagaaaagacggggcgaacgcgagacctaaaatgccgagcatgcttgcggtgagtccgagcggcaaagcatacggcatcgggcgtttatccgtataccagccgatgacgggctgcatcacggaagacaccatattcagcgtaaaggcgataattccgagctgcgtaaatgtaagattcatggaacgttccaaaatcggaaacatcgccggaatcaccgcttgcagtgaatcgttcagcagatgacagatcccgataatgaacagaatagaatacatggttgtctcgggacgatggacaggtttttctttaagcggggcggcaattgccaaagtgattctcctcctttttatgtaaacgaagcatacaccatattattcataaggtgaatgaattatcaagtgcaaaaaaggctcttctttctcaaacagaaaaaagagcctccctttttatttatttaacaaactgtgttttctcgaatacatcatataaacgacgatcccggcggcgatccagatgacaaaggcgagccatgtcacgcccggcaggctgcttgcgagatacaggcataagcatgcgctgatgatcggcacaaaaggcacgaaaggaacacggaaggaagatttgatctccggatgtttctttcttaaaacgatgacggcgatcgcaatgaccgtaaaggccgccaaggttcccatattgacgagatgcgccaaggttcccagatcaataaaacctgcgatcccggcggcaacgatccccgtcacccatgtgttttgaaacggtgttttaaaacgcgggtgaaccttggaaaacatgcggggcaagaggccgtctctgctcatcgcaaatgtaaggcgcacctgagcgtaaagcagagcgagcatgaccgttgtaatcccgataatcgcgccgacggaaataatgcctgctattttgttctggccgacaaattggagcgcgaaagatacagggtctccgacattcagcttggtatacgaaagcattcccgtcaggacaagcgataccgtaatgtaaaggacggtgcagatggcaagcgcgccgatgattccgacaggcattgatttctgcgggtttttcacttcttccgacgcgtttgacacggcatcaaatccgagatacgcgaagaaaacggtcgcggcgctcgtgatgacgcctttcattccgaacggcataaacggcgaccagttttccggtttcacgtagccgaaaccgacgacgataaacagcagaatgatcgcaattttcatcaatacaatgacattgttaaagcgggtgctttctttcacgccccttgaaacaatcgcggtaatgaccaagataatgataacggccggcaggttgaacacggcacccgttttgctgccgggtgcggcggtcagcgcctccggaagatgcagcccgaagcctgcaagaagcgactggaaataagatgaccagccggttgcgacggcggcgagcgcgataacatattcaagcattaagtcccatccgattaaaaacgcgagacactccccgagagtgacatatgaatacgtatatacgctgcctgaaatcggaatggatgaagaaaattccgcataacaaaacgcggcgagcgcgcaggcaaggcccgcgagcacaaacgacagaatcaaagccggtcctgcgcctgtcgcggccacagtcccggtaatcacaaaaatccccgtgccgacaacacagccgattccgagcaaaaccaagtcaaaagcgcttaacgagcgggacaggctggtctgtttgctctgggcctttaagtcggccagcggctttttccgaaatagtaaagacatatgggtcctcctgaaaattcataatattcttatcattatatacactgacgtttgtattatattgtcgaaatttctcgcagtcaattaaagaattttccactttaaaaggacaaagctaaaaagcgtcgatgcacggaaggaaagggaattttattgtgaaatagttcaattttctcaccttaagaccgatacaaaagatgactcatcaactaatttcaagtttcggtgaaagggagatgtttacatgtttcaatatgaagaactaaataagcagtttatcggcggccgatggagggatgggagcagccggaacgtattggaaaacagaaatccttatactcaaaaagtcatcacctcattccgaaaagcgacgcctgatgacgtggatgcggcatatcgcgccgcggctcttgcgaaacaagaatgggacaaagtaaacccttttaaaaagcgggccattttggaaaaagccgtttctttcattgaagagcacgaagaagcgattatttacttaatcatggaggagcttggcggaacacggctgaaggctgagtttgaaatcggacttgtcaaaaatatgataaaagaagccgcaacatttccggtgcggatggaagggaaaattctcccgtccacgattgacggaaaagaaaacaggctgtacagaatacccgccggagtcgtgggggtgatcagcccgtttaatttcccgtttttcctttcgatgaaatctgttgcgccggcactcggcgcggggaacggcgtcgtgctgaagcctcatgaagaaacgccgatctgcggcggaacgcttatcgcgaaaatttttgaagcggccggcgtaccggacgggctgctgaatgtcatcgtgacggatatcggggagatcggcgacagctttgttgagcatcccgtgccgcggataatctcatttacaggttcaaccggagtgggcagctatatcggacagcttgcggtcaaacactttaaaaaaccgctgttggagcttggcggaaacagcgcgctgatcgtgcttgaggatgctgatcttgaatacgccgtcaatgcggccgtattcagccggtttacgcatcaaggccagatctgtatgtcggcgaaccgcgtgctcgttcacacatctgtatatgacaaatttacagagctttacgaagcgaaagtgtcatcgctgaaagtcggcgatccgatggaccctgatacggttatcggtcctttaatcaatgagagacaggcggaaggtctgagacggtctgtcgaaaaagcgatagaagagggagcggttccggtgctgtccggccgattcagcggaacggtcgctgagcccgtcattttaaaagatgtgaaacctgagatgagcatcgcgaaggaggagctgttcggaccggccgtctgcatcatgccgtttgaaacggaggatgaagcggtaagcatcgcaaacgcgacaccgttcggtttaagcggagccgtgcatacggcaaacgtggagcggggcgttgagtttgctaagcggatcgaaaccggcatgattcacgtcaacgatacgaccattaatgatgaaccgaatgtcgcgttcggcggcgagaaacaatcaggtctcggcaggctgaatggcgaatggagtcttgaagaattcaccacgctgaaatggatttcggttcagcataaaaaacgtcaattcccatattaagaaggagtgaaagaaatgagtatacagacggagcagcaaacgcacagcctgcttgacgcttttgtcaaagttgcgccttttttaaacagcctgatccaagatgacatcaccatcggaatttatgatacagaaaaattaatcgtgaatattccggctaaaacgttttctcttaatgtaaagccgggagacccgctgcaaaaaggggacatcattacagacgcgatccgcatgaatcagaagaagacaagcatggtgccgaaagagctgttcggatttccgctgatcgccagagcgattccgcttcatgatgaaaacggaaaagtcatcggcggcgtcggtctcggcacgagccttgaaaaatcagccaagcttcatgatgtcgctgaaagcctgtccgccgtcgtggaacagaccgcttcggccatcgcggatatctcagaatccatcaacggcttttcagcacagatgaccggaatttccgctcaggcgaaacaagtcagtgaaagcgcgggagaaatcgctgacatttccgtcactgtcaagggcatctcggatcaaagcaatctgctcggtttgaatgcggccattgaagccgcgagagcaggagaatccggcaagggcttttccgtggtggcggatgagatccgcaagcttgccactcattcaaaagacaatgtcggccaaattgaccagattacgaaaaaaatccacagcctgctgaaagggctggaggactcaattgaatccatcaaccagaacacggacggccaagcggcggcggttgaacaaatttctgccacgatgcaggagatttcaggaagcgcccagcatttagcgaaaatggctgaaaacgttctcggagaatcataaaaaaaggggagcttacgggctccttttttgttttccctttatcaagcggaaactgcacttacacgtttgatccgtcatgctaaaggggtacacatacgaatacatcaccaatgataaaggagagtcttgtatgtctgatgcaaatctgcacaacccgctgacgaaatatgatcatgatgaatttccaaaacaatatcaagaaccgcccggcttgcagaaagagatgaagcctgtgccggattgcggtgaaacaagctataaaggagccggcaagctgaagggaagaaaagccctcgtcaccggcggcgattcaggtatcggccgggccgccgcaattgcttatgcccgggaaggggcggatgtggccattaactatctgcctgaggaacagccggatgcagaagaagtgaaagcgttaattgaaaaagagggaagaaaagccgttctgctgccgggagatttaagcgatgaagcgttttgcggagaattggcggaaaaagcgtatcaagagcttggcggtcttgacacgctcgctcttgttgccggcaaacagcaggcagtggatgatatcagcgatcttactacagaacaaatctatcaaacatttgaagtcaacgtattctcactgtattggctcgtcaaagccgcgcttccgtatctgccggaaggcgcgtctattatcacgacaacgtccgtagaagggtataatccaagcccgatgctgttggattatgccgcgacgaaacatgccattatcggttttaccgtcggcctaggaaagcagctggcgaataaaggaatcagagtcaactcggtagcgccggggccgatctggacaccgctgcagatttcaggaggacagcccggtgaaaacattccgaaattcggcaaggaaacaccggccgttccattacagcgtgccggacagccggcggagctggcaggaatttatgtctttttggcctcagaagaatcgagttatgtgacatcccaaatttacagtgtaagcggaggaattccgacagcgtaatcaaaaaggagctgcccttcatacgggggcagctctttttttcgatgttatgtgccgaggacgttttgattatacaggacactcggatgtgacggatgataggaggcggctttgtcgttatgaatcttcgctttttctctgtcgccgagctgccagtggcagacgcagagctgcagatgggggtaccaggtggaatattcgagctgggtaaagcctgcatcactgcttttggcggatagggcgagctcataccaaaacacgccctgccggtattgccgtttctccgcaaaatagtcgccgagcctgcagcagaactccggccgcggacaatcgatcagaaatgattttaagagagacgtcatggcggcctcttcatggccgaccgccctgtagcaatcggatagatattggcacgttctgatctcgtcttcgatccagcactgttttgtggaaagaaaatggtgataatacgtaatggcgcgctgatactggccgtgatcctttaattcattcgcgaagtaaaacaaatcgcgcggtgtcatcgtttcactgttttccgccattttctcataaatcttcaagttgcggtccgagggaggcgagtgctttttctcggatttccggtgtgtgacggcaatatcggtttctatgatgtttccgtatacttcaagatactcatgcacggctccgatccagcggaatcctttttcacgcttgacgagtcggttgcggcggtatctgaagctgacctctccccgatcatcaaagccgacgtgataatacatggataccgcgtccacctcttttgaaagcgacgcctttagttcaatcagcttttcacggtccttttccgtcagcatatcgtcggcgtccagccacagaatataatccatttccgctttcgaaaacacaaaattacgggcggccgcaaagtgatcgatccattcaaaatcataaatcttatccgtataacgggccgcgatttctttcgtccggtcggtcgagcccgtatcagcaatcacaatttcatccgcaatgtctttgacggaatcaagacagcccgcaagcacctcctcttcatttttcacgataacgcacaaactgacgctgatcatgtcatcacctcttcccctccagtgtataaaaggagaggcggaaacattcttcggacaaaatgatctcttccaggaaatttgtctgtccttttactagttttattccagcgcctgatttaaaatgaacacatgaacttacgtgaggattgataggaaccatgagcatcataaaagcggaaaacctttataaaacatacggagataagacattattcgaccatatctcctttcatattgaagagaatgaaagaatcggtttaatcggcccgaacggaacggggaagtctacgcttctgaaaaccattgccggccttgaatcaacggaggaaggcgagattacgtcttcaggaaacgtgcatattgagtttttgcatcaggaccctgagcttccggccggacaaaccgttcttgaacatatttattccggcggattagccgtcatgagaacgatgagagaatacgaaaaagcgcttcaggcgctgaatgaagaaccggaaaatgaccagcgccagaaacacctgcttgatgcgcaggcccaaatggacgcgaatgatgcgtgggaggcgaatacgttagccaaaacggttttaaccaaacttggcgtcaccgatctgatgaaggatgtcagtgagctgtccggcggccagagaaagcgcgtcgcgattgcgaaaaacatcatccagccggctgacctgctcattttagatgaaccgacaaaccacttggacaatgaaacgattgaatggctggaaggctacttatcgcaatatccgggcgccgttatgcttgtcacgcacgacagatattttctgaacagggtgacgaacagaatttacgagcttgagagaggcagcctttatacgtataaaggaaactatgaagtattcctggaaaaacgggccgaacgggaagcgctggcggagcagaaagaaacaaaacgtcaaaacctcctgcgccgcgaattggcgtggctcagaagaggagcgaaagcgcgctcgacgaaacaaaaagcgagagtggacagagcggaggcgctcaaggagcaaaaagggccggcagtctccggatcactcgatttcgcgatcggttcccaccgtctcggaaaacaagtaatcgaagccgataacgtcgccattacctataacggccaagcgctgatcagccagtttaatgagcttgtcatcccgggggaacgaatcggcatcatcgggccgaacggaatcgggaaaacgacacttttaaacagcctcgccggcagaattcagcctgacagcggtaatatcaccatcgggcagacggtccggatcggctactacacccaggatcacagcgaaatgaacggtgatatgaaagtcattgactatataaaagagacggctgaaatcgtcaaaacggcggaaggcgatgtcatcaccgcggaacaaatgcttgagcgttttctgttcccgcgtccgatgcagcagacatatatcagaaagctgtcgggcggggaaaagcgccgtctgtacttgctgaatgtactgatgcaggagccgaatgtgctgtttttagatgaaccgaccaatgatctggacacagaaacattaagcgtgctcgaggattatatcgaacagttcccgggcgtcgtcatcactgtatcccatgaccgctatttccttgaccgcgtcgtggaccgcctgattgtatttgaaggacacggcatcatttcccgtttccaaggttcgtacagtgaatacatggaacaagcaaaagcgaagaagacggcggtaaaacagccggccgaagaaaaaaaggcggaagaagagccgaagaaaaagcgcaaaaagctttcgtacaaggatcagatcgaatgggacggcatcgaagacaaaatcgccggccttgaagaaaagcatcagcgtctggaagcggaaatcgctgaagcgggaagtgatttcggaaagatacaagaactgatggccgaacaggcaaaaacggctgaagagcttgaagcggcgatggaacgctggaccgaattgtcactgatgattgaagaacttgagaattaagaaaagccggtacggcccccgagaagacggcgggtcataccggctttttgttttaaacaaatgtctcccggcgctttaaagacaaaggttccgtccaagctaagtttattcggcataaaaagtttacgtttacgttaaggttcaaatggtgtataatagaaacagatacgacaagagggggattcaccttggaatggatgaagattgatcaagttgccaagcgaagcggactgacaaaacgaaccattcgtttttacgaggagattggtttgattcctgctcctaaacggacagaaggcggcgtccggctttactctgaagatgatatggaggagctcgaaaaagtcaccagcacaaaagaagtgctcggtttttcccttcaggaacttcagcagtttatggagatgagccgtcagctggaattaaacaaagaggggtacttgttgtcactggatccgaaggaacggaaagaaaagctggaagagattcagcacgctttgaaccaccagcttgagatgattgatgagaagatcagcacatttcagcattttaaaacgcgccttaacggaatgaaagaaaaagctgaccgcgccattcaatcaatcgaatgattttgctgtaaacgctatggatatagcgtttcttttaatggataaaacaggaggtctggtcaaatggatacatcatcacaacagaaaacaggcttattcagccagccgaaagccgtttgggcggttgcgtttgcctgtgtgatttcctttatgggaatcggtcttgtcgatccgattcttccggcgatcgccgcacaattacatgcttcacctagtgaagtatcactgttatttacaagttatttgctcgttaccggttttatgatgtttttctccggcgcgatttccagccggatcggcgcaaaatggacgctgcttctcggacttatttttatcatcgtgtttgccgctctcggcggaagctcaagttcaatcgctcagcttgtcggctatcgcggcggctgggggcttgggaatgctctctttatttcaaccgcgcttgccgtcatcgtcggggtatctgtcggcggcagcgccaaagctattattctgtatgaggccgcgctcggactgggaatttccgtcgggccgcttgccggcggagagctaggcagcctttcatggcgcgctccgttcttcggagtgtctgtcctgatgtttatagcgctttgcgcgatttcactcatgctgccgaagctgccgaaaccggcgaaacgcgtcggtgtgtttgatgcgatgaaggcgctcaaatataaaggccttttgacaatggcagtatctgcattcttatacaactttggattttttattttgcttgcttattctccgttcgtgctggatttagatgaacacggtctcggatatgtcttcttcggctggggccttctgctggcaattacgtcagtctttacggcgccgctcgtgcacaaagcgctgggcacagtgcgttcgctcgtcgttctctttatcgcctttgcggccattctcgttattatgggggtctggactgaccatcagacgttgatcattacatgtatcgttgttgccggtgctgtcctcggtatggtgaatacgatcatgacaaccgctgtgatgggtgctgcgccggttgaacgttcaatcgcgtcttcagcctacagctcagtccgctttatcggcggtgcgctcgctccgtggattgcgggaatgctgtcagaacacttcaccgcaagcactccatatacagtaggcgggatcgtcgtttttgtaggcatgcttgtccttctcatgggacgcaaacatctcgccggaataaaagccggacattaagaaaaaaaggaacttccgcacgggcgggagttcctttttgtgtttacagcacttttgtcgtccaagactcacaattccatgtttccgtcgcgatatccatgtaaaactcgggttcgtgggaaatcagcagaatggagcctttgtattctttcagcgcgcgtttcagctcttctttcgcatcgacatccaggtggtttgtcggttcgtcaagcacaagtagatttgtttctgaattgatcagcttgcacagtctgaccttcgctttttctcctccgctgagaacggagacgcggctttcaatgtgtttggtcgtcaggccgcatttggcgagggcggcgcggatttcgtactgggtaaaggaaggaaattcgctccacacttcttcgatgcacgtattgttattggtttctttcacttcctgctcgaaatagcccgtgtattgatgctcgccgcgctccaccgtgccttccagcggctggatttcaccgagcaggctttttaacagcgtcgttttcccgatgccgtttgcgccgtacagggcgactttctgtccgcgctccattctgagattgagcgggcgtgacagcggagtatcgtaaccgatgactaagtccttcgtttcaaaaatgagcttgcctgacgttctcgcaggcttgaaatggaattccggtttcggtttttcggccgccagttcgatcatatccatcttatcaagctttttctgacgggacatcgccatatttctcgtgctgacgcgggctttgttgcgggcgacgaaatctttcagctcagccacttcctgctgctgttttttataggcggcttcgagctgctgttttttcacttcgtagacttccataaactgatgataatcaccgacataacgcgtcagctcttgattttccacatgataaatcaaattgattacgctgtttaaaaacggaatgtcatgggaaattaagatgaacgcattttcatattcctgcaaatagcgtttcagccattcaatatgctgttcatcaaggtagttcgtcggttcgtccaacagaaggatttccggcttttccaaaagcagtttggcgagcagcactttcgtccgctgtccgccgcttaagtcagtgacgtcgcggtctaggccgacttcctgcaggccgaggccgcgggcgatttcttcaactttgctgtcaatcacgtagaaatcattgtttgtcagggcgtcctgaatgacaccgacatcttcaagcagctgctcaagctcatcagggtccgcttcgcccattttgttgtaaatctcgttcatttcttcttccatcgcaaataagtaatggaacgcatccttcagcacgtcgcggatcgtttttcctttttcaagcacggtatgctgatcgagatagccgacacgcacgtttttcgcccattcaaccttaccctcatcaggctcaagctttccggtaataatattcataaacgttgatttaccttcgccgtttgctccgattaagccgacgtgttccccttttaaaagacggaacgatacattgttaaaaagcgcacggtcaccgaagccgtggcttaaatcttttacggataaaatactcatcattacacctctatcgttatcagacacgctttttttatcatgtgtctttctcatttatgattataaaggaggagaccgtttgttaaaaggcttggaaggaaaaagaaaattgcgtttgccgcgtgcatttgagatactatggagtagattttaagaattgaggagaacgacatgacccaaacatggccatttttacagcatacacaaccatttatcgccgaaaactgggaggcgtcaggttttcaggagccgaccgttattcaggaaaaagccgctcaggtgatcatggaagggaaagacgtcattgccgaatccccgacgggaacgggaaaaacattggcgtacacgcttccggttctggagcggatcaacccggaacagaaacatccgcaagtgatcattttagcgccgtcccgcgagcttgtgatgcagatttttcaagtgattcaggagtggaaaaaaggctccgatcttcgcgctttgtctttgatcggcggggcaaacgtgaaaaagcaggtggagaagctcaaaaataaaccgcatatcattgcaggcacaccgggcagggtgctcgaattgattcaggcgaaaaagctgaaaatgcatgaagtcaagacgatcgttcttgatgaagcggatcagctcgtgacaaaggaacaccgcgaaacgatgaaaaaaatcattaaaacgacgctgaaagaccgacagcttttaagcttttccgctacgctgcagccggagacagaagaggtgctgaatgccatcgcacatgaaccggccgttttgaaagtggagcggaatacggcggaaaaagcgcgcgtcacgcatcaatatctcgtctgcgatcagcgggataaagtgaagctattgcaaaagctgtcacggctgaacggcatgcaggcgctcgtgtttgtcagagatatcggaaatttaagcgtctatgcggaaaaactcgcctatcatcacgtggatctcggcatcctgcacggagaagcgaaaaaaatggagcgggcaaagatattatcagcgtttgaagggggagaatttccgctgcttctggcgactgacatagcggcgcgcggacttgatatcgatgatcttccgtacgtcattcacgcagacatcccgaatgaagacggatatatccacagatccggccggacggggcgggccggtaaagaaggaaccgtactcagccttgtcacgccgatggaagaatccaaattgaaaaaaatggccaaatcactcggaattgagctgaaagaggccgtttattcaggcggaaaattatctgagaaataagaaacggagggcgggaagcccttcttttttcattgtaaaataatagaaaaggttcgggcaggggagtgggaagatgggttcaatagaccgatttcaaatattgaaggaacgtgagctgaaaatacttgaacactggtttaagaacgataacatcagacggagaatggatgcgatgctgccattagacgcgtggtatgcacgattgaataaagatgaagacgatactgtcattatggcatatgacgggcagcttccggcaggaatggtctctatagagtttgtggaggaacgggcgtatatcggattgatcgtcaatcctttgtaccagcttcaagggtacggaaaacagattttgcaaaaactgctgactgatcctgggtttaccggcgtgcgggaatgggcggcaagcatcgaaaaagacaatcaaatcagtttagcctgctttcaagcagcgggattcactttggaagatacggagcctgatgaagacggctttctgactttgattcttcgcggctgatgcgaaaaagcaaaaggaggggacaaagccctccttttttcatcatcatgttaacttagatcactgactttgatgatctgtttgcctttgttttctcctttaaacaggccgaggaacgcgtcaggaatatggctgaatccttccgtaatcgtttcttcataatgaagcttcccgtccttgagccattcggccaattgtttcgcgccttcggaaaagcggtcagcataatcactgacgatgaacccctgcatcagcgcttttgttttgatcagcttcggctggacgcgggggcccatgtcttcctcttcactttcggtattatatgaagagatcgctccgcataccggaatgcgggcgaattcattcagcaggtttatcaccgcatctgaaatcggtccgccgacattgtcaaaatagacatcgacgccgtcagggcatgcctgttcaagcgctttttgaatatcatccgccgttttgtaattaatggcttcatcaaattgaagctcctctttcagatacgcgattttttcgtcagaaccggcgatgccgacaacccgcgcgcctttgattttggcaatctgcccgaccgttgagccgacggcgcccgcagcccctgaaacgacgacggtttcgccctttttcggacggccgatatcgagcagcccgaagtaagcggtcagtccggtcatccctaaaatgccgagatacgcctgggcgggtgcgatatccgtatccaacttgcggagggcggactcattgacggctgaatattcctgccatgcgagatttccgatcacaacatctccttttttcagcttatcgccgtctgtcagaacttcggcaatcactccgcctgttatggcttcatctaaagcgaacggctctacatatgattttgtatcctgcatccgtccgcgcatgtacggatcaacggacacataactcgttttcacaagcacttcgccgtctttcggttcgggaacggcaatcgtttcaaagcggaaatcgtcatggacgggaacgcctttggggcgtcttgccaattgaatctgctgctgatttttcggcatgatgcatcctccttcaacatgagtgtttgttccaaatgtaacacgaaccatttcccgaatacaaaatcaaaccgtccgccggcaacaaaaaaagaagggccagggcccttctttccttatatgcgtatttaaaagaataaccggtacacatcggtgtttttctcatgttccaaatattcataggcattcgtttttgaagaatgaagcatgtcagcggtaatgacgggctgaagcgcggtcagataagaacccagcttattttcaatttctttcggcagaacggattcgatatcaccgatattgataatgatagagaaaacgaaatcgatattaatatgaaaagtatcttcagcaaagaccgtaagctcttttattccatccgggcagcgggtatgccggcggaatacctgcttcactaaatcactgacaacccaagcgttaaatcgctgttccggtgaaaagtaatgaataggaaccacctccctgcttaatcggctcatgaagatttttatttttctgaaaatgtagctttccctactgtaacatgtcccgccggaaaatatccaccgacaatctgcccgttttttcccggaactctctttcttttgtttgacctttggttgagcgggtaaacatccaatatacaaaaacaaaagggaggacttatcaatgaaaccggtagtaagagaatatacaaatgatcaaaaactgatgcaggacgtaaaagagcttcagcaattgggtgtcgcaaaagaagacgtatatgtgctttctcatgatgacgacagaacggaccgcctggcagataatactgatgtcaataccatcggagcgaaagaaacgggcattaaacacgcggtcggcaatatgtttaataaaaaaggcgacgagctccgcaacaaaattcacgaaatcggcttttcagaagaggaagcatcacaatttgaaaagcgcttagatgaaggaaaagttcttctatttgtcacggataacgaaaaagtaaaatcatgggcgtaagctgaacagatcccaaggggttttcggtcccttgggatttttttgcggtttccgcaataaaaccgaaaggcacatgctgtacattttcggtgccgtttctcaactgatttgatagaattcaattgtaataaattggaacgaaaaatcaggaggagtacaattcatgaaaaaaatgttatttatgctggcggtttgtttatgtatgatccctgcggacgtctatgccgctgacctgggacggcagacgttaggaacaaatgacggctggggagccgcttccggcgggacaaccggcggcgcgaaagcctcttcatcgaatgtctacaccgtatcaaacagacagcagctcgtttctgcattagggggaagcgccaacagcacgccgaagattatttacatacaaggcacaatcaatatgaatacggacgaccggaataaaacgctcggctttaatgattataaagatccggcatatgatctcaacgcttatctgaaggcgtacgacccggacaaatgggggaaaaaagcgccgtcaggcacccaggaagacgccagacagcgatctcaaaaaaaccagaaagcacgggtcgtgattgacattccttcaaatacgacgatcatcggttcgggttcaaatgccaaagtgacaggcggaagttttaatataaagaacggcgtcgacaatgtcatcatccgcaacattgaatttcaagacgcttacgactattttccgcaatgggacccgacggacggcagcagcggcaactggaactcggaatatgacaatatcaccattaacggcgcgacgcacatctggatcgatcattgcacctttaatgacggatcgaatcccgacagcggttttccttactattacgggagaaaatatcagcaccatgacggccagacggatatagccaacggggcgaattatattacattgtcctataataaatatcatgaccatgacaaaggctccgtcatcggaaacagcgacagcaagacgtcggatgaaggaaaactgaaggtgacccttcaccataactattaccagaacatcgtccagcgcgcaccgcgggtccggtacgggcaggttcatatttataataatttttacgcaggctctaaaagcgccgcatacccgttcagctatgcgtggggcgcaggccacgcgtcaaaaatatatgcccagaataatgtctttgaagtgccgggactggctgctgataaagtcatcagcgtcttcagcggcggaaaagcgcttcatgaagacggcactcttttaaacggcgcctccatcaacgcgtcagccgccaacggattaagtcagtccgtcggctggacaccgtcattgcacggttccatcggctcatcatcaaatgtaaaatcagatgttatatctaaagccgggtcgggtatattaaaataataaacaagaagcacaaaggaaaatattcctttgtgttttttaattaacaaaaacgtttattaacttagttaagtagtaaaatgggataggggatggaagacaacaaaataggaggagacctgtaatggcttcagaaaaagacgcaaaaaaacagcaggcagtaaaaatcattcctttgcttattactgttgctgtgggattaatcatttggtttattcccgcgccgtccggacttgaacctaaagcatggcatttgttcgctatttttgtcgcaacaattatcggctttatctccaagcccttgccaatgggcgcaattgcaatttttgcattggcagtcaccgcgttaacgggaacgctatctattgaaaatacgttaagcggatttggaaacaagacaatctggctgattgtcatcgccttttttatttcccggggatttatcaaaaccgggctcggcgccaggatttcttacgtattcgtacaacggttcgggaagaaaacactcggcctttcttattcactgcttttcagtgatttaattttatcacctgccattccgagcaacacggcacgggcgggcggcattatttttcctattatcagatcattatccgaaactttcggatcaacgccggcagacggaacagagcggaaaatcggcgctttcttattaaaaaccggttttcaaggaaacttgattacgtctgcgatgtttttgacggcaatggcggcgaacccgctgatcgccaagctggcccacgatgtcgcaggggtggacatcacatggacaagctgggcaattgcggccattgtaccgggattggcgagcttaatcattacgccgctcgtcatttataagctgtatccgccggaaattaaagaaacaccggatgcggctaaaatcgcaacggaaaaattgaaagaaatgggtccgtttaaaaaatccgaactctccatggttatcgtctttttattggtgcttgcgctgtggattttcggaggaagcttaaatatcgacgcaacgacgacggccctgatcggattatccgttttgcttttgtcacaggtattaacatgggaggacatcaaaaaagaacaaggtgcatgggatacgctgacttggttcgcggcgcttgtgatgctggcgaattttctgaatgagctcggcatggtgtcttggttcagcgatatgatgaaatcatctgtttccggtttttcatggattgtggcatttatgattctgattgtcgtgtattattacacgcattacttctttgcgagtgcaaccgcgcatatcagcgccatgtatgcggcatttctcgccgtcatcgtggcggcaggcgctccgccgctgttggcggcgctcagcctggcgtttttcagcaaccttttcggttcgacgacgcattacggctcaggagcggctccggtctttttcggagcgggttatatatcgcaaagcaaatggtggtccatcggctttatcctgtcaatcgtccatattgtgacatggcttgtgatcggcggattatggtggaaagtattagggttatggtagaagaaaaaaggcagactcaggtctgcctttttttatttcggtaaggaatgggaagggcctgcacatgatgacttcaatgcgaatagaatattgccggggtgatattatgagcagcggccgtaatcaatacatgatattgaaacagaaaccttacaaatatatgagcagacatatgaaacgccggtatgaacaattaccatgtgaacttgaaagtccggaaacagggacggaaaaacggtttccgtcttcagatgaaaatcgatctgccttgtgcgtacccgggctgcgaggtcccgaaggcaaaagaggacccgccggctcccgcggtccgcaaggggaggcgggtccgcccggtcccccggggcctgagggtccgccgggagcggttcctgcggtagcttttcaaaatacagcagaactaatgacgattccgttagaaggaacaccgataaacgtgttaagcgcagtgatagctgcgccgacagatcaattggtgaaaacggatgccgtcatacaagtaaatgtggaattagatccgctcgcgtctcatttctcattggtcttagctgtcgagctgcaaagaaatggcgtatcgatacaaacacagagacaagagaggaacctcttttcttcaggcgggcaaatcataggaattccttttacgtacatcgacgaaatgaaggcggatgaaacagccgcgtatcagctctatttatccgtcctttcttcgaactacgtaacacaagtcgcagcggcaaaccgctccctcattgcgacgggattccccattcaaggatcagattaaggtgatgaaaagaaatcaccttttttatttaggttgtcaaaacacagcccgtattaatatgctgtcttaataagtaagacggtcaacaacgggaaggagagggaaaaagattgaatgaataatccgattataaacggaagctttgaaaccggcacattagcggggtggagttcggcaaatacccagattaacagtttgtttgcacattcagggagatattctgcgcaatttattggagctcagccatatgcttacctcagtcaaatcgttcccatttcagccaagtcagtgactctattcgtatcactcgcaacgctcggaaatgagccaagtccccaagtcactctccagatcatctatgtcagcgcagcaggtgaacaaatcagttccattcaagaaaatatcacacccggaaatttgccgaacgtgctctttcacacatggtctgaaatctataaaacaagcagtgtgccttctggcgcagcctctgccgtcattgtattaagtaaagtttcttccggcacggttttaatagatgacgtttcattggcgcaaaccgggggtgaacctggcgtaacaggaattacaggtcccacaggagtgacgggtcccacaggagtaaccggagcaagaggagcgaccggagtaactggtgcaacgggagtaagaggagcgacgggtgtaaccggcccaaacggagtaactggtccgacaggagtaactggagctaccggctcgactggtgtaacaggagcaaccggaatcacgggctcaaccggagtaacaggctcaaccggtgcaaccggagtaaccggaataacgggaacaaccggagtgactggtgcaacaggagcgaccggagcaattggttcaaccggaccgacaggctcaacgggagcaaccggcccaaccggagcaaccggctcaacaggtccaactggagtaacaggtgcaacaggatcgacaggcccaaccggcgcaacagggccaacaggtttaacaggagcaaccggcccaaccggagaaactggtgtgactggcccgattggggtcacgggatcgacaggagcaaccggggcgacggggataaccggctcaaccggagtaacaggtccaacgggagagatcggccccaccggagtaacgggtccaactggagtgactggctcaactggtgtaaccggccgaaccggaataacaggctcaacaggaacgaccggcccaaccggaataacaggtccaaccgggccaacagggtcgacaggttcaactggagtgactggtgcagcaggatcaactggacccacgggagagatcggtccaactggatcgtcaggctcaactgggattaccggcgcaacgggatcgacaggagaaacaggcgcgactggctcaacaggagtaactggagcaacgggtgtaaccggttcaaccggcgcaaccggagcgacaggtacaacaggccgaactggttcaacgggagaaaccggagcaactggagtgactggtgcaacggggataacaggagcgactggagcaaccggaataacaggggcaacgggtccaacaggatcaactggttcaacgggagaaaccggtgcaactggagttactggctcaaccggagtaactggtccaactggtgtaacgggatcaacaggtgtaacaggagcaaccggtccaacgggagagaccggtccaatcggatcgacaggaccaaccggcgcaacagggccaacaggtttaacaggatcaacaggagcaaccggaaccacgggctcaactggagtaacaggggcgactggagcaaccggctcaaccggagtaacgggtctaactggtgtaacgggctcaactggtgtaacaggagcaacgggatcgacaggctcaaccggcacaaccggcacaaccggcacaaccggtgtaacgggagtgactggggcaacggggataacaggagcgactggagcaaccggtccaactggagttactggggcaactggagaaactggctcgactggagaaacaggaccgacaggaccaaccggagaaactggctcgaccggggataccggagctactggagtaaccggcccagcaggagcaacgggatcaaccggcgcaacaggctcaaccggcgcaacaggggcaacgggggtaactggagaaatcggcccaacgggagaggccggtccaaccggatcgacaggcccaaccggaaccacgggttcaaccggaatgactggagtagcaggaacaaccggttcgactggtgtaaccggtgcaacgggagaaactggcccaaccggcgtaactggtgcaacaggagtgactgggtcaacaggagtgactgggtcaacaggagaaaccggagcgaccggtgtaacagggtcaacaggaataaccggagcgaccggtccaaccggagcaacaggtgtaacaggagaaaccggaaccacgggatcaaccggagtaactgggacaatgggagaaaccggtgcaactggagtgactggagcaacggggataacaggagcaacaggcgcaactggtgtaaccgggctaactggaataacaggcgcgacgggcccaaccggtgtgactggaccaacaggggttactggctcaacaggagaaaccggttcaactggagtgactggcgcaaccggtacaaccggaatgacaggcccaacaggagtaacaggcccaaccggtccaacgggtgtgactggagcaacgggagtaactggggcgaccggagaaaccggcccaaccggaatcacgggtccaaccggagtaaccggggcgataggagaaaccggagaaacgggatcgacaggcacaaccggcccaaccggtgtaacgggagtgactggtgcaacagggccaacaggagcaaccggagaaaccggagcgaccggtgtaactgggtcaacaggaataaccggaccgactggctcaacgggagaaaccggttcaaccggagcaacgggtgcatccggggcgaccggcgcaacgggaataactggagaaaccggagcaacaggagcgactggggtaactggtgtaaccggatcaacaggctcaaccggaataacaggggcaacgggtccaacaggggcaactggtttaacgggagtgactgggtcaacaggagaaaccggcccaactggggtcacgggctcaactggtgtaacaggtccaacaggatcgactggcgcaaccggagcgatcggtgtaactgggtcaacaggaataaccggagcgactggtgcaacaggagcaaccggtccaacaggagttactggagcgaccggagaaactggggcaacgggagaaaccggtccaaccggagtaacaggagcaacaggatcgactggaccaacagggctaacaggtttaacaggatcaacaggagcaactggaaccacgggttcaaccggaataactggagtaacaggaacaaccggttcgactggtgtaaccggcgcaactggggcagcaggagaaaccggtgcaacgggagtaacgggagtaactggagcaaccggtccaactggagaaaccggcccaaccggtgcaacgggggtaactggagaaattggcccaacgggagagaccggtccaaccggagtaacaggagcaacaggatcgactggcataacgggttcaaccggcccaacaggtgtaacaggttcgaccggagcaaccggcccaactggagtaacaggttcaacgggagaaacgggtccaaccggaatcatgggtccaacaggagtaaccggtgcaacgggatcgacaggctcaaccggagcgactggtgcaacaggagcaaccggtccaactggagttactggagcgaccggagaaactggggcaacgggagaaaccggcccaacaggagtaacaggagcaaccggttcgactggtgtaactggtgcaacaggagaaactggggcaacgggagaaaccggtccaaccggagtaacaggatcgacaggaccaacagggctaacaggtttaacaggatcaacaggagcaaccggaaccacgggttcaaccggtttgactggggtaacaggctcaactggagcgaccggagtaactggaataacgggcccaacaggatcgacaggcccaaccggagcaacaggttcaatcggagaaaccggagcaaccggcccaacgggagagaccggtccaaccggagaaacgggtgcaacaggatcgacaggaccaacagggccaacaggtttaacaggatcaacaggagcaaccggaaccacgggttcaaccggaatgactggagtaacaggaacaaccggttcgactggtgtaaccggtgcaacgggagaaactggcccaacgggagagaccggtccaaccggagaaacgggtgcaacaggatcgacaggaccaacaggaccaacaggaccaacagggccaacaggtgtaacaggatcaacaggagcaaccggaaccacgggttcaaccggagcgaccggagtaactggaataacgggcccaacaggatcgacaggcccaaccggagcaacaggttcaatcggagaaaccggtccaaccggggtaacaggttcaacgggagtaactggagcaacaggagtaaccggaaccacgggttcaaccggaataactggagtaacaggagaaaccggcgcgaccggtgtaacagggtcaacaggaataaccggagcaacgggatcgacaggttcaaccggcccaacaggtgcaacgggagtaactggagcgaccggagtaactggcccaacaggagaaactggtgcaacgggagaaaccggcgcaaccggtgtaacagggtcaacaggaataaccggagcaacgggatcgacaggctcaaccggcccaacaggtgcaacgggagtaactggagcgaccggagtaactggcccaacaggagaaactggtgcaacgggagaaaccggcgcaaccggtgtaacagggtcaacaggaataaccggagcaacgggatcgacaggctcaaccggcccaacaggtgcaacgggagtaactggagcgaccggagtaactggtgcaacgggagtaactggcccaaccggagtaacgggtccaactggtgtaacgggatcaacaggtgtaacaggagaaaccggagcaactggagtgactggagcaacggggataacaggagcaactggtgcaaccgggctaactggaataacaggcgcgacgggcccaaccggtgtgactggaccaacaggggttactggctcaacaggagaaaccggagcaactggatcgacaggctcaaccggtacaaccggcccgactggtgtaaccggcgcaaccggagtaacaggcccaaccggcgcaacagggccaacaggagcaaccggtgcaacgggggtaaccggagaaatcggcccaacgggagagaccggtccaaccggagtaacaggagcaacaggatcgactggcataacgggttcaaccggcccaactggtgtaacaggttcgaccggagaaaccggcccaactggtgtaacaggctcaaccggcgcaaccggtgtaacgggagaaaccggcccaacaggatcaaccggatcaacaggctcaaccggaataacaggagcaacaggtgcaaccggagcaacaggtgcaaccggagtaaccggagtaaccggagtaactggagtaacaggtgcaaccggctcaactggagtaacaggagcgacaggtacaacaggcctaacgggtccaacaggagcaacaggagcaacaggcccaaccggcttgacaggcataaccggcccgactggtgtaaccggggcaaccggagtaacgggcccaacaggcccaacaggcccaacaggcccaaccggcgccacaggcagtacaccaaccttgctcttcacaagaaccaacgggccgctcactgtttatccgccgttaaatacagaagttcccgttgctacgctggcaatcccagttaatgctttgcagaatgtaaagctggattatgcactcagtgccgcgttaacaactgcagcgaattcaaactttgtttttgaagtgagattatataggggagcagtgcaaattcatacaagaactctgtcgcgaactaatactaccgcagctacggatagtttttcgattgctgatacaacagtggatacagcgccgaccgcaggaacaaatacgtaccagttgagagttgttttcacaactgcaaataatataacagcagcgtcagctctcaatatcgattttaacagcattcgtttcccgacaacctaatgacaatagcagactgatattttaaaaatgaaagacctgacttatgcacagttaggtcttttttctctaaaagctgtgcatggtgcagccttaagaacatttgaaaattcgcccaatagaaatgggattttgccacacctttttcttttgcggaaatattatgcaagaagaggtggtgtaatgagaaaaggagatacttggtataacagatacgactcttgggattacgactgccggaattgtaatgagtgctgctgtcattttcaacataaaagaagaaatcaaaggcgcagttatcaaaaacgggcccattgctgtgaagaattctgttgcaaaacctcttgctgtcatgaaagatggtgtccatgctgtcatccaaatcattttcatgtaagaggattcaccggagcaacggggtgcaccggagcaacggggtgcaccggagcaacggggctgaccggagcaacagggctgactggagcaacggggttcactggagcaacagggctgaccggagcaacggggttcactggagcaacagggctgaccggagcaacggggttcactggagcaacagggctgaccggagcaacggggtttaccggagcaacgggctcgactggtgtaaccggtgccacgggagcaaccggcgtcactggagatcccggcacgactggagcaactggcgccacgggagccacgggagtaacgggagcaaccggggtaaccggagttactggagtaacgggcttgaccggagcaaccgggatcaccggagtaacaggcgctaccggagtaacaggcgctaccggagtaacaggcgctaccggagtaacaggcgctaccggagtaacaggagcgacaggaataacgggagccaccggggtaacaggcgctaccggagtaacaggcgctaccggagtaacaggagcgacaggaataacgggagccaccggggtaacaggcgctaccggagtaacaggcgctaccggagtaacaggcgccaccggagtaacaggcgccaccggagtaacaggcgccaccggagtaacaggcgccaccggagtaacaggcgccaccggagtaacaggcgctaccggagtaacaggagtaacgggatcaactggagtaaccggggtaacgggagtaacaggagcaaccggggtaaccggagccatcggagctactggagtaacgggcttaaccggagcaaccggagctactggatctaccggaataacgggagccaccggagtaacaggagcaacaggagatactggatctaccggaataacaggagccaccggggtaacaggagccaccggagtaacaggtgctaccggagtaacaggcgccaccggagtaacaggggctaccggagtaacaggggctatcggagtaacaggtgctaccggagtaacaggggctatcggagtaacaggtgctaccggagtaacaggcgccaccggagatactggatctaccggaataacaggagcgaccggagtaacaggagcaaccggggtaacgggagtaaccggagcaacaggcgccaccggagtaacaggtgctaccggagtaacaggcgccaccgggataacgggagccactgggatcaccggagctactggagtaacgggcttgaccggagcaaccgggataacgggagtaacaggagctacaggagctacaggattaacgggagcaaccggggtaacaggtgctaccggagtaacgggagcaaccgggatcaccggagctactggagtaacaggcgccaccggggtaacgggagtaacaggagcgacaggaataacgggagccaccggagaaacaggcgccaccgggatcaccggagtaacgggagcaactggagtaaccggggtaacgggagtaacaggagcaaccggggatactggagcaaccggaataacaggcgccaccggagtaacaggggctaccggagtaaccggggatactgggataacgggagccaccggagtaacgggagcaaccgggatcaccggagtaacgggagcaaccgggatcaccggagtaacgggagccaccgggatcaccggagtaacgggagcaactggagtaaccggagtaacaggcgccatcggagaaacgggagcaaccggagctactggatctaccggaataacgggagcaatcggagtaacaggagctacaggaataacgggagcaaccggggtaaccggagccactggagtaacgggcttgaccggagcaaccggagctactggagctactggatctaccggaataacgggagccaccgggataacgggagcaaccggggtaaccggagccaccggagtaaccggagtaaccgggatcaccggagtaacgggaacaactggagtaaccggagtaacaggcgccaccggagtaacaggggctaccggagtaaccggggatactgggataacgggagccaccggagtaacgggagcaactggagtaaccggagtaaccgggatcaccggagtaacgggaacaactggagtaaccggagtaacaggcgccaccggagtaacaggggctaccggagtaaccggggatactgggataacgggagccactgggatcaccggagcaggcgcgatcattccttatgcttcaggtcttcccactgccgtgacgaccattgccggcggattaatcggaacggtgagccttgtcgggttcggcaattctgtgacgggcgtcaatgtcggagggggaggcgcaattgatcttaccggggctggaggaactctgctgaactttgctttttctgctccgagaagcggaaccattacatcaattgccgcctatttcagtacaaccgcagcattgtcgcttgtcggctcgactgttacgataaccgcacaactatacagttctactgtgccgaacaatacgttcacgccgatccccggagcatccgtcactttagctcctcccctcaccggcgtattgtcaatcggcagcatcagcaacggaatcacgacagggctgaacattgcggtaactcctcaaacccggctgttaatggtattctccgccactgcgacaggcctttcgcttattaatacagtggcgggatatgcaagcgcgggagttacaatttcctgatagattgcagactgacttcggtcagtcttttttatgtgttatatcaattgtgtaaaagtaaatatatacctatcatcacctttttggtaagccgcaagagaaaaagatcacgaaaattctcaaaaatgagaaataaagatttgaaaaatggtatgattttaggaggaaaggacggctggtgctgtgttggaagcgaagcggttttatgtctctctgcaaatgaaaatcgccggattaattacggctttattaatacttgttatcggaacgctcacggttatatttgcctttcagcaattaaaggaagggcagaagcaggctgaacagctggcggtgcaaacggcaaaaaccatttcatacatgcctcccgtaaaagaggcgttccggcttgcggatcaagaggcttttacaaagttagacgtcattgaacaaatgaaagaacaggcaggcgcgcacgccgtctacatcactgatcaaaaagggcatgttgcatttcattcggcccgaagcagtattccgaaagaaaatcaaaatctgcaaaacaaaaccgtcatgttcggcgggtctccggtttccgacggaatgaaggccgtccggggaagcgccccggttattttggaggaaaaaaatcataacgaagtcgtcggaacggtgacagtcgagtttctacaagatgagatagaaaaagatatgaaagcgcatctgcggcatttaggctattttgcatgtttggtgtttcttatcggcatcgggggagcggcggcgctcgcaaaaagcatccgtaaagatacactcggccttgaaccgcatgaaattgcagcgctgtacagggaacgcaatgcgatgctccttgcgattaaagaagggattatcgccgtaaacaaagaaggcgcggtaaccatgatgaatttatctgcggctgatatgctgaatcttccggaaccgatgatcggaaggcatataaaagaaatcatgccgggcgcaaagctcatgccggtgttggcagggggagaaataccgccgaacgtggaggtgcgtgccggagataaagtatttatcttaaatgtgaaagaaatgaaacagaccggacaagtatacggagcggtgatcagcttccgcgaaaaaacggagctcaagaaactgatcaacaagctgactgaaatgaaaaaatactcggaggatctccgggcgcaaacgcatgaattctcgaataagctttacgcgatactcggtctgttagagctgggagaatataatgaagccattgaactgataaaagaagagtacgccatccagaatgaacagcatgaaatcctctttcaaaacattcattcacagcgggttcaggccatactattaggaaaaatgggaaaggcgtctgagaagaaagtgaagctttcaatagatgaaaacagctttttagaatcgctgccggagcatgtgggttcatcccagctcattacgatcatcggaaatcttattgataacgctttcgaagccgtcgccgaaaaagagaaaaaagaggtatcctttttcatgaccgatatcggcagggatatcgtcatcgaagtggcggactcaggagacggcgtgcctcaggaaaaaacagaaacgatatttgaaaagggctactcttcaaaggggacaaggagaggatacggcttagccaatctgaaagaagccgtcagtgaattgcagggatcgatagagatttcgcagcaaaagagcggcggtgctgtatttacggtgtttataccgaaagaaaggccaaagggggaatcggtgtgattaacatcgcgattgcagaggacgactttcgaatagcgcaaatccatgaaaaatttatcgaacatcttgatggattcaatgtcatcggcaaagcaatcaatgccaaagacactatatcgctgcttgagaaacggcagcctgatctgctgcttttggatatttatatgccggatgagctggggacagatctgctcccgcttatccgcggccgttttccttccgttgatatcatcattattacggcttctgccgaaacaaggctgctgcaggaagcgctcagatcaggcgtttcccactatgtcataaaaccggtgtcggcacataaatttacagaagtgcttttgcagtaccgtgaaaaaagagaatggctgcactcacagccggagctcagccagtctgtgatcgacatgtttttcggaagcggtcagaaagaacaaaaacagcacaatgatctgccgacaggcattaattcgattacgcttcaaaaaatcaaaaacgcgctcagaacggcccaaaaagggatgacggctgaagaactgggagaaaaaatgggcgcctccagaacaacggcgcggcgctacgccgagttcctcgtttctcgggaagaagcgctcgctgaattagagtacggcattatcggcaggccggaacggaaatattatttagcacatgaataagggatgggagaaatgaagcggttgggagtgcttcttgtcatgctggcggcgctggtttcttttgacggacggcagatggagggcttccgctcagctgaagggccggttgaaattgtcgtcccggcagcgcctcaagggggctgggacgtaacggcaaaagctttgcaatcggtaatagagcggaagcaaatattaggccggcccgtaaagatcatctataaacccggcggaggcggagacagcggctggaaatatgtaaacgaacgaaaaacggatgtcatcagtatgaattcaagcctgctgttaagcaatgaaattttgggacaaagccggctgaaggcagctgattttacgcctttggccattatcgcaaaagagtggcagaccgtcgctcttcccaaggattcaaagataaaaagcggaaagcggctgctcggcgatattaaagcaaatccgggcggcataaaaatcggatttgcgcccggcctcggaaatgatgaccagctctcctttgcgagagcggcggaaatggccggaatttctccgtttgatatccgcttttttcaatacggaagcagcaatgaagtcattgaagctcttatcagtcacgagatagacgccgcctcaatgaccatttcagaagcgagagacgcctatcggaaagggaaaatcacattggcggccgttacgtctgacaaaaggctctccggcttcagcgatgtgccgacatggaaagagcagggggtgccgtttgtctttgcgcactggagaggcatcatggggccgaaagacatgaccgaaggcgagatcgcctattgggatcaggctttgaaacagattacttcatccgcggagtggaagcaaatgttgaaaaaacgggattgggagagcttttataaaaacagcagcggcgcaaaacgctttttagaagagcagaccgagttctataaagagatgatgagcagcgaaaaataagccttccgcatatttgcggaaggcttttgatttataaatgaacaaaatgaacgaaaaggttataaaaaattaaaaatctttaaaatccaaaatatttacttcaatatccaattctcataagatagcaaaaaggcggataaaggggatcgggcctttaaaatgtaagcgtattcataataagggggacatactgtgttagcaatcttaggctttcttatgatgcttgtttttatggtgctgattatgacaaaacggctttcagtgttaacggcgctcgtattaacgccgatcgtgtttgcgctgattgccgggttttcttttaaccgggtcggcgagatgatgatctccggcattgaacaggtggcgccgatcgcagtgatgattatgtttgcgattctttatttcggcattatgattgataccggtttatttgatccgatggtgtcgcgtattttaaagctggttaaaggcgacccgctcaaaattgtggtcggaacagccgttttgaccatgcttgtcgcactggacggagacggctcgacgacgtatatgattacgacaagtgcaatgctgcctttgtatatcatgctcggaatccgtccgattattttagcgggaatcgccggggtcggcatgggtatcatgaacacgataccatggggcggcgcgacgccgcgtgcggcgagtgcgctcggcgttgacccggcagagctgacggggccgatgctgcccgtcatcgcgagcggaatggtgtgtatgattgtggtcgcttatgtactcggaaggatggaaaggaaacggctcggggtgatcgaattaaaacagccgtcccatacaaatgaaacggctgcggctgcggaagatgaatggaagcggccgaaactgtggtggttcaatttactgttaacgctttctttagtgggatttttagtgtcaggaaaagtgaatttaaccgtgctgttcatcattgcgttttgtatcgcgctgattgtcaactatccgaaacttaacgatcaaagggagcgcatttcagcccattcgagcaatgtgcttgcgatcggttcgatgatttttgccgcaggcgtgtttaccggaattttaacggggacgaagatggttgatgaaatggccatttccctcgtatcgcttattccggaacagatgggaggttttattccggcgattgttgccttaacgagcggtatctttacgtttctgatgcctaatgacgcctatttttacggcgtgctgcccattttatctgagaccgccgtggcgtacggtgtagataaggtggaaatcgcccgcgcttcgattatcggccagccgattcatatgttaagcccgctcgtgccgtcgacgcatttattagtcgggcttgccggggtcaccattgatgaacaccagaaatttgcgatgaaatgggcggttcttgccgttatcgtcatgacggcctttgcgctcatcatcggcgcaatcacgattttttaacataaaacacccggttcgtcgcacactaaaggcatcagaggaggtgccatgatgagtgatccgtttatgccgcttttttcagtgagaagcggcgccggttttaaagcggcggacggcgtttacggactgaccgtgcagattgcgaatgtttactttatcgaaaatccctcagctccgcgggaaatcattctggttgacgcgggaatgcctcaatcggcggagatgataacagaagaaatgaaacgccgattcaaagaggggtatgagctgaaggcggtcattttgacacacggtcattttgatcatgtcggtgcgattgaagaactgcttgagctttgggatatgccggtttacattcatgaaaaggagctcccgtacgtcacggggaaagcggattatccgcctgccaggcccgatgcgaaaaaagggcttgtcgcaaagctgtcaccgctgtttccgcgccatacgatccgcattccgtccgttcaggcactgccttcagacggtaccgttccgtttcttgaggaatggagatgggtgcatacgcccggccacacacccggccatatttcattattccgggataaagaccgcgtgctgcttgccggtgatgccgtgatcactgttgaacaggaatcgcttgcggacgttgtcatacaaaagcaagagcttcacggtccgcccgcctattttacagcggatacgcagacggcggccgcatccgttcagaaattggcggaactggagccggaagcgcttttgacgggtcacggaattccgatgacgggaaaaaactaccgtgaggatttgcttacactggctgaaaaactgcattccgttttgtaaaacacctgcgaaaatcacaggtgttttttcttcgcagtttccagtatgatacaaaaaaaccattgtgttcacacctaaaaacgatacaatgggaaacagatgtaaattgaaggagagagttttttgaaacatacggaaatactttgggatgaggcgaaggattttattgatgtctgctatcacgaactcggaatggaatcgcaaatcaacgcgcgactgcacgcgataaaagatgagatagagcggacgggaagttacgtccatacggcggaagagcttgaacacggggcgaaaatggcgtggcgcaacagcaaccgctgtatcgggcgtctgttctggcaatcgctgaacgtcattgaccggcgcaatgtgaacacgaaagaagaggtgcgtgacgcattatttgaacatattgaaatcgccacgaacggcggaaaaattaaaccgacgattacgattttccctcctgagaagaacggggagaaacaagtggaaatctggaatcaccagctcatccgctatgcgggatatgagactgaaaaaggaagagtcggtgatccggcatcatatgagctgacggctgtctgcgaaaaactcggctggcgcggaaagcggaccgattttgatattctgccgctgcttttccggatgaaaggggacgggcagccggtctggtatgacctgcctcagacgctcgtgaaagaagtgccgatcactcatccggatattgaagagtttgccgatttaaatctcagatggtacggggttccgattatcgccgatatgaggcttgaaatcggcggactgtcgtacaacgcggcgccttttaacggatggtatatgggaaccgaaatcggcgcaaggaatcttgctgacgaaaagcggtatgatatgctcaaaaaagccgcttcggtcatggggatttccgccagcctgaatactgacctgtggaaagatcaggtgctggtggaactgaataaggcagtgctctattcatacaaaaaacacggtgtcagcattgtcgatcaccatacggccgcgaatcaatttaagcgctttgaagaacaggaacaagacgcgggcagaaagctgacgggcgactggacctggctgattccgccgatctcgccggcttccacccacatttttcataaatcatatgacgatacgattgtgaagccgaattatttttatcaggacaagccttatcagtaactgatggaaaaggtgcggtaccctttcagacggtgtgattcttcgatggttacgtttgtgacatttgagaaggggctgccttttctgaccgcttcggcaaattgttttaacgactcttcagggccttcggcaaggatttccacccggccgtcatcacggttttttacccagccggctaccttatgtctgtcggcttccatctggacgaagtagcgaaaacctacgccctgaacccggccgtctgcaatcatatgatactgaagcatggaaaaaccacctttttcttactatgataaaggaaagataggatatttcgcaaaggatgtgaacgaggtgacgcaagactattctgtcttatctatcaatctcggaaagcccgcaattcatgaatttgccggcagacaaatcaattccggcatcatcaagcggcccgcagattctcccgtcatgctgtataaaacccattttgacggggacgggcaggctgatctgaagcatcacggaggtcccgataaagcggtgtgcgtgtatcccgccgagcattattcatattgggaaacaacgctcgcgagaaaacttcccgccgccgcgttcggagagaatgtaacggtcaaaggactggccgaacaagacgtgtggatcggagacgtctttcagctgggggaagccgtcgttcaagtaagccagccgcgccagccctgcgtcaaactcgcgctcaaatatggcatcaaagatatggtgctccgtgtacagcagacgggatttaccggcttttatttcagggtgcttgaagaaggatatgtcgatccgcgtcccgtcctcaagcgtctgtcgagaggcaaagaaagcatttccgtctggtatgcgaacgaagtgaaataccgtgattcaggcaatctgtcagcgattgaagaaatactgcgggaagaagcgctgtcagaaagctggagggagtccttccttaaaaaaagggacaggctcactaatgtatagaaaaaaagccgtgctgcactgacagcacggctgatttacgttatgcttgtttctttgtttccagcagattggcaaggaagtactttttgaagctttgaagctttcttccttcatagtgggtaattccttttttctttaactcttctacataccagcctttactgccataatgcatgtcagaaaactcctttctccgttctcccgctggggagagtttcttcagtttttgccaaacttttggcattgtaacatctataaaaagacgctgaaaagggataacgcaaaaactgagcctttcgattcagagatgtaaagctttcttacatatatatgtaaagggcggtcttttcatgcttaatggccggttaattttaacagcactgttccgagtgtcatgattccgaaaacgacgccgaaataaatcagcatccccttctttttcttcaccccgtaaacggtaagaatgatgctttcaataaagaaaataaacccgaagataataaaccacatgttgaaaaatggctcctttcacagacatatgtccagtgtagcacaactcttataacggagcataaaaaagccgggcactgtatcagtgtccggcaagtttgacgagaagctgggccaaatgctgtttttcattgtcatccgcaatgtcccacagttcttgtaaaagtttttcttccgcattgcggggctcctcgtgtttggcgagatagtccccgaggatggcggcgcttttaatgattttgctgtcatccagacccagtttttttccggcggaaattttctgatgaaggtacgccttaaattcctcgaaatcctctaaaatctgctgtttcgttacgccgtgcatggcgtgtatttcgttttcgattttgattttttctttatcttttttcatgcgtctccctccttcgggttagttgttgtatacctgttcgggagggagatgaaacattacaatgcagttaaaataatcggtttgtcttttgtgatcacgatggtgtgttccacttgggcgacaaggcttttatccggcgttttatacgtccagccgtctcccgcttcaacaatcgtttccgctttcgtggaaataaacggctcaagcgcgatcacggttccgtttttaaacagcgcgttatcaaacggatcgtagtaattcatgatgtggttcggcgcttcatggaggtttctgccgattccgtggcccgtcagcgttttaatgacggtaaatccgttggagcgggcctcatggtagacggctctgccgatctggttttgacgtttgccggcttttgcctgatccaatcctttctgaaatgcggatgctgcgcagttacaaagcttttgcagacgttcatcgccttctccgagcacaaatgaaatgcccgtatcggaataaaaaccgccgaactccgccgaaatatcgatattgacaagatctccggcttttaagattttagaggcgctcggaatgccgtgagcgacttcgtcatttacgctgatgcatgtcacgcccgggaaatcgtattccttctccggagcagaagcggctccgtgctcgtcaagcaccgcctttccgatcaggtcaagatctttcgtgctcatgccgggctcggcttttttcttcatttcttcacgcgccagcgcgacgattctgccgatttttttaaggccttctaattcttgatcgttcgttacaatcattgtcattcccgctttctatttttaatcatctgattcaagcttaccacaactggtttataaatagaaaaccaacaagccttatgtgaataaatgaaggaaaattggtatagatcactagataacttatgtggtatatttaagaaaaaagaagggggatgggtaaaatgcttcaatttttgcaaaaactcggaaagtcttttatgcttccgattgccgttctgcccgccgttggtattattttggccatcggcagagaggacttattaaatattccgttcatttacgcggcggggacctcggtatttgatcatctgccgctgattttcgcgatcggaatcgcgatcgggatttcgaaagacagcaacggggccgccgctctgtcgggagccatttcttatatcatgctggacgcggctgtaaaatcaatcaattcgacaaataatatggccgttttcggagggattatcgcggggttaattgcgggatacacgtataatcgctttaaggatacgaagttgcccgaatatctcgggttttttagcgggcgcaggctcgttccgattgtaacggcgctgattaccattattttggcggggatcttcggatttgtgtggccgccgattcagtcggtgattacgtccttcggggaatggatgatcgggcttggcgggatcggcgccgggatttacgggatttttaaccggcttttgattccattcggtcttcatcatgtgctgaataatattttttggttccagtttggcgattttcacggaaaaacgggagatctggcccgcttctttgcgaaggatccgacggcggggacttatatgacgggattcttcccgattatgatgttcgggcttccggccgcatgtctggcaatgattgccgcggctaagccaagtaagcgcaaagcgacggccggaatgatgatcggtctcgcgctgacggcatttattaccggaattacagagccgattgaatttgcatttatgtttttatcaccgcttttgtacggggttcatgctatattaaccgggttctctttatttatcgtgaatgttctcggaatcaggtcaggtttttcattctcggcgggggcgatcgattatctcctcagctacggcattgccgaaaaaccgcttttgctgctcgttgtcgggctttgttatgcggtgatctattttgtcgtcttttatatgctcatcaaaacgttaaacttgaaaacgccgggacgggaagatgatgaggaagaggaagaagtgcttagtgaagatacggccggttccgtcgaagaacatgccatgctcaaggggctcggcggcaggcaaaacctcgaaacgattgatcactgtgcgacccgcctcaggctgaccgtgcaggatacgtctctcattaatgaggcggcgcttaaaaaagcgggagcaaaaggggttatcaaaacggggaataaaacggcgcaggtcattatcgggccgaacgtcgaatttgtcgcggaagagctgagagaggccgtccgccttgacgatcagaagcagacttgaaaaatccggatcacctatgtgatccggatttttttgaacatatatcaagtttcacataatgtacaaaaaacaatgtttccttctatgttaagattcatgtagaacaagtatggagatgatgtaaggtgacatggattgcagttgtttcaattgttgtcataagcctgattaagattgtgctgacatgccttcctaccggagcggtggaatggatcctccgcaagtttgaaacccattcaaagctcagtgacgagtccgctgccgtttccctcggcggaaaacgtctggaaggcgaagacaaacgacgggtgattgatgattttaacgaagccgtgtttatcgaacggcattatatatacccaggggatgaagagcgttatcttcatccgcaaaacggagccgatccgcttgtcattaagacgagaaaaggaaaaaaagatgtgacggtgtttgtatacagctacgaagatcatgtagatgtcgtcaagcagcagaaaaagaaagtcgtcgcttattcagttctttccgacagcctgcaaaagcgcactatggccgccgccgggagctgaacataaaaaagccagatcatatcaatgatctggcttttgtttattctttttgatcgtctgctgaggaatcttcacgcttcgtataatcgaattgtgacggatccactttcttgaagcctttcggctgatagaaacgaagcagatcgccgttgatgatcttatcagacatttcaagctcagtcttgacgagagagtcttcttttttgtcgacttctgaatcatctaaaagtcttccggttttcgtatcgtaatacttgccggacactttcgtatagttcggcgagatgaagtctccgttacggaacggaatgacttctctgtgctctttcgataagatatcagaacctgacatgagataatctttcgtatcgacgccgagcagatgaagaacggtcggcgcgacatcgacttcaccggcaaatttatgattgcggccgcctttcacgccgggagcgtggataaagagcggcacccgctgaagctgggcattgtcgtattcagtgatctcatctttgccgagcactttcgccatcgctttattatggttttcggagatgccgtagtggtctccgtacatcacgataatcgacttatcgtacaggccgtcttttttcaggtcattaaagaactgttcgattgattcatccagatagttcgcggactggaagtaattattgacgactgaatcgccaaagtctcccgccgggaagtccgtgtcttctttatccattccgaacgggaagtggttggacagcgtaatgaacttcgtatagaacggctgcggcagactctttaagagcggcatggattctttgaaatacggtttgtctttcatgccatagtttttcgtgttttcttcgctcatgtcataataagcggaatcgaaaaacttatcgatgccttccgatttgtacatttcgttacggttccagaaagtctgcgtatttccgtggaaagcggcagacgtgtactttttgccttttaagatcgcaggaacggactgcagcgtgttttgcgctttattgacgaaaaccgaaccttgcgaaagcgggtacagagagttctccatcataaattccgcatcagatgttttaccttgtcccgtttggtggaaaaagttatcaaagtagaatgtttgattatcgtgcgccagtttgtttaaaaacggcgtcacttccttgccgttaattttgtaatcaatgataaaggattgcagagactctaatgagacgtagatgacgttttttccttcggcttttccgaagtagacgttattcggcacgtcatagttggccttcatatagttttccacatccgttacatcgcttgaatcggcaagcgcgcgctggctgtttgatttcacattctgcacggcatcgtaaatcgtaaagttgtacgtgccgaggtatttcaccagatagtttcggtcaaatgagcgtgtcaaaagctcaggacggtctgattccgcgacggcgaggttgatcaggaacacaagcacggcggaagccaaaacgattctgaatgatttcttcgccggtttttcagccggttttttcatcttaagggccaaaataatcaaaatgacggtatccaggaagtagaaggcgtctgtccatctcattaacgagaacgcgctgtctccgagctggccgccgtttgtctttgcctgcatcatgaccgggatggtaatgaaatcattaaagaatctataatagacgatgtttgcaaaaagcaaaaaagacaatataaaatgaatcacaataatggctgtctgctgtaattttttcttgaaaagaagcccaaatccaagaaagaacaagctggagctcagcggattcacaaaaagcaatattttctggatcgtgttgtctatgccgaggttaaagtttaaaatataagcgacatatgttttcacccacaataacacgaccgctatcaagaagaaggcaagtcctctttcttttataaatgttttcattgttacactccttttttccgatcacggtttacacggaacgatagaaaaaacgaacgtaatcaatataccatgaaaccagcaaatagaaaaggtggaaaaggctcatcggaaaaagggcgaaaaacgctgtcgcaacagcggttcatctgttgaatgacagctttaaaaaacataaatggcacaaactgggatgtgaatttccgtatgatcacacccggttctattgaaaaaagaggtgaacagtgatggatattgcccatatcgtggctgaagataaaatcaagcgcgccattaaggatggagagttcgccggcatcaaaggaatgggaaagcccctgccgaaagacgatgccgcacatcttccggagtcgctcagaatgggctaccgcatattaaaaaacgccgggatcgccgaggatgagggcgcgctgaagaaagagctgatgacgctcgattatttgatcgccaagtgccgcaatgaacaggagcgggatcacctgcggaacaaacggacggaaaaacaagtcagactcgacaaactgacggaggagaaagccatgttctcaaaacccgcatcttctcattataaggagaaagtgtacagacggctgggccgcccgtaagccggctctttagatttttttctgaaaaggaatgtgctccataaggcgcgggtaggaaatgtggagcaggccgtttacgcactgcgcctgtaacaggtggggctcagccggttcaggaagctcaatcgtctcatcgatttccccgtaataccggttttggcagacgcccatgttcttcggaaaaaggggtgtgatgtttcctcttatatgcagccgtgttcttgacagcagcctcaatgtcaattcttcttcgtaaacgccgggcatttccacaatgacaaatgtgtgctgttcatcctgataaatatcataagtcagggtgtttttttgtaaggagaaaaaatcttcgggagatttccgtttcaggacattggtccaaaagtcgctgggcttgtgctcgttcgtaatctcaagccactttctcattttttcgatatccacctcggcagaacctccctatatttgatttgcgatcggcattgaagggttggcgatctgatcctgatcgctcacgtcagggtcaagatggcccgaattcaaacatccggcggccggcgaaaaatcccctaaagaaaagttcgcgccgacaaatttgctgttggcggtgtggctgttttgtacggtctgaccgatatcgacgtttccgttttgcgttgctccgtttacttttatattgacgacgttaatttggtaaggcattcataaaaacccctttaatctataatgggcggcaccggcgtaatatttgcggtatctgcggttccgatggctgtctggtcgttgacatcaggatcatttaacaagttctccatcatcgattctataggtgacgtatcgccgaatgaagagttcagtccttgtgatttgttatttgtggtgggactgttgtatgccgcttccccaatcgtaatagatccgttgccagaaatactgttaatcttcaaatagtacaggttgataacagtggatggcatctcttcacacctctttaacttagttgtacagtactgtatgctttttgtgctcctgttgtgaatttcgcccggacatgttcccgaccaaacaagaagtcaaggcccggttccggcggggctttttttgtttcagggtctttcgcagtatatttgtgatgaaagcgctataaaaatagattgacgacatgtatatacatcattacaatagagtcgtaaacatgtatatacaagtttttttgagacaaaatgaaaacggttacggaggggttggcatgggtgagtttaaccgggctgcgcggcagatcgctgaagctgtcggcggaattgaaaatattgaggcggcgactcattgtgtgacgcgtttgcggtttgcattaatagatgaaaccaaggtaaaccaaaaaatgcttgatgcaatagacattgtcaaaggatcttttgcggtaaacgggcagtttcaagtcgtgatcgggcaggggacggtcaacaaagtatatgcggaattagtgaaggaaacggggatgggtgaagcgtccaaggatgacgtgaagaaggcggcagcgcaaaaaatgaatcctttgcagcgtgctgtgaaaacgcttgcggacatctttattccgatcttgccggcgatcgttacggccgggcttttaatgggtctgaacaatatcttaacggcggaaggcattttctacagcacgaaatcgattgtccaagtgtatccgcaatgggcggatcttgccaatatgattaatctgatcgcagggacggccttcgcttttctgccggctttaatcggctggtcggcagtgaagcggttcggaggaagcccgcttttgggcatcgtgctcgggctgatgctggtgcatcctgatctgttaaacgcatggggctacggggccgccgagcagagcggcgatattccggtgtggaacctgttcggccttgaggtgcagaaagtcgggtatcaaggtcaggtgcttccgattctgctggcgtcttatttacttgccaggcttgagctctttttgacgaaacggacgccggagggcattcagctgttggtcgtcgcgccggtgacgcttttggtcatcggttttctatcctttgttatcatcggtccgatcacctttgcgatcggtaacgcgctgacggcgggattgattgccgttttcggccaattctccgccatcggaggcctgctgtacggagggctgtattcggcgcttgtgatcacggggatgcatcatacgtttctcgcggtcgatcttcaattaatcggatcaaagctcggcggcacatttttatggccgatgctcgcattgtcaaatatcgctcaaggatcggcggctctggccatgatgctgattacaaaagataaaaaacagcgggggctttcactgacggccggcatttccgcatatttgggcattacagagccggcgattttcggcgtgaatctgcgttacaaatttccgtttgtgatcgccatgatcagttcggggatcgcggggatgttcatctccgtcaaaggcgttctcgcaagctcggtcggagtcggcggcgtgccggggatcttctccattatgagccggtactggggtccgtttgcgatcggaatgctgatcgtgctgattctcccgtttgcgggaacatacgggtatgcgcggctgaaacggcaaaaatagaaaaactgcggggcgccttctaacaggctgtcccttttccctttcaattcaaaacaatacaggcggtgaagaaaaatgaaaacagacagcacaccatggtggaaaaaggcagcggtatatcaaatttatccgaagagctttaatgatacgacgggaaacgggatcggtgatctgaacggtattatcgagaagcttgattatttgcagaagcttttgattgatgtcatttggcttacgccgatttacgattcgccgcagaatgacaacggttatgacattcgcgattactgcaccatttatgaagaatacggaacgatggaggattttgaacgccttcttgatgaagcgcacaaaagaggaatcaaggtcgtcatggatcttgtcgtaaaccatacatcagtcgagcatcagtggttcaaagaagcggtttcgtcacccgacagtccgtatcgggatttttacatttggaaagacggaaaggaagacggccgggcgccgaacaactgggaatcaaaattcggcggttccgcttgggagctcgacccggcgtcaggccagcactatctgcatttattcgatgtgtcgcaggccgatttgaactgggaaaatgaagagatgagaaaacaggtttacgacatgatgcatttttggttccgaaaagggatcgacggcttccggctggatgtgatcaacctcatttctaaagaccaatcgtttcctgatgccgaggatggccgtgacgggcgcccttattatacggacgggccgcgcgtgcacgaatttcttcatgagatgaaccgggaagtgttttcgaaatatgacagcatgacggtcggtgaaatgtcttcgacaacggctgaccactgcatccggtacacaaaccctgaaaataaagaactcgatatgacctttaactttcatcatttaaaagtggattatccgaatggtgaaaaatgggcactcgctccgtttgattttctgaagctgaaacggattttagcgttttggcagacggagatgcaaaacggcggaggctggaacgcattattctggtgcaaccatgaccagccgcgggccgtatccagatacggagacgatggcgtataccggacgaaatcagccaaaatgctggcggcggccattcatatgatgcagggcacgccttacatttatcaaggtgaggagatcggcatgggcaatccgaagttcgatgacatcggctcataccgcgatgtcgaatcactgaacatttacaaaaagatgaaggaagaaggcgtgtcagaaaaagacattatcgccattttaaaagagaaatcaagagacaatgcaagaacccccgttcaatggaacagcggaccgcacggcggcttcacgacgggaacgccttggattccggcggcggatgattatcgggacattaacgcggaagcggctttgcgggacccggattcaattttctaccattatcagaagctcatcaagctcagaaaggaatatgacatcgtgactgaaggaacgtttgagctgcttgctgaagatgatccggcggttctggcgtacgtcagacacggcaaggatgaaaaacttctgtgcatcaacaacttctacgggaaagaagcggactttacggttccgcttaaagacacggacggctggcggtttacggtgctgctgacgaatgatgaaccgagggaagggcggccggaacgattgacgctccgtccgtatgaatcgatcgtttatcatctgacaaaagcgtgatacactaatctgggtggtcatgaatgaaagtgaataaatatatcacaatctataaagatatggtgcggcagattgaaagcggccagcggaaggctgaagacgttcttccgtctgaaaatgatttgtgcgatcaatacggcacatcacgagaaaccgtccgtaaagcgctcaatatgctggcgcaaaacggctacatccagaaaatcaaaggcaaaggctccgtcatattagacagagaaaaaatgcgctttcccgtctcaggcctgatcagcttcaaagagctttcggaaacgctcggaaaagagacgagaacggaggttcaccgtctcgggctgatcctgcctccctcagaagccgcaaaagagcttggtacagaagcggatgaaaaggtgtgggaagtcgtcagatcaagacggattgacggagaacatattattttggacaaggattattttgtgaaaaaacatgtgcctcaattgacgaaggcgatttgcgaagattcgatctatgagtatctcgaaggagagctcggcctgtccatcagctacgcgcaaaaggaaattgtcgtggagccggcgggggaggaagaccggaagtatttggatctcagcgggttcagccatatggcggtcgtgaaaaaccgcgtctttttggaggataccagactcttccaatatacggaaagccggcacaggctcgataaattccgtttcgtcgactttgcgagaagagaaaaataaaaacggactgccgcggcagcccgtttttttgtcagtatcaaaatgaatactatccaacaaaaatgtgcgtactggtactttcaaaaataatggctacaatagtacataacgagatgaaaaggagagatcatgaatgtcagataaaaaacagcagatcatcgaagcgtatcaattcagacacgccacaaaggaatttgatcctgagaaaaaaatttcagaaagcgattttgaattcattttagaaacgggaagattatccccaagctcactcggtttggagccttggaaatttgtcgtcgttcaaaatccggagcttcgtgaaaaactccgcgagttcacatggggggcgcaaaagcagctgccgaccgcaagccatttcgtacttctgcttgcccggacggcaaaggatatccgttttgacgccgattatgtcaaaaatcacttgcgggaagtcaaaaaaatgccggaagatatgtatgaaggctatatcagcaaaacggaagaattccagaaaaatgatttcaatctgcttgaatcagatcgcgcgctgtttgactgggcatccaaacagacttacatcgccctcggcaatatgatgacagccgctgcgcagatcggcatcgattcctgtcctgttgaaggcttcaactataaagaaatccaccggattcttgaagaagaagggcttctggaaaacggaagtttcgacatctctgtcatggccgcattcggctaccgtgtcagagaaccgcgcccgaaaacaagatctgcctcaaaagacgttgtaaagtgggtataagataaaaaaagctgccgggcgtgtcccggcagcttttactgtttatttggttttgctaaaaaacaggcggtgatccaggacgtaacgggaatgatgatgccgatcccgattccggcgcaaagaatggtgacggcttccgcactgaatacttttgagttcactattttttcagctgagtatgataagtctttaaaccagataattaaagccaaatagctgccgaaaaaagcaaagaataacgtattcgtattcgttcctaaaatatctctcccgatgcttaatccgaatgtgtacagttcttttctgctcatggacggattatgactgtaaatttcccgcatgggtgaagtaatggaaatcgcgacatcggtaatcgccccaatcgtgcccatgatgatcatagctgcggtaacctttacaaaatccaccccgacaaacagtgtgaatatgccgatatcccccaattcttcttcaccgaatccctgaatcgaagtatgttttgttacggccataataaaaaacagcagcaatgcaatggtcagcattgcagaaataaaggcggttacggttttgacgtttcctccattaatataaaaaagagtaatgctgcaaatcacggcggaagagagcaatgttaaaacaatcggattgatatgcgggtctgtcatgaaaataatggtgagaaagagaacaccgaaatttaagaataacgcaataaaagacctcgctcctttttttccgccgatgatgaccattaatagaaataaaatcgccgcgagaattacgatgacattcatgagcttgccttctttcgtttaataaaaaagacagaagcatacagactggcgggtatggttaatacaattccgatccccccggccaatgctctggctatttccaaggaaatgttcatagaaagagtgaatcctatcggggaatcatttttcaaatacaaaagcatcatcggaatagagccgcttatataagcaaaaaacagaatgttggtcatcgcccccatgatgtcttttccgatctccatcccggaacgtctgagagcttgtaatgagatacccttgttttcttcatataatccgaagacagatgacgtcatggtaatggccacatccatgaccgctcccagtgatccgataaataccccggccataaacaccgtgtgataagggcgggttaaatactgcatttcctcatatctgagacctttctctccggttgccagcattaccagatacgtaatcagcagggaaacgaacgtgcctgcgagtgtcgcggctatggcggcgtatgttttcgcgtgaaaaccgctgacaagcagcaatgagatgacagtaaagatgagaatacagataccgcagatgaaaattaaccctatattaggatgcttcctgtacaaatctaatgcaaacgacagtaaaacggcattaaacatcaggctgacgatcgaaaagaagccttgttttttgccgacgataagcaaggtgaagatgaaaacccaagcgatcagcaaaatctgtttatcccgttttttatctataatgcttcccgatatatctttgtttgatggtttccctttatcaatagaaacgaatacttcatcgccaatcgaatatttctgatcattcgctccggataaagaatactgattggacaaatgaatgagctgtcctttctgacttccgttttcaagtctggctgtgatcgtctgagtgaaaatcttatctttgtttttatgcatgtcctgtacgtcagactgatgttccaatgttgttttcgtcactttggcaatcggccgctcataaaaagaagcgttgtgagtgacaaaaatgagcgagctgataaaacaaagcgctgttatcacgtaaaacagctttttcttgtaagacatgcggtttcgtttgtttcctgtaatcttcaaaaaaagtcctccaaacaggcggcgccgtgtgaaagagaggccctgccgtgaagtgttaaacgatgcggatgcagtctttcgcgaataacgttcatattttatcactcggccatacggctgtcgactcagaggggggaccggcagaaaaagctctcctgatatcagatcaggagagcttttgggatgaaccgcccgataaaagcggtatttttatgcttcgttcactttttttgcttttcttctttggtacagatacagtgccgttccgagcgcgctgatgagtaacccggcaagaaggatggaatacatcgttgtggccgtatcaggaagcaggccgcccggcgatactccgtcctgcgcagggccggatgacggtttttgtccgcttggctgctttccggagccatgatcgccgcttgtcggcggcgcgctcttcgtgtttgcgtttaatatggtgtattcactgaaatgatttgtatagcccgtgacgagatcgtgtgaaaccgaaccgttgtctgtttttgtatagacgttctttttccggtctacatgataaatgccgggctgtttcgcctttttcatattctcaatgcgcagggtgagctttaccggcgcattgaatgttttgatgtctttgtttttctgcttcattgtaaagtcgtatacatttgaaagcgccccgctaacttttcctttcggcgtcacaccgaatcgtgtatcagctgaagcagcgtttgccatcggcattttcatgttgaacttgtcatgcaggatcgtaagggaagaatccgatgttctgtcctttaacaggccgatttgttttttggtcacgctgagatcaatcggctttttggcgccgtcattcttatcgtaatacacgatcggcgtgttggcgtttttggcatagacggcaaatgcgctgtcatcttcaagcgtccacgaatcgtttttttgtctcgtcggcaggtacacttcctgcgcgcggccgtcaactttcggttccaccgcttttcccgctttttcaagctgctcaacgaagacctcatagtcggcaaagccaaggtcttctttatgggacgcttcgttaaagacggaatatccgtctccgccttcaccgacaaagttactggtggcgactctgtatgtcttcttatcagaaatcggctttacactgccgtcatcctgtacggtcgcagcttgaagaacgcggtgtcccggctttttattcagtgtaaacgtgtatgttaaaccggcaacttgagggaaggcgccgccttgagcttcaattccgcttaatccttgttccagggcttgtttgatctgttttccggttaaatccgcgacgtaaagcgtgttgccgaacggcattacattcagcacgtcgccgagtgtgatgtctcctttatcaatgcccgcgcggatgccgcccccgtttgtgatcgcgatttgggcgccggccgcttccttcgctttttgcagcatgccgtccgcgatgaagtttccgagattggtttctttggagcggacatgctcgcgctggccgtcaagtgcgaccttcgttgaaccgactttttcatttttaactgagacgagctcttttttaaacggatcaagctcttttttcagatccgggtcttctttcgtctgctcattcaccggtagcgcttgaagagaggattgttccggcaggacgacgccgtttttgtcaaatgcgacatcgacacggcctaaatattcgccgtattcttttgcctgggcgacgatggtcggctcttcgtttttgacaatttccattttatctacaagcgtatgcgtatgtccgccgacgattaagtcgatgccttttacctttttggcgagatcgagatcacgctgatgcccgatatgggtcagggcgataattttattgacatgttccttgttctgtatttcttttaccgtatcttgtgcggattggaaggcatcatgaaagacaatgctttttcccgggcttgatgtgacggacgtatcttctgtcgtcaagccgaatacggcgactttttctccgtttacatcaagcagaatatatggatagatgcctgcttttttctttttccctgccgtaaatgtgtctgcttttttcatgaatggtctcagttttgactctttggccacatcgacatttgaactgacgagcggaaagtcaggcgcttgaaaattgtatttcccggatgggtcagacgcgctcccgttaccgctcaggaagctggcgagagcacccggacctttatcaaactcatgatttccgaaggtcattgcgtcgtagcccatgctgttcatcaattttaaatcagccagcccctgccactttgtgaaatagagatcgcctgagaaaacgtctcccgcatccagcaaaatgctgcggtcggtttcgcttctgatttctttaattttcgtcatccgcctcgccgcgttatcaaggtgggcgtgcgtgtcatttgtatgcataacggtgagtttccatgcgtcatctttcggcggatctgtgcccggttcatcatctttgaattggagcttgtactgtccgtagcccgcgttttgtgattcaccgatataggcgacgtcatctgcgcggtcggcaaacggctttgcggccaaggaagattcaaatgtcaggtttgtccctttgaccggaaggatggaccagttatgatcagcctgcggattaatcgttttctgctggatgatgtaatccattaagacctgcctgttctcatcggcagaagagtatacgattttatcattgcttaagtgagggaatcctccgccgcctgaagcgcggtaattatttgtgacgatcagaaattcctgcttggcgctgacgggctttccttgataagaaaggttgacgatccggcttgcatcgggatgaatgactgttccgttttcgttgtatttcgccggttttgtgacatcgacctgataggtgacaccgtcaatgacatcaaaattgtatgagcggtaggcgtcatttaaaagcgcttggctgccgccttttgcctgatcgatctgattaaattgccccgcggacatttcgagccagtctttcacttcgcttccgttcagcttgacgatctgaaccgtgttgtcatacaggtacaaatcgccgatgtttttgatggcgaggtcgcccgcggaaatgtttgtatagtagtttgagccgttccgcccgccggctttaaacggggcgcccgccgagaggataggcagatctttgtactccgtatccttcatcttattttcagcgtaccatttttgcgcatccgttacgatttgaatggacggatcatctttgacttgggcgaagaaactgttgatatcggcttttgtctggccgacgggttctctgatgtatttcaaagtgccttcgtgcgcttttttgacggtattgacgacggtttcgttttccgaattcacattgccggcaatcggctcgatgctgccttttgcatcttccacatgccacgcgctgtctgttttttcaagccggaggtcgatgacgcccgcatatttgccccagctgcttgacataacaacggggatgccgttaatcgtgcctttatcgacgtcgaattgagcagcgcctttgtattcggcatcagggaaaagcccgtgctgatggccggatacgatcgcgtcaattccgctgactttcgttgccaggtcaaaaacggcgttttccgctccggaagactgcgcttttttttcgatgccgctgtgggcgagggcgatgacgatatcggctccttcagctttcattttcggaacggttttctttgcggattccacaatgtcctcgacctgaacgcggccttcgagatttttcttatcccacgtcatgatctgaggaggaacaaagccgatgtagccgacttttagctgatgcttgccgccgttttcatccgtgacggttttgtcttttatgacataaggcgtataacggttttcgccgcttactgttttcacattagcattaacgatcggataatcagcgcctttgattgtcccgtccaggaattcaagcccgtaattaaattcatgattgccgagtgttcctgcgtcataatgcagactgttcatcacttcaatgatcggatgggtctttgcgcctgaaatgatatcatttttctcatattttacggcgtattctccgaggggattcccctgaatcaggtctccgttatcgacaagcactgtattcgggttttcgcgcctgtgcttctcaataagctgagccgttcgggccagcccgaattccgttgtcggtttgtcgctgtagtaatcgtagtccatcatgttagcgtgaacgtcagttgtggctaaaatgctgagattcacactggaggatttgttttcttctgctttaatgggtgatgttgggaggatcagactaagtatcataactaggggcagcagaatacggagtgtcatattgacgctgcatcgtcttttctgtattctcacctgttctccacctttcaacaaattttgtcatgcagtaccattgtaagaatattttgtgaaagtttatatagatttcatgatgattcttgtgaaaagataaaaaatgaggataatgacctatgtaaaacaggcgggcggtaaacgcgttacctatgtttgatgttagtgtggctggggtacatggatttatgtagacttcatcaagcaggaggtagtaactatgggtaaaaaaattgcagttgtattaacggattactttgaggatgtcgagtatactgaacctgcgaaagcttttaaagatgcgggtcatgaattaaccgtaattgaacaggaaaaaggaaaaacagtcaaaggaaaacaaggggaagcggaagtgaaagtggacgcgtccatcgatgatgtgaatccgaaagactttgacgcattgctgatcccgggcggattctcacctgacatgctgcgtgcggatgaccgtttcgtccaatttgccaaagcgtttatggatgataaaaaaccggtgttcgccatctgccacggccctcagcttctcatcaacgcgaaagcattggacgggcgcaaagcgacaggatttacttcaatccgaatcgatatggaaaacgcgggcgcgaatgtggtggatgaagaagtcgtcgtctgccagaaccagctggtcacaagccgcacaccggatgacattccggcattcaaccgcgaatcattaaaactgcttgcgtaatataaaagcggagcgccgtatcaggcgttccgctttttttgtgaagattcccggatgaccagctcaggcgccagaataatgcgctgttttttgtgctgggaattggtgattttatgatgcagcaattgagccgcttcttttcccgactgccgcggaaaggaagaaacggttgtaagcgggggataagaaatttcagcttccggcacgttatcaaagccgacaatgtcaatatcttcgcccggaacgagcccggcttttctgatcccttgcatgacgccgaacgcgaccaaatcactgaagcagaaaatcgcggtcgggtgctcagaccggcggaggagctccgtcacggcctcacagcctgcttcgcgggtcggcgcgctgtcaatgacatattcatttttcacttccagacccgcttcacggagcgcttttttaaaccctttcatacgcttcgtccatgttgatgagtgcttcacgccgcccagaaacgcaatctcctgatggcctttctcaatgaaatgacgcactgccttataagtgccttcttcataatcggctccgacaaaatcacagtctgcatcggcaatctccctgacggcgagcacgaccggaatgtcaagctgctcaaggcgggaaagggtttcctcagccgcacctgaaaccggacacaaaatcaatccgccgaccctgtgctccagcatggtcgaaatcagctgctcctgcttggcgacggaatcaaatgtcgtgcctaacagcaccgttaatccgacttcctcaagcgtattctgaacgccgatcagaaactctgagaaaaatgtattggaaatgtcagtgataatcaatcctaccgttgtggacgtctgtgatcgtaaattcgcggcgacccgatcatatacgtaccccagctcccgcatggattgcagcactttctcacgggttgcttcggaaattcgggggttgttgcggacaattaatgaagcggtggatgttgagacgccggcatgttcggcgacctgctgcaatgtcacccggcgttttttttgctgtttcatacgtcgcattcctcacttggtttttattcgttacatccattataagcgttttggcgcatgagaagaaagagagaggagggggaaaaagataaagcgccggaagacggattgtccttcggcgcttctgtcacataggttattcaaacatttgctctttaatatactgaaccggcatttcacggcctgtccaatattcaaatgccatggcgccctgccaaagcatcatgccgagaccgttaatggttttgcagccggccgcttgagcttgttcaagcaatttcgacgtaacggggttgtaaacgacgtctgtcacaatcaaatccggacggagcatggatgtatcttcaataacgctcaagccttcaagcggtttcatgccgacacctgttccgtttgtgaaaatatcgcttgaagcgatttcagcacgcagcgcatcttgatcttcgagcgggaagactttcgctttacaagaagatcccttcatttcttcattgatgatgcggacattttcttccgctttttcgaaaaacgcgtcattgcgggcgaaaatagagatttctccgaggccttccaatgcggattgaatcgctatcggagtggcggccccgccggaaccgaccagcgtcatttttttccctgtgatatcgatgccgtgttcttttaagttgcggacgtatcccataccgtcagtggagtgtccgatcagtctgccgttttcattaacgactgtatttaccgcgccggtgaatttcgctgaatccgcgagttcatcgagataagggagaatgttcatcttgttcggcatcgagacattgaagcctctgacgtttaaggcacgcattcccgttaccacatcttccagctgttcattgccgacttcaaacgcgaggtaagcgtagttcaatcctaattttttaaacgccaggttgtgcatcgccggagataaagagtgtccgatcggtgtcgcgaataatccgataagctgagtttttccgttaatccgtcctaattctttcttcatgatgtattcctccgttagtccattcatttgtttttcaacccgctttgagggcaaaaaacgctgattacatatgtttatttaaaatgctgagtacgctgcgcaattcctcaacgggaatctgcccgggcgctgatgcttctttgcccgcgccgaacgtgcacgctgagccgaagacttcgccggccaggcggctgatcaggcctgttcccgccattgacatcgtgatgatcggccggtccgcgtattgtgttttcatcgtgtgagtggcatccaataagacgaaaacatcttccgtgctttgcggcatcaccgcgattttcggaatgtgcgcgccgtacgcctgcatgttccgcagccgggaaatgatttcttcttttttcggtgtctgatgaaaatcatgattggacatgacgacatatacgccgttgtcttcagcggttttcacaattgatttgacttccgcttctcccgtaaacagctcaacgtctgcaaggtcaatatgttttgtttcgatggcggttttaagcaattcaatgtaaaagcggtcatcaataactttatttccgccttctttatgggttctgaatgtgaaaagcagcggtgttgcgcctgcggctttccgcagcttttcaagcatgccttttacggcgtccaggctgtcaacatgctcgtatacatccgcccgccactcaatgatatccgggcgaagcccgttgacggcttcaatttcttcgagcagttctttctctccggccgccatcagcggcacaatgatcttcggaagcccttcgccgatgaccgtatttctgatcgtgatagattgcatgataaatcctctcccttaaaaaatagtcaggctttcatcacttgcttaaagcggattccgataaacaatgcgagaagggcgctgacggccgcaattccgatatcaagcagaaaaacaggcgtcaggccggcggctttggatatcgctcccgttacaagcggaatgacaataaaagataagcttgatgctatattaacaaaagatgtgatcgtacctttatttttagggaataaaacagccataaccgtcatcgccaattgcagaatgcccgcagttgaaagtccgatgacaaaggagctgatgaccgatacggccggctgatgaatgaaaatcagagcaagcagcgcaattgccgcgatcacagggtacagcaccattaccgtaatcggctgaatcactctgtttaacagcacagccagcaataacacggacacaagcgccccgatactgtaatagctcaacaatttgacggcctgcacctcaggcatgcccaaaacggattgcccgaacttaggaagccatacttgaacgagcataaacagcgccgttgatgaaaagcctaacagaatgattgcgaggccttcgcgccatatcgacggctgtgatgtgaacgcgtcatcagacggagaggcttccgtccggccgccgtcttctttttgcttatgattcggaaacggaactttcaacaggaaaaagccgttcaggaagaaaataatgcccggtacgaaaaacgtccagccgtaaaacaaatgcctgtccgcaataaacgcgataaaaaacggaagcaccgtcgcgccgattgatacaaatgctttgattaacacggttgcagagcttgcgtttttcggaaatccttcaataagcgccggatatgtcccggaatccaaaaaggaattggcgatcccggcgaaaatggcgaagataaacgcggccgtatagtttgtcgaaagcggaatcccgattaggaaaatcagatacagaaaggcgcccgacacgataaacggccgtctcccgaatgtatccgaaagcttcccggcaaacagaagcgaaatcagcttcccgatcccgatggcggagaccaaatagctgacaccggctgcggaagtatgaagctgttttgataatgcctccatattggatgcgataataatattgatcatgcccagcaggaaatagttaatataaagacccgctgccattttggtgtatatgtttttcatgatgacatcccctaatgcggttaataaagaattaaattatttttttaattgataaaagcacagcaccattcccctttattgaaccactgcctttctttgaaaactgtttgaaacaacggttgcatagacaaacttgaataacgctgatatcacaatgagtatatcgttctactaaataaaaaaagataagcggcctgctcatttagtatatcgttctaccaagttcacagttactatactccttctttttatatgtgtcaaaccgatgaacttttattttttgcttttttaaatcaagaaaagacctgccgtttttcggcaggtctgacatgggtttattttctgagagaagcgagctcctcggcaatggcctgcatttcactcgggctgaatgatgcttttttcatgaccatttgatgaaggtatgtaagatcttctattttttcatcactgaaatcttccgctctgatgacgccgacattgagcatgttgagcttttgcgaaatgtcttcaatcattttgtttaacgtttctgtttgttggctcggcaaattcatgcatcctttcatgaccgttttcgtaccctttattctaacagaattcatttagaataaaagcttatttccacagccgcagaaaagttgctaagatgttgataaggtttttgatcctcaaaatgcggggaaagaatagggaggttatcgatatgatacatgtgctgtttgtctgtctgggaaatatttgccggtcgcctatggcagaggcggtattttctgatatggtgaagaaaaacgggctgaacgggcagattaacattgattcagcgggaatcggcgcctggcatgcgggaaatccgccgcatgaagggacaaaggagatcctggagaagaaagggatcagcgcaagcggcatcacggcgaggcaggtccgtgagtctgatctgaccgattttgattacgtcattgcgatggatgcagaaaatatcggacatttgcgcagcatggccggttataaaaaagcggcgccgcgtattgcaaggctgcttgattatgtaccggagtcggaccttgccgacgtgcccgatccgtattataccggaaatttcagcgaggtgtacgctttggtcgagtccgggtgccgtcatttgctggagataataaagaaagaccatcatttataagggggattgaccgatgaagcagacacgcatcatggcaaaagcgattctgatcggcgctgccgccggcggagcactgtccttattacataagccgacgagagaggcatgtttccggaatatggacgcgtgcaggcggcgtgcggcattttaccgaaaacatcctgaagccctgaaacagcaggcttccgcaaaactggatcaagtgaaaatcatcgccaataccgtatcggacgatctgagttttttaaacgggcagatcaccaagctgaagcagacgacaccgcaggtcattgacctgttaaaagaaacgaaggagcatttttcgaaaaacgatcattgaggtgggatgtcatgagttttataaaggagctgtttgcaaggttttctctgcatgaaggacaaagtaaatcggcggagctggcgtattttttcctgctgtcattgtttccgttaatgattttcatgctgacgctcaccgcctatcttcccatatcggcagaagacgtgctcggggcggtcgatcaatacgcgcccgacagcgccatgtccatggtgaaatccataacggagcaaacgctgaacaagcgcagcggcgggcttttgtcattcgggattatcgccgtcatctggtcggcttcgaatggtatgaacgcgattgtcagagcatttaaccatgcctacgaagtcgaggaaaaccgctcatttatcatcattcgcctgacctcaatttttttaaccattgcgatggtggttacgattttaatcgcattgcttctgccggtgttcggcagagaaatcggaatgctggccgcggattttatcggcgcctcggacctgtttttgcaggtgtggtcggttgtccgctggggtatcagtccgcttatcctgttaatcgtgtttaccgcgctttacattttcgcgccgaataaaaagctttccctccgttttgtgctgccgggagccgtattcgcggcagccggctggattatcgtcagtatgctgttctcattttacgtcggcacctttgccaactacagcgccacatacgggagcatcgggggaattatcgtccttatgatctggttttaccttacgggaaccctgttgattttaggaggagaaatcaacgcgcttttacataaacgtaaaaagcttcctgatgaaaatccgtaccgcgggagcaagctatagaggaacggatgacgttcaagctgaaaaacggagggaatcggctatgaccaagcatacgaaaaaaggcggaagccataataaacaaaactcaaaaaacggcccgaagaataaaacaagcggaagcgccaacgggcagaacggataccactagaaagaagccgcctggctcagatcaggcggcttttttatgtggccggaaaagaatgggattcggaagcggggctgtgctttgttttcccgaagacgagcgcaagccaaatacagaccagaatcaccgtaataaagtaaaacaagttggcgctttcaaaccgctgcatataccagccgcccgccaccgggccgatcatgcttccgagactgaaggaaatgccgcagagcaggttgcccgccggcagcagatgggacggcagcaggtcgctcatatagctgatgccgagggaaaacatactgccgaccgccatccccgccgtgaaaaagcagcagccgatgacagaaggcgacggaaacagtccggccgtcaaaaagcaaagggcacccgttaataagatgacgagcaggacacgttttctcccgaatcgatcgcttaataaaccgagagggaactggaatacaatacctccgatggcaaaagcgggcaagatcagcgcgacggcatcaacggatatacctaaacgaagggcgtacacgggaaagcttccgttcagcgccgtttctaaaaaaccgtacccgaaagccgggagaaaagcgacccagccgaaaagaagggcgcggtaaaaccgttttgcgctgttgtccccggatgtttcatccggaccttgcgccgggtactcgttacgtaaggcaaacacaaacagccaggcacaaagactgatacagccggatacgataaacggaagggacggacttgttttcacaagagggaccatgaaagggccgacagcgaatccgagcccgaaggacagtccgtacagcgaaatgtttcttcctctgtttcggggcgttgacttggaagtcacccacgtttgggttgaaaaatgcagcatatgatccccgattccgataagcagccgaagaaaaaaccataaccatatggattgaagccaaataaaactgaataagctgatgataacaagaaatccgcccatgaccatcagaggtttgaatccgagcttgcgcagcggggcctccataaacggcgacgccagaagcacgccgatataaaggccggttgcgtgaagtccgtttatggctgcggattctccgttcgtttcaaaaatgacggagatcaccggcagcagcatgccttgggaaaatccggagatggaaacaagcagaaccaaaataaagaagtacagtcgtgacatcgcgtatttctccttcttcagtatctttcttgatcgtacacggattttccgcgtccggcaacctgaaaatgccaattcgggctgccgaggaagtgtaattgagggagtttttgagaaggatataaaaagacttattcgaaaaaaggagccaggcagatatgaatcggatttttttctttacggctgcggcgggagttccgctttcagtcatcggcggcctgatgcactggccgtcagcggttttgtttattatttattgcttgacgattattgcgcttgcaagttatatggggagagcgactgaatctcttgccattatcgcgggaccgcggatcggcggtctgctgaatgccacgttcggtaatgcggtagagctgattatatcgctttttgccctaaaagaagggctgacgggcatcgttcttgcttcactgaccggttcggtgctcggcaatcttttgctcgtcgcgggactgtcgttttttatcggcggtttgaaatataagcggcaggaattcaatattcatgatgcacggcataattcaggcctgctgatttttgccattatcgtagcttttgtcattcccgaagtattttccatggatatgggggaaaaaaacaagctaaatttgagtgtcggcatcagcatcatcatgatccttttgtacgtggcagctctttatttcaagctcgtcacccaccgcggtgtttatcagccgaatcagccggaggcaaaggaagaagaggagcagcctgagtggtcggggaaaagagcgacagccgtcttatttatttcaactattattgtcgcctacatatctgaaaaccttgtccatacgtttcatgcggtggctgaacagttcggctggagcgagctgtttatcggggtgattatcgtcgcaattgtcggaaatgccgcagagcatgcgtcggcgattattatggcgtacaaagacaagatggatgtcgccgttgaaatcgcggtaggttcgactttgcagatcgccatgtttgtagccccggttcttgtgatctgttctatcttttttccggtcaatatgccgcttgtattcacattgcccgagcttgtggcgatgatatcatccgtccttttgatgacgatgatttcaaatgacggcgattcgaactggtttgaaggggctacgctccttgccgcttatgtcatcatggcgatcggttttttcctgctttaacctgtaaaaaatgcggataacaacgattgcggaggaaaagactaaaggaaaatgctatagaaagagtgatatgatgagaaagctgtttcatgccacattgattctgctgttatcctttagttttttcgcaatgccgtctgccggtgcaaagaaaccgtttaaggttcccaactctgtcgtaagcatttcaaaggaaaatacgtatccgaatgcttcacaggaccagccgatgcttcagccgagcaaactggcaaaggaattgttagatacctccgagatcaacatcgaaaatccgcatctgataaagatgctgaatgaatcctcggtttccggttcaccgcttgccatcggatatcgggcgacaatatttctcgggaaatgggcgctcggctatcaatcgaacgaaacggtcgccaactgggaatataaaaaaattaacacaaacagagcggataaccggggcggacagcaaaccgcggttatctcatatgcccaagaacagcaatacaaaatcaaaggcgggctcacagcgaaggtgccgaacgcagaagacgtaaaaagtatgatgatgcaaaaagcgatgaagaaaacaaaactgccgctcgcttttgaaacggttatcggcgcaggcacaaaacgcgatcaaacctacaaaatttctccgcagcggctcggctacctgcacgcctacgctccggccgttaatgaaaaaggaaaagtaacatacggtgaagtgtatttggtgctgaaaggcagcaagcggaaacttgtcgtcaaaaatgtgacttcgcaaggaatcggggcttggattccggtacaggatcacgtcacattcggttttcaaatgacagcgcagccgagataactaaaaaagctgattccggttcgggaatcagcttttttgtgtgtgatacatttcctcaagcaattgcacattgttgttgtacagctcccgggcaagaacgcgtctcaccgcaaggctcgccgagaagtattctttatcttgaaccatgcctttgacggtaaattctatgcctctcgtcaatttgttcaggctcatgattccatgcacttgaaacggctccgtcgcattgagaaattcatctcgcttcagtgaatcgcgaagctcatcattgagcatgtcgcaggctttttctaagacggcatatacccgctcgggatcttctttataactgatcacgacggactcggtaatccgcataaaatcaatgttatagttttgaagctgtctgacctcaccgtttgaaatggtaagcagcttgccggtccactcacggatctgaagggaacggagcccgatttcttcgactgtgccgttgaacagattgttaatcgtcacgtaatcgcctttatgaagctggcgttcgtatatcaaaaagacaccggccaatatgtccttgattaacgactgggcgccgaaaccgatgacgataccggcaacacccgccccggctaaaattcggccgaaatcatgaacgaataaagaaatgacgtaaaagataaaaccgatcgtcgccgtatactgggtgatggatcggacgaggctttcaatcgttttccctttccgttcctccaagaaatctatgcgtttaaataacacctggacaaagcggttgatcagaaaaacaccggcgtaaagcacgagagcgacgatgatgatctcaaccactttgcttttcaaaatgtccgtaattgtcgtttccatcttctgttaacctctggcttttcgtaatgaaaaatccgtgtcctgataataactgtttttgacaaggacgttcggtccgaggcaccggacgtttgtgcagcggcagttcagctctttgctcagcttcgtctgtctccacttgtcatatgcattgggaaggctgtctgttttaatattgccgagcggcggtgtatcgccgaaatccgtgacaatgatatttccgtcaaaaatgttcacattcaggcgggagcggccgtcagggtcgtttcgcaccgtaacgtatttcgcttcccgcaggcggcggaggagcttctggtcttcttcatcagggctgcatgcgtaaaacgggagcgtgccgaacagcatccatgtctcttcatcgcgaatgtcgagcagatgatgaatggcctgtctcatgtccttcaggctgagtgattcaagcgcgctggcgaaatcactcggatacatcggatggacttcgtgccgctggcatttcatttcttccgtaatctgccggtgaatatgttcaatatgcggcagcgtgcgtttgttcagcatcgtttccgctgaaaccattacgcctgcttcgaccagcgtgcggctgttttcaatcattttgtcaaaatagcgcgcccgctgttcaaatgtcggtttcttctccatcatcgcaaatccgatgtcggcaaagtcctcgaccgttccccagttgtgggaaatgtgaagaacgtccaaataaggaataatccgttcgtagcgcccgatatcaagcgtcaggtttgaattgatctgtgtgcgcacgccgcgttcatgcgcatatttcaaaagcgggacgacgtattcctttaccgatttcagcgaaagcatcggttcgccgcccgtaatgctgatagagcgcaacagaggaatttcatcaagccgctttaataaaaggtcaatcggcagcgcattcgggtctttcggctggagcgtgtacccgacggcgcagtgctcgcatctcatattgcacaaagtcgtcgttgtgaattcaacgttcgtcaatttcatatctccatactggtcgacatccatgtacgcttcccaaggatcgtactccggtgtgatcggacgcagtgttgtgttttgtgtcatgactatctaactcctttataaatggggcatactaacgtctgccaactgttaattttagacctgatctgccaagatcgcaagtagcggaaccattgaaaaacgccaaaaaatacgctaccattataaaaaatgaatggagtggaagtatggggaatgcagtaaacagcaaagatcagcagctcgattacctgaagaacagactcgatatgtttatgaatgtcattgattcattagaccctgaatcaacggacgttgaagatatagaccggctcattggcatgcttgatgatctggaagcaaaatacgaacgctttaaaaaggattgggaataacccccggcggatgccggggtttttctttttccataatgcggctgtataaaagggcagggcctactgcaaaataaggaaaaatgcagaaggagtgctggtcatgaaatggttttgttcaatttgctgcatggccgttttacttgcaggaggcatcaacagcgcagaagccgtgccgaatgaacggataaactggggatttaaacgcagcgtcaatcatcagccgccggatgccggcagacagctggacaatctggtcaaaaaatatgatgccttttatttgggcaatacgaaagaaaagaccatctatttaacgtttgataacggatatgaaaatgggtacacccccaaagtgcttgatgtgttaaaaaaacatcacatcacgggcactttttttgtcacgggtcattttgtgaaagagcagcctgatttgattaaacggatgtcaaaggaaggccatatcatcggcaatcattcttttcatcatcctgatctgacgacaaaaacgggcgatcagattcaagacgaactcgattccgtcacggaagctgtgtacaacattaccggaaagcgggacaacctgtatctccgtccgccgcgcggcgtattcagcgaatatgtcctcaaagaaacgaagcgtctcggctaccaaaccgttttctggtccgtcgcatttgtcgactggaaggttaacgagcaaaaagggaaaaaatacgcctatgatcacatgataaaacaggcgcatcccggcgcgatctaccttctccacactgtttcaaaggacaattcagaagctttggacgatgccattaccgatttgaaaaaagaaggctacacgtttaaaagcattgatgacctgatgtttgagaaagaaatgaagctgccgcgcctgtaaaaaacacctctcctggtaatggagaggtgttttgttatttgatacatttaatcaaagcggcccaatccagatccccgaagccttgtgcgaccccgctttcaaaatggctcttcgccagttcggcaagagggagttttgcggaaacctgttctgcggcggcgagcgccagattggtatccttcagccctaaagacattttgaagccggccggctcaaatttctcctcagccatgatcgtgccgtaattttgatagacgggagagccaaagagcgcaccggcgatttctaaaaattgtttttgttctaaaccgaacttttccatcattaagaatgattcagataacgcctccagcatagaaacgagcaagaaattgacgctgattttcgcggcattggccgtttttgtttcttcacccgtatcaaatacttgctgactcaggattttaagcagcggttcggcctttttcttcgcttcagccggtccggctgtgatgatgcgaagctcggccttctcggcggcatcggggcggccgaggacgggagcggcaataaaggactgccctctgcccgaatgtgcggcggaaagctgttctgacagcgccgtactgatcgtgctcattgaaatatgaatgccgttttcagataacccggcaataatgccgcaagctccgaacgtcacgcctgttacagcttcatcgtctgacagcattgaaagcacaatgtccgcatgttcagctgcctggcggggcgtttcggcatattcggcccctttatccagcaggtcagccgctttttctttcgtccggttatatacagtcaggctgtatccggctttcatgatattttcggcgatggggcggcccatattgccgagtccgacgatggcgatcttcatttgacagtccctccaatgaaaagttttccaccattatacatgcaaaatggttaatctgctgtgtacaggatttccaccttcagttcaggttctgaagaccatccggagtctgaggcggctttccccttataaaatccggtaaaccgcgtcttgatgattgttttcgaacggggctttacagtgaacgtttttgatttgaatgtgacgtcctttatgttttctgataaatccggcgtgacagaaatggtttgttccccttttccgtaatgattgatataaagcgtgcagctcatgcccgctctttttcgctcaatcagatgactgcattcgctgcggtgcttcaaatattcgacagactctttttcgggcgcgaactgttttaaggaaaaagcggcatattcggtggcaggactgataccggaagcggcccccatactgagaaagatcagaaacagccccgccgcgggaagcgtccgcctgaacgcggcggcacaccagattaacgccgcaaagtaaaggacgaccccgggaatgacggagatatgggctccgtcttccgaccaagaggaaaagccgagtaactcaaagatgtaatcagacaccgtacagccgttatacagcggggcaatggacatgacactgaatagcaggaggacagaagaaatgattttgtgagaaaagatggtaacggcgcacacctctttacgtttttttccagactatcatgttttctcaaaaaaaagaacagccggcagccgttcttacttgaaaatattaaaccagcctttgcgggcgaaccaaaacagcatggcggccacaagaacggccatgacgcccaaaacgataaaatacccgtatttccaatgaagctcaggcatgttatcgaaattcatgccgtaaacccccgcgatgaacgtcagcgggataaaaatggtcgagacgatggttaatgtcatcataatggcgttcatccggtttgaattcagcgtcacatagctgtcccgtaaatctgacgtcatatcacggtttgactcgatcagctcggccagttttaacaggtggtcataaatatcgctgaaatatgccttcgtttcacggctttcttttacatggtcaaggctcaaaatccggtacattaaatcgcgcatcggaatgatcgtccgtctcaggttcaaaagatccgtccgcaattcaaacacttcattcattaatgtgccgtaagatttatgggttctgctgtcttcaatttcattcagccggtcttcaattttgtacagcacggggaaatattcatcgacaagctgatccataatcatataagtgatgtgccccggcccttttttggctaatcccggggaagcgaaaaaccgttctctcacccttgagacgccgggcgattcgtgcaaatggaagctgacgatgaaacggtcggactgaaaaatgtccacctcttccatttccagtgtgtccgggttcaaggcgtggagcacataaaaacggtagccgtcataatggtcgattttcggccgctgcatgtgctgaaagcaatcctcgatcgcaagcggatgaaagtgaaaataatcccgcagcagctcggtttcatgcatctcagcgccgaaaaaatcaatccagtaccatgcgatgtccggttgttctgtacgtgatagggggatattatctaatatctcattatgtgttgtgattgcggttatatgtatcataaacaaccctccgcctgccattatatcatgcggcgttatgaagaaaagtatacgaattgccgcccggccgcttcatgatatacttggacaaaaaggggtggagcatatgtggaaggaaaccgtttcggtcacgccgccgtatcattttgataaagtccttgaaaggctgtcgctcgatccgctgaatgcggtcgatcttcatgcaagatcaatcaaagtgccgctcagaacacgggacggcaaactgtccgtcatcacggttcaagcggaaggcaccgccgcagacccggtcttcctcgtcagcggagaaacggaccgcgaggagatgattgaacggatcaaacacatttttcagtgggaacagccgcttcagcctgtgcttgatcatttctcaaaaacaaatctgtcggcgctttttgaggagcatgcgggaaccccgctcgtcttggaatatgacgtctacaactgtctcatgaaatgcatcatccaccagcagctcaacctgtctttcgcatttaccttaacggaacggttcgtccatgccttcggtgaacaaaaagacggcgtctggtgctatcccgaaccgaaaacgatcgcggcgcttgattatcaggacttgcgggagctccagttcagcatgagaaaagcggaatatgcgattgacatttcacgcatgattgcagacggagcgctcaatctggcggaacttacccatttatcggatgaagacattatgaaaaagctgatcaccatcagaggcatcggcccgtggaccgtccaaaacgtcctcatgttcggcctcggccgcccgaatctgtttcctttggcggatatcggcctgcaaaatgccatcaaacgccgcttcgcccttgaggataaaccgtcaaaagacgtgatgcttcaggtaagcagcgaatgggcgccgtatttaagctatgcgtccttgtatttgtggagaagtattgaatgaaaaaccgctttgaggatttttggaaacttccagtgaaaaacattaaggaaccgccggctgcatgttatactgaaaagatgtgatatttcaaatcagccgttttcccaggagaaaggctttatatagaaacggagagaaaaaaacgtgaatcaacatcaaaaaaaggcgcctgccgaattgaaaatcgggcagacatttccgctgaccatcaaacgtctcggcattaacggagagggcgtcggctattttaagaaaaaagttgtcttcgttcccggcgctctgcccggggaagaagtcgttgccgaagcgacaaatgtgcagccgaaattttcagaagcacgcgtcaaaaaaatccgcaagccgtctgaacaccgcgtcacgccgccatgcccggtctacgaccagtgcggcggctgtcagcttcagcatctggcatacacccagcagcttcgcgaaaaacgcgacattgtcattcagtctctggaacgtcatacgagattcaatgtcgaagaaatgaacattaaagatacgatcggaatggacaacccttggaattaccggaacaaaagccagttccaagtcggacgctcgcaaagcggcagcatcattgccggcttatacggacttgattctcataaaatcgtcccgattaaggaatgcattgtccagcatccggcgacaaacaaaacaacgggtatcgtccgccgtattttggaaaaacacaacgtatccgtttataacgaacggaccaaaaaaggcgatgtccgcaccatcgtgacgagagtcggttttgaaacaggcgaagtgcaggtcgtgcttgtcactgcgaaagagacactgccgaataaagatgagatcgtcaaagccattcagaaccgactgccggaagtgaaatcgattattcaaaacgtcaatggcgcgcgcacatccgtcattttcggtgacaaaacaaaagcgctggccggaagccatgccattcaagaagtgctcggtgacgtgtcatttgaactgagcgcccgcgccttcttccagctcaaccctgagcagacggtcaagctgtatgacgaagtgaaacaagcggctcagctgacaggaaaagaaaaagtcgtagacgcgtattgcggcgtcggtacgatcggcatgtgggtttcaagcggcgcaaaagagatccgcggcatggacgtcattaaagaatcaattgatgatgcgaagaaaaacgccaaaaaacacggcatcaaaaacgcggcatatgtcacaggaacagccgaacactggctcccgaaatggtcgaaagaaggcttccgtcctgacgtggtcatcgtcgacccgccgagaacgggctgtgacagaacatttttagataccatcaaaaaagtaaaaccgaaacgcttcgtctacgtatcctgcaatccttccacactggcgaaagacttgcagacgctgtcgaaggactatcgcgtcgaatatattcagcctgtggatatgtttccgcagacggctcatgtggaagccgtggcgaagcttgtgttgaaatcgtctaactaaaataaacaattcgtaatcagacctggattcggtataaacatttccgatttccgggtttttttatgcggagcctttgccctggctgtcttttctaaactttatgtttcttcttttctcggagatctttatttaaactgacgaaaagagttgaaaaacgtgtggaaaagcgagtgaaaaacagccaattttgacctcgtttgtataatgatgatgtggtgtattatgacattattgggataatgtaaaataatttgatatcattggttttagatgaagttgtaacattattcaactgtaaagtatttatcatgccaaagtaagtaggtctttaataaaagataaacaggaggtgaaaccgaatgagagatattggaatttcaacaactgaacgaaggttctgaagtagaagctgtaaaaggcaagggtgcttacttacactaatcaccagcggcagttggcacatcgataaaagatcaaacacactaaaaaagcatgtttggtcgttatacataatatgaaagcctaaacaggaaaaaaggaccccaattatttcccttattcccaaaaaaggaataaatccgaggcggaaccacaagtgataacaactcttacagtaatacctgcgatggttatatccttaataagtaattatcgcgacaatcgtgcttcatcatataatgatgttagattgtcacttggctaaaaagtattgcagaaaaggaaatggtaattgaaatgggtaaagtatataaaaaacgaccgttatataaaaaaagttggtttcacacgttgttggcatttttaatatcacagctttattttagttttgtagaattaacgggatggggtccgaattatagagaaatgaatggattcccagcaaacatagctgaactggatttctttcaaacatatctttcattctatgataatccatggtttaatattgtcactgttttcttgggggttttcactgttatacaaatcattacaggtataacaaagaatattcgaatgaaagcaataacttctgacgccttatttaatgatgaaagaaaatgaacactttcttattaatcttatgagtgaggactgcggcacttagtcagcagtctattttattggttttggatcagaattaccgaagcgtaaccttatacaaatatatataggtgattgtataaagatattaacatatgggctttgaaagccgatcgacccttagtacatatactgtatagagccaagccacttgctgcgttggttatttctaaaccatgagcaaatccgaaaagatccagattgaagttcttgaattctgttaagttcaagtttattttctcttcccatcctctttacttcatgtgattcacaatcggcaagttaaggctttttctttttacattctcttcagtactcagatatacccccccagccccatttgcttaatcaacttatttcttgaaatttgttttatggtaatagggagaactcatatgatattctatttaggttggactcctttttatccaaaaagagcaaaagtaaggccgctaagaaagatgaaggtcagcgctaatcttaataaaccacaatataaataaaaattaggtgtagataatcatcacactttttctctctcagacccttttaaaggtgaaggagttgactgagttgatcagaaatgaacggtatggggttaactatagcggtagtctattacgttaactcaattaatgtgttctactccagtttgctttttcactttttaaaaagtgaaatgttcaaaatttactatcgtttgataagaagtgctgacacatgctataagtgtaaaagaagcatggtcagtttttaattttgggataaaggtttggctgtatcccatcatgaaaggatttggatttgttatgacagataatttctggcgtgaattaccgcggccattttttgtactggcaccaatggaagatgtgacggatgtcgtttttcgccatgttgtgagtgaagcaggcagacctgatgtgtttttcacagagtttacaaactcagaaagctattgtcacccggatgggaaggatagtgtgcgcggccgtttgactttcacggaggatgaacagccgatggttgcccacatatggggagataagcctgaaaactttcgccaaatgagtattgggatggcggaattagggtttaagggcctggatatcaatatgggctgtcctgtccctaatgtggcggggaatggaaagggaagcggcctgatttgccgtcctgaagttgcggcagaattaatacaggtggcgaaagcaggaggtctgccggtaagtgtgaagacgagacttggctacacggatgttgacgaatggcgcggctggctgacacacatactgaaacaagacattgcgaatctttccattcatctgcgtacaagagcggaaatgagtaaagtagatgcgcattgggagttgatcccggaaattaagaaacttcgtgacgagattgcgccagatacccttttgacgatcaatggggatattcctgaccgggagaccggcttgaaactcgctgaacaatacggtgttgacgggattatgattggacgaggcatttttactaatccgttcgcctttgaaaaggagccgagagagcatagcagtaaggaattgcttgatcttttgagattgcatctggatctccatgatgagtattcaaaagaagaagctagagcatataaaccgctccctcgctttttcaagatatatctccgcgggttccggggagcaagtgaattaagaaatcaatgcatgaatacaaagtcaacagatgaagtgcgtgcattgctcgatgactttgagagaaagtatcttgatgggatggagcaagagtgacataaacaactcttcatccggcccggagttcggtttgaattccgggtctttttgtgtgcagcttttacccagacagatccatggccggtttcgtcatgcagaaataaacgaataatggtacattgataggacatacatcataaagggggagagaaaaatgaaacgactgtgcatcatcccctgcggcaagaaaaaaatttgggatgtccattcagatacagggccggtaagggcggaagacgcttatctcagcccgtttcatcaggcatgcgagcgatatgcgaaagcatttttcgatgagtgggtgattttgtcggcgaagcacggattccttcgtccggatgatactgttcccggaaattacgatgtcacttttggaaccggtcacccggagatcatggcagcggacgagctgcgccgtcaatttcatgaaaaaggcttttccgacgtcgaagagcttgtcatgcttggcgggaaaaaataccgaagtgttctaaatgccgtcatcggagagcatcagcatatcacctggcctctgtcatcgtataaaggcattggctacatgcttcaagcgctgaatcaggctgttgaagaaaaggatgaactgcagcacgtggatatgaaaaaaagagtgtaaccactcaaacgccgcgatagactgtatgcggaagaatgaagcaataaaagatttccgaggaaataaatacgtcgatcattgtcaaagacagggtgatgcccggtctttttttatgccataaaacgagacaaagggaacagatcgagacaaaatgagacacctgtctcaaactgtctccattgtaaaaataaaaacattcattttacgggcttcaaaggctggcatgcttcttgcatttataagtgtgaaccctaaatagaaggaggcgcccaaaatggaattgttaaaacgagaaggcttgtcattaactgaggagaaagcgctgtggatgtaccaaaagatgctggaaatcaggggctttgaagacaaagtgcatgaactgttcgcgcaaggagtgcttcccggattcgtccatttgtatgccggtgaagaagcgatagctgcgggggtgtgcgctcatttacatgatggcgacagcattacaagcacacacaggggacatggccattgtatcgccaaaggctgtgatctggacggcatgatggcggaaatattcggaaaagcgaccggactgtgtaaaggcaaaggcggctctatgcacattgcggatcttgataaaggcatgttaggcgcaaatggaatcgtcgggggcggattcacgctcgcatgcggatcagcgctcacggctaaatataaacaaactaaaaatgtaagcgtttgcttctttggggacggagccaataaccaaggcaccttccatgaagggctgaacttagcggcagtatggaaccttcctgtcgtgttcatcgccgaaaacaacggctacggcgaagccacgacatttgagtacgcgtcagcctgtgattcaatcgccgatcgggcggctgcctacaacatgcctggggtcacggtggacggaaaagatattttagcagtttatcaggcagccggggaagcgatagaaagagcaagaaacggcggaggcccgtctttgattgaatgtatgacttaccgaaactacggccatttcgaaggcgatgcccaaacttataaaacaaaggatgaaaagactgagcatcttgaagaaaaggatgctatccaaggctttaaaaactatcttctaaaagaaacagatgcaaataaattgtcagacattgaacagcgagtcagcgaatcgattgaaaaagccgtctcgttcagcgaaaagagtccgtatccgaaagagtcagagctgttgacagacgtctacgtgtcatatgaaaaagggggaatgtgagatggcgagagtcataagcatgtcggacgcgatcaatgaagcaatgaagcttgcgatgagaagagatgaaaatgtgcttttaatcggtgaggatgtcgccgggggagcggcggtcgatcatttgcaagatgatgaggcatggggcggtgtactcggggtcacaaaggggctcgtacaggaattcgggcgcagccgagtgctggatacaccgatttctgaggcgggctatatgggtgcggccatggctgcggcatccacggggctgagaccgattgccgagctgatgtttaatgattttatcggaacgtgctttgaccaagtgatcaaccaaggggcgaaattccgctatatgttcggcggtaaagcgcaagtgccgatcaccgtccgcaccacatacggagccgggttccgggcagccgctcagcattcgcaggcgctgtatggcctgttcaccagcatcccgggtctgaagacggttgtgccgtccaatccgtatgacgccaaaggtttgctgctggcggcaatagaagacaatgatccggtattcttttttgaagacaaaacgtcctacagcatgaagggcgaggtgccggaagattattatacaattccgctcggaaaagcggatatcaaacgcgaaggcagcgacatcacgctgtttgcggtcggcaagcaggttaataccgcgcttgaggcggctgcacagctttctgagaaaggcatcgacgccgaggtgcttgacccccggagtctgtctcctttagatgaggaagcgattttcacatcgctagaaaaaacaaaccggctgatcatcattgacgaagccaatccgcgctgcagcatcgccacggatattgctgcgattgtcgccgataagggctttgatttgcttgatgcgccgattaagcggattacagcgccgcatacaccggtgccgttttcgccggtgcttgaagatcaatatttgccgacaccagaccgtattgtcagcgtcacacttgaattgcttggcgagccggcaatgaattaaaggagggatatagaatggctgtaaaagtagtaatgccgaagctgggaatggcgatgaagaaaggtgaagtatccgtctggaataaaaaagtcggcgacccggtagaaaagggagaaagcatcgccagcatcaactcggaaaaaatagaaatggaaatagaagcgcctgaaagcggcacgcttcttcatattaaagtcaaagagggagaaggggtcccgccgggaacacccatctgttatatcggggaaaacggcgaagaagtgcgggagaaggaggcgccggctcctgaaaaagcagggaaaccgcaagctgaatctgaacatattcccgctccaaaagccgggcaaaagcgtaaacaccgcgtgaaaatatctcccgttgccagaaaaatggcggagaaagccggattgaaagtcgatacgctgaacgggacgggtcccggaggccgaatcgtaaaagctgacgtcatcaaggcgatgaagacggaagctgaaccgcagtcttcggtacagacggcacagccggaggaaaaaccggcttcagcgatgagaaaagtgattgcagaccgaatgcacaaaagcctgcaaaacagcgcccagctgacgctgacgatgaaagcggacattacggagcttgtaaaatggcagcagcagctcgccgacagcgcgaaaaagcggagcggtgttaaactgacggtcacacatttcgtatcccgggccgcggtgcttgcgctgaaacagcatcctgagctgaacagctcttatcaagaggagcggatcatcacctatccatatgtccacctcgggatggcggtttctcttgaaaacggtctcgtcgtgccggtgatccgggatgcggaaaagctttcattccttgagcttgcggatcacatcagcacatcggcacgccgggcgcgggaaggcaatgcttccggagatgatctgcacggatcgacattttctattacaaatctcgggggttacggaattgagcatttcaccccgattcttaatccgcctgaagccggtattctcggagtgggcgcaagctatgaaacgccggcgtttaaaggagatgagcttgtcaaaagcaccatgctgccgctgagtcttacctttgatcacagagtatgtgacggcgccccggctgcggacttcctgaaaacggtcaaagcgctgcttgaagagcctgccggtttgattttatagagagaggtgaaaaaatgaaactagccattatcggcggcgggccggccggatatgcagctgccgtgactgccgcgcggagaggagcagaagtcgttctgatcgacaaagggccgctcggaggcacttgtctcaatgaggggtgcatcccgacaaagtcgcttttggaaagtgcgaatgtgctcgataaaatcaggcatgcaaatacattcggcatcgaactgccgcaaaacattacactcaattggaactgcatgcaggggcgcaaacggcaaatcgtcagccagctcgtgcagggaattcaatacttaatgaaagcaaatcagattaaagtcatcagcgggacagcctcatttctcacagagcagacattgcttgttgaagaagaaggaggcgcaaaagacattctggaagcggaccggatattgattgcatccggatctgaaccggcggagctgccgtttgccccatttgacggcgattgggtgatcgacagcaaagatgcgctttctttacagcaaatcccttcgtctctgctcattgtcgggggaggtgtgatcggcagcgaatttgcctctttattcagccggtttaaaacgaaagtgacggtgattgaatcggctgaccggctgctcccggcagaagacggggaaatcgccgccgctttcgaagactctttaagagacagcggggctgatattcagacaaaagccgcccttcagcggattgacaaagaaaggaaaaccgccgtgtggacaaaagacggaaaagaaattgaggctcaggctgatcacattttggttgcaatcggcagaaagccgcgtttgcaagggctgaatttggatcaagccggcatccggtattctccgcgcgggattgaagtcaatgaccatatgcagaccaatgtgcctcatatatatgcgtgcggcgatgcggccggaggaatgcagctcgcgcatgccgccattcatgaaggaatcacagccgccgcgcatgcctcgggaaaggacagcaaagtcaatatgcgggcggtgccccgctgtatttatacatcgcccgaaatggcagctgtcgggctgacggaaacacaggcgagagagacatacggagatgtgaaaatcggagaatgctcattttctgctaacggaaaagcgttaattaagcatcagcacggcggcaaaatgaaaatcattgccgaaccggaattcggagaaatcgtcggagtgtcaatgatcgggccggacgtgacggaattgatcggtcaggcggtcatgatgatgaacggtgaaatgacggcggatatgtcggagcactttatcgcggcgcatccgactctgtcagaaacgcttcaggaagccctgctgaatgtcaccggacttgcggtgcattccgtataaccggaataccctttctcagatgagaaggggtatttttcgttgaaagcgctttacttttcccctacaatatatgaaaagatggtctgaacaggggggagcgaatacaatgaatgtcattcggaatgattttaaaacctggaagcgttttgtgaaagaaggcgtgctcgatgaatcccgtattcagaagcgggtggccgcctcatggcaccgctgcaaaaaagccgacgtcaatccttatctagaaaagggaccgaatgtaatgccggcagatcatttagaaaggcaggccgaaaagcatgcgttatttttagcggcctcaacgccgcacgcagaaagaatgaaaacggcgatgcgggaaatggaaatgatggttcttctgattgattctgacggcgttgtccattcagttgacggccacccgcgcaccattcatgaagcgaaccgcatcaatttcttaaaaggcgcccgctggacggaaacggccgtcggcacgaatgcgatcgggacagctctttatacaaatgagccggtcatgatacacggctctgaacattattcgctcgcttctcatcaatggagctgttccgccgcgcccatccgttatgaagacgggcggctggcgggtgtcattgatatttcctgccccgccgcccgcgctcagccttttatgctcggaattgcctcctccatcgcttatacggcggaacgggagcttgccctaaagatcaaaatgacagaacttgacatgatcagcaaattcgccgggcttacccggtctcacgatccgatcgtgctttgcaatgaaatgagccgggttatcgccgcaagccgtcccgttcagcattttaccggacatatgctgcgcgagcttgaggaacagggctatcatatcaagcagacgaagcgggaggagaacggcttctcatgcatttacttatctaaacgagaagaaaagccgtcgtttatatttcatggtgcggcaggcaaaagcccgtcatcccgacatatgctccagcagctggagcttgtcgcccgaacggacgcaaccgtttgtcttacgggagaaaccgggacgggaaaggagattgccgcccgggcgattcacaacaacagctccaggaaaaacggcccgtttatcgctgtcaactgcggggcggtccccgaaaagctgattgaaagcgaactgttcggctactcggaaggcgccttcaccggagccaaacggaaaggacataacggcgctttgcaaaaagccgataaaggcacgcttttcctcgatgaaatcggagaaatatcacactccatgcaggtcgctctgttacgggtgctgcaggagcggaaagtcaccccggtcggcgggacaaaagagattcccgttgacatcagaattatcactgccacccacactgatctgagacagcttgtcgaatgcaaaaagctgagagaagatttattttaccggcttcacgtctgtccgatccacctccctccattaagagaacgcaccgaagacattcccggcctcttccttgaatttcagcgaaatcgcggctggcggggggagcttcctgatgattttttagacctattaaagagccggaaatggccggggaacatcagggaattgtttaatgtatttgaacgtctttccgtcatgttcccggacggacggctgtcagggcgccccatcgcagccctgcttgaagcgtcaggtcttaaagaggcggccgagtcttatgaacaggaagaagcgtcccctgtctccatccgggagcacattcagaaaaacatcatcgtaaacgcgcttgaatcagcgaaggggaatgttacacaggccgccaaaatggccggaatcccgcggagcacgttttacaaacgcctcaaaaaattcaaactcaccgccggacaattgtaagaaacaagcatacttctcttggctgccggacacgttatgtgtgaggcctaaaggaggtttgagacgtgaatacacagcgtgcgaaagacatttcggaatccgccgccatggcgtatgtgacgtatgaaggagttccgatttatattcagcatgtcaacgaagacaaggaaacagccaggatttttccgatcggaaatccacaatttgagcaggaagtgctgctttctgatttacaagagcatttttgagaaggggtctgctgatgacagcaggccttttttgtacctgtgggaactttcccgatttttgagaaaaataactaaaaatgatcaaatgatctaactcctccaaacccggtacagatcggaccttctcatgatataaataaaatgtaaacgttatcagaggagggcttcacatgacagacaaatcattctcaatcgttattgcaggcggcggcagcacatttacccccggaattgtattaatgcttttgaatcacctggaagagtttccgatcagaaagctgaaactttatgacaatgataaagaaaggcaggagcggattgcgggtgcgtgtgaggtattcataaaagaaaaagcgccggacattgaatttttggcgactgatgacccagagacggcttttacggatgttgacttcgtcatggcgcatatccgcgtcggaaaatatgcgatgcgcgcactcgatgaacaaatcccgctgaagtacggcgtggtcggccaggaaacatgcgggccgggcggaatcgcatacggcatgcgctctatcggcggtgttctggagattcttgattatatggaaacgtactcgcctgacgcatggatgctgaattactccaatccggcggcgattgtggccgaagctacacggcgcctcagaccgaattcaaaaatattgaacatctgcgacatgccggtcggaattgaggatcgcatggcgaacatcctcggattatcttcacgaaaagaaatgaacgtccgttactacggcttgaaccactttggctggtggacgtccatcaccgatcgagagggcaatgatttaatgccgaagctgaaagagcatgtccgtgaatacggctacgttccgaagacggaggccgaacagactgaagcaagctggaatgacacattcaaaaaagcgcgcgacgtacaggcggctgatccggatacgcttccgaacacatatctgcaatattacttattcccggatgatatggtgaaaaaatcaaatccgaaccatacgagagccaacgaagtcatggaagggcgggaagctttcattttcagccaatgcgatatgattacgcgcgaacaatcatcggagaacagtgaaattaaaattgatgatcatgcttcctatatcgtcgaccttgcccgggccatcgcttacaacacaggggagagaatgctgttaatcgttgaaaataacggcgcgatcgcaaactttgatccgtcagccatggttgagattccttgtctcgtaggttcaaacggaccggaaccgctctcagtcgggaacataccgcaatttcaaaaaggcctgatggaacagcaggtgtctgtcgaaaaactgacggctgaagcgtgggaagagcggtcgtttcaaaagctgtggcaggcgctgatcctgtcaaaaacagtgccgaatgcccgtgtggcaagactgattcttgaagatctgatggaggctaataaagactactggcctgagcttgatgtaagcccgtctcctatttcctgatgacaatcttccccgttttctttatctgttattctatataatagaaagaaaacggggggatttttgggatgagtcttgaagaactggttaatcagcattacgcgaaattaaatgacaacgatttttatattttaaaatatatattgaatcataagcatacgtgctaccatctcggtatcaatgacatggcgaaagcctgcaatgtctctcggtcttccatcctgcggctcgcccaaaaactgggcttcagcggctatagtgaattccgtgtttttctgaaatgggaggatcagcctgaagagggcgagaatatgacgtttgaaaagctgctggatgatattgaagccaatgtaaaatacgtgaagtcaaaagatatgacggagatgtgccggctgatagatgaagcaaaacggattttcgtttacggatcggggacggctcagagggtgtgcgcccgtgagctgcagcggatgtttgtatcccggcggaagtatctgattttaattcaggacatcacagagtttgatatcatgtgtgatgattttaaggttgatgacgtattcatcattatttctttatcaggcgaaacacccgaattaattccgcaggtaaggaccctgtccgcaaagggagttccgtttatttcaatcaccaatctgaaaaacaacgtcctggcgcaaacgacgccgtataatctttatgcgaccagcaagccggtgacgttaagcgataaaacggaaattgtcgcatttgccccgttttttctggtgggcgaatcgttattccgtgcatatgttgattataaagagcttgaaaattttgatgaatagcgggaggtcacgtgaaatgatgcaaaaagtccagcgcttcggcagcgcgatgtttgtgcctgttttgttatttgcattttccggaattattgtcggtctgagcacgctgtttaaaaataaaacgctgatggggccgctggctgatcctgacgggctttggtatcaatgctggtatgtcattgaacaaggcggctggaccgtctttaatcaaatgccgctcctgtttgcgatcggcatccctgtcgccttagcgaaaaaagcgcaggcgcgggcttgtttggaagcgcttacagtttatctgacattcaattactttatcaatgcgattctgacggtttggggcggggcttttcatgtcgatatgactcaggaagccggcggaacgagcgggctgacgatgatcgccgggatcaaaacgcttgatacgaatattatcggcgccatctttatttcatctattgtcgtgtatttgcacaatcgtttctttgataaaaaactgccggattttctggggatttttcaaggatcttcctacatcgttatcatttctttcttcattatgataccgatttcacttgcggtggcatacgtatggccgatggttcagtccggaatcggctcgctgcaaagttttctcgtttcttccggggcgatcggcgtgtggatttacacattcctggagcggattttaataccgaccggcctgcatcattttatttactcgccgtttgtttacggtccggctgtggctgaaggcggtatcgttacctattgggctcagcatctcggggaatactctcaaagcgtcaaaccgctgaaagaattgttcccgcaggggggcttcgcgcttcacggcaactcgaaaatcttcggcataccggggatcgcgctcgctttttacgccacggcttcaaaggaaaagaaaaaaatcgtcgccggccttttgatcccggtcaccttgacgtccattgtagcgggaattacagagccgattgaatttacattcctttttatctcgccgtttttatttgcggttcatgctttgcttgccgcttccatggcaaccgtcatgtatatggccggcgtcgtcggaaatatgggaggcggtttgatcgaagctgcgaccttgaactggatcccgctggcgtcaagccacggcttgacgtatgtataccagatcatcatcgggttgtgttttaccgctgtttactttttcgtcttccgtttcctcattctcaaattcaacatcgccacaccgggcagagaaaaagaggaagggcaggaaacaaagctctattcgaaaaaggagtacagagaacggaagcaggcttcaaaagaaacagcggcggcagacgaaacacagcgggatacggccgctttgtatattgaagcgctgggcggaaaggacaatattacggaggtcaccaattgcgccacccgtctccgcgtcactgtcgctgatgaatcaaaggtcaaaagtgacgccgatttcagagagctgggagcccacggcgtcgtcagaaaaggcagggcgcttcaggtcattgtcggattaggcgttccgcaaatgcgggagcgtgtcgagaaaatattgaacggttaaaatactgcagcagcagactatgtgcagagcgcttgttaatccggcgctctttttatgttttgaaaaaaatgtatgaatttgtcatacctttgccacctgtacatgcaggagtgaaaacgagggggtgcaaaaaacgaaatgacttctgcggtattttaaatagcaattaacaaataggaggcaaggcaatgacaaactatacgactttcttaggactttacaaacccgataaaacggaggggattgaggttgaaagcattgctcaaaactttgaagcgattgacagcaaaatcggtgctgcgcttagcaatggcacgtcaacttatgaaaatttaaacgaaagacttaaaatgtatgaaaacagatttgaacatgtgacagagcggaacgttatggattttggagctaaaggtgacggcgtaacggatgatacgcaggcatttcatgatgccatggccgacggaggttatgtcgtaacagtacccccgggtatattcagaacatccggattgtttgttccgtcaaatacaatgcttgtcggagcaggcaagaaaagaacggtcattaaattattagacgaaacaccggtcggccattctgttctgaccaacagcgattatacgaacgggaatgaaaatatttacgtcggccatcttacgttggactggaacaaggatacgcgtcctgccggctggaagattccgaagggccctacttcaagctgtttgctttttgcgaatgttgactattcttttgtcgagcatgtgtttgcgaagaacgccggcctgcacggctttgattccacgagcccgaactataacagacatggagaaatggacgaccccacttattatcagcccaacggctgtaactttgtaactttctctcattgtgaagcaacagggtccggcgatgataactttacttgtcattttggattccatactacttttagccattgtatttcttatcacccgatgggaaatgggaatggcacgtccaattcaaattgctttgagatcgatgacggttctcaagatgtatttttagatagctgtgttgcaattggcggtgcccgcggttttgaaattaaggcgcatgactatgcaccggcggctaaacgggttcaactggctaattgccgtgcttacgaaaatgcaatcggtttttgtattagacatattggccaccatttatcgggtgagccgacatcaaaaactgcccatgatgttcaattagtaaattgtcaggcaacaaatcctaaacagaattctatatataaaggcgtcggggcgagtgctttggttgtttcgggctatgattcagttaatatagtgaatttccaagctatttgtgaagatcgttcatacgattacagcaatgacacgatcattatgatttattacaaagggcggtatgtcaatctgaagaatattacgatccgcgggttccgctccgctgctcatgatctgtatgttcttggcggagaaaatgcggtaggaaagtgcatgattgacggtgtttttctagttgacggcggcacgacgggacttgcttttggcggaggcgttgataattgtacagtgagcaatgtatacgggcatagattgggagccggcagcggaacggtcggactctattcttcgggtccggatctgaatatatcaaatattgattttcaaggatatgaaacaacatttcatgtaggcggtaaaaaaacaccgtatgagttgtttaaacataaaggatcttctgttatggcatctaaagattcccacgttacaggaactaatggctttgtcgtcggttctgtccgggggcaggctgcaggaggttctcaatctggagtaatcggttcatataatacgattaacccaaatgcgaactcaactgtatggggctggggttccggcagcactccgttatcagccaacagaaagattgagcttcacgcaaaagaaggaacaattaaggctgcgggaggcgtaacaggttcctcgacattctctgactacgccgagtattttgaaagcctgagaggggaaaagattccgacgggaacacttgtcacacttgaaggtgataagatcagaccggctgaaaaaggtgacctcatgctgggggtcatttccgagaccgccggagtgattcttggcgagtcgagttttcactggtcgggacgatacgtaaagaatgaatttggcggctatgtttatgaagaacagaaagatgcgaacggccatatggtcatggcgccaaaggaaaatccggactttcggcctgaagaagattacgcttcaagagaagagagagacgagtggaacattgtcggactcatcggccaggtatatgtcagatgcgatgagtctgtgaaagcgggagattttattcacgctcataacgggattgcaacaaaatctgatgctccaaatcagcgctggcaggtcatgaaagtgatcaatgagtttgatgctgataaaggattcggggtcgctctcgttttcattcgttaaatgaaatgaaaaagcataaatgaccttcctgaatagcggacgcctttttaaaggctccgctaattcattttaaaatcaaagctccggttcaggagctggtaaaaaagaaaagataagacagcctccatatatctgcacgcctcatatcctcaatttttatcctcaatgattttcgttttttttacacaaagtacataataaaagtgcgccgttcaagggttaatcctttattcatttaagacaaacaaataaaataaatatacatacatattgaacaaaggatttggaggcttacacatgtcaaaggctttatcatatgtaaaaccgtattcccttttggcgggaatcgctctgtttttcatgctcatcgagcttgcggtagagctgatacagcccctgctgatcgggaaaatcattgacgaaggaattttaaagcaggatctcggtacggtttggctgtggggcggtgtgatgatcggaatgaccgctgtttcattcgcatcgggaattttaaattcattctactccgcccacatcagccagagctatgcgtatgatacgcgaaaagggctttttcaaaaaatccagtccttctcttattcgacgtttgcgcaattctcatctacgtcgtttatcaccaggctgacaaacgatgtgacgcaggtccagaatatgcttttcatgagtctccggtttatgcttcgtgcgccgttaatgatcgcgggcggcattattctctcgctgaccgtcaatgtgaaactcgggttttttctgctgatcacggtgccgattttgcttttgtttttgctgtgggtgctgaaaagaggcggcgcgctgtttcggtccgtgcaaaagcggcttgatcaggtcaacacgatcatgcaggaaaacctgacggcgatcaaactgattaaagcgctcctccgtgcaaaccacgaagtgaaacgttttttgaaatcgaatacgaagctgatggaaaaaacggtctccgcttttcgtctcgtggaagcggcgatgccgattttaatgctgctgatgaacagctgcattttgtttatcttatggttcggcgccaaaagcattgctcagggcggagcgcaggtcggcgatgtcgtttccgtcattaactatgcgacgcggattacaggtgcgctgtccgtcctgccatttctcattatggtattttcccgggcgaaggcttccggggaaagaatcggcgaggtgctggaaacagaaggcggcgagggaacggggcacgacccggcacgggcgctagcaggcgggattgagtttcgcgaagtgtccttccgctatccggacatggaaaaagacgcgctgcatcacgtgtccttttcagccagcccgagagaaacggttgccattatgggcgcgacaggttcagggaaatcaacgctttttcagctgattccgcgcctgtacacggctgattcgggcagtattttcatagacggcaaaccgatcggtgaattctccgcttgcgggctgcgcagggaaatcggctatgtgccgcaggaagtgcttctgttttcgggcacaatccgtgaaaatatcgcctggggacgggaggatgcttcactagatgaagtaatggaagcggccaaagacgcgcaaatccatgacacgattatgaagctgtcaaacgggtacgacacggtgctgggacagcggggcgtcaatttgtcaggcgggcagaagcagcggatttccatcgcgcgcgcttttatcagaaagccgtccctcctgctgttagatgacagtacgagcgcgctcgatcttcaaacggaagcgaagcttttacaagcgatcagatcctatgaatgcacgacactgcttattacgcagaaaataacgaccgcgatgaaggctgacaccatcttattgcttgaagacggcgaactgcttgcaaaaggcacgcacaaagagctgatggcacagtctcatctgtaccggcagatttatgaatcacaattcggaaaggagggagctgacagtggagaaagacattcgtaaacctttccgatatccgaaaataccgctcaaaccaaatgaaggcggcagaaaacgcgcgaaagcaaaagatacaaaaggcacgctgcgcagaatctggtcgtatgtagccgagaaaaaagggcttttaacccttgtgatcatcatggtagtcataagcgccatattcggcctgctcggaccgttcgtcatcgggaaagcaattgatcattttatcgtcggacggacgacggacggattggcgggggtgctgttcttgctgtttgggatttacctcgtgcaatcattgtccttatggtttcaaaactattggatgatcaatatttcgcaaagcaccgtgtttaaaatgcggagcgaactgttcacccatctgcatgagctgccgataccgttttttgataaacagcgcctcggcgacttgatgagccgggttaccaatgatatcgaaaatgtcagctccactttaaatacatccgtcattcaagtgctgtcgagcgtcattacattcgtcggcacaatcgccgtcatgctgtacatgagtccgcttttaacattgatcacgcttttgattattccgatcatgcttttgagcattaaatggatcaccaatcggacgggactcctgtttaagcagcagcagaaaaacctcggcgagctgaacggttttattgaagagtcgatatcaggagcgaaggtcattaaagcctattcgagggaagaccgcgtcatggagcaatttttagaaaaaaacgcggcgttacaatcatcagggttttgggcgcagacaatttcgggattcattccgaaagtcatgaactctttaaacaatttaagctttacgattatagcggcggtcggcgggctgtttgcgctgaaggggtggatttcgatcggttccatcgtcgtattcgcagaatactcgcggcagttcacgcgccctttaaatgatttagccaatcagttcaatacgatgttatcggccatcgccggggctgaacgggtgtttgacgtgctggatgaaaaagaggagcgggaagatgaagagcatgcgacgcaccagccgatcaaaacgggagagattgaattccgagatgtctccttcggctatcaggaagacagcctgatcttaaaacatctgtccttcagcgttccgaaaggacagtcaatcgccttcgtcggaccgaccggagcgggtaaaacgaccgttacgagcctgatcgcccgcttttacgagccgaataacgggaaaatcctcatcgacggaacggacatcaaaaaactgacgagatccagtctgagaaaaaacatggggtttgtcctgcaggattcctttctctttcagggcaccatcagggaaaatatccgttacggccgtctggatgcatctgaccaagaggtggaggcagccgcaaaagccgccaatgcccatggattcatcgaacggctcccgaaaggctacgataccgtccttacccaaaacggcgcgggcatcagccaaggacaaaaacagcttatttccatcgcgagagctgtgctggcggaccctgtgctgctcattttggatgaagcgacgagcaacattgatacggtgacggaagtgaaaatacaagaagcgctcggccgtttaatggcgggcagaacaagcgtcatcatcgctcacaggctgaacacgattcaaaaagccgatcagattcttgtgctgaaagacggcgaaatggctgaaaaaggaacccatgccgaactgctcagccagaacgggttttaccgggaattatatgaaagccagttccgggaatcatagatagggaaaaagacctccgacagagtgcggaggtctttttttgcgaagacaaatagtacttttaagttattttcgttaaatgtaacaaaattacttgacgtaaataagttatgtatatatactagcttacataaagtaagtgataataattttcaaggaggattttatgaataaatcattcgaaacaggaacactgcttttaagggttgtaacaggtattatcttttttgttcacggtttatccaagtttcaagggttggaaggaactacgcaatttttccagagcatcgggcttccggcctttatggtctatgtcatcgcaacgattgagcttgtcggcggggttctgatctttttcggtttggcgacgcgcataatcggcgttctgtttgccctcacattagtcggcgccatcttcacggcgaagctttcctcaccatttatgggcggatcggaatttgatttcatcttactggttgcgtcaattcacttagcgctttcaggaagccgactgctttcattggatcagctccttttcaaatcaaaaaagggagaaactttttcagcataagaaagaaggcgttcaaatgaccggcattcatcaagatacggcaatcggttatgtcaaattgaccattaaaaatatggaacggtcgctcggcttttaccaaaatgtgatcggccttcaagtcatctcgcaaaccgatcgttccgcagaactgtcagcagacggaaaacgcgtcctgctggtgcttgaagaaaatccaagcgccgtcgttctcccggagcggtctgtcaccggcctttaccatttcgcaatacttctgcctgaccggaaagaactcggcatcgcattggccaggctgattgaaaacggcatcgcgctcgggcagggggatcacgcagtcagtgaggctctttacctgtctgatccggacggcaacggcattgaaatatacgccgatcgtccccgcagcacgtggcgccgggatgcagagggcaattacgtcatgcaaacggcgcccgtcgatgtggacgggcttttggaagaagccggagctgaacggaaaagccgtctcccggaaggaaccgtaatcggtcacatccatcttcatgtgacggatttacaggaagccaaagcgttttacaccgatatcctcggttttgacattgtcggcaattacgcgggcatgtccgctctgtttgtttcagcgggagggtatcaccatcacatcggtctgaatatatgggccggaaaacatgcgccgccgaaaccgggaaatgcaagcgggctggattattacaccatcgcactgccgcatcaaaaagagctgtcacgtgtgacaaaagcgctgaccgatgccggctttgagatcgaagaaaaagaagagggcgtattcgtcaaagaccctgtatcaggggcggatatcgcatttacactgtaagaaacaacccttgccgtctaaccggcaagggtttttatttttccgaagttttcttgggaaggctcgggaaagaagaacgtcgatttgcaatatacacacggcttttgtgtgactgaagagagcgaacatctcagtggggcgcaaaaatgatgcgtggagcccgccatcgccggcccgggctcagggcatccgctggattgaaaatggtgtccgttcggcggatcagggagcagtatgggcagactttgaatagaaaaagggaaaagccgcatccggtcacaagatgcggcttttcatatacaatttacaattgtgtgaaaaatgcccaaaataaattgtgcttcctgattcttcctgatatgataagccgaaaaaggagaacctcaacaaatgaattcaaatgcagcacagacggaacagtctatgaagcataacggaaaccggatgacggtcaaggactttatcattcttgccaaaccggggattatcatctcaaattcactcgccgcattgggcggattttggatcgcatggcttcagtcggaaaggacgggcggagggcccggtatatttgccgccatggcggttgccatgatcggaacggcgttagtcatggcgtcaagcactgtttttaataacttctttgaccgcggcatggacgcaaagatggcgcgaacccgcacccgcgccagcgtcacgggaaaaataccgccgacggtcatgatcctgtacggcacatgtctcggcgcatgcggattcatcacgcttgcttcgcttaatgtactgaccgccgttcttggcctgcttgcatttttgctgtatgccgtcgtttatacgctttggtttaaaagacaatccgtctggagcacatttgtcggcagctttccgggggcggctccgcctttaatcggttattgcgcgctgaccgggtacattgatatgcccgcaattttgttatacgcgattatgtttttgtggcagccgccgcatttctgggcgatcggaatcaggcgaaaggaagagtatcgtgccgccggcattccgcttttgccgatcataaaaggcaatcgcgtcacaaaaataaaaatgctgcgctatatcgccgttctgactgcggtttcgctgctcgttcctctttatatagacgtcagcccgttttataccgcaaccgctctcctgctcggggccatctggctgtaccggagcgtcaaaggctttcaggcggcggatgacacgcaatggtcgaaggggatgtttttttattcgattgtttatttcagtctgctttttcttattttaatggctgattcgtttgtcaatgcggttctcagaacgtaaacaggcggcctgcagatacagagccgccccgttttgtttatgcttttttgatgagcgccaaaatatcttcaagccaggaaatataattccgttcccgctcaagcgcttttgtcagcacgagataatggccgaaatcaggagaagaaaatgaatccgcctccgcggacgatgtcatcagttcttgataactgttttccaggtcggacaatttctcctgccgctttacgagctgatcggtgaagagctcatccgcttcctcctgcgtcaaagcagagatgaaataggccttcagcataaattcatccttcaccgtttccggaatcgggtcttttttcgtcagccaggcagcaagctccagctctcccttgtcagtcagcgtgtacatttttttctcaagcttcgttccttgaatcgcagtgcgaaacgtaataaatccctcagccgtcagtttttttaattccggataaatctggctgtgctttgcgctccaaaactggccgagctcttccttaaaatagctcgatatatcatatccgctcaattcgccttttcgcaaaagccctaaaatcgcgtactttaaaattctcatgttgtcctccaagcccattcatttgacagctagtataccatacggccgcttaaaaacgcagaagcgccggatgcttgtcattgaatccgcggcggcaaaatcagcgaaaatttgcagcaaggggttagcgaaacggcagcagaaccggaaaaagcctttctcgtgtctttgcctcattcatatgacatcatgatataatcattgtaaaaattaataaatactgggagggacatatgaagacggtgattgtgtatgcaaacccggatgagaacagtttcaatgcggctctcgtaaaatacgtcgccatggctttaaaggacagcggccaaagctatacggtcattgatttatacgccgatcaatttgatcccgtgctgaagtacggcggcgaaaaaaagcgctctgacatgaaccgggacactgaaacgaagaaataccggaaactgatgaaagaagcggatcatctcattttcatctacccgctgtggtggggaggcgttccggcgattatgaaaggcttttttgacagagtgcttgtcgccggagaagcctacacatatgaaaacggccgcgtaaaaggactgctccgggcagagacggcacaggtcttttatacggcggactccccgggctggtacttaaagtggttccggaaaaactcggactggattacgctgaaaaaaggcattctgcaattttgcggcattcaaaaagccgagcggaaccttttttctgtcgtcagaacgagcacacccgaactgcgggaaaaatggctgcgccaagcatacgccaaagtccggcgcgcttgtgaaaaaggagcggccgcatgcagataaaagaaattttcgtaattcgctgcctgtcctgtttaagtgtcgttctgcttcacgcagtttcaatggtgctgatgattcaggaagagtccttagccagtgccgcccatacggttgatgcgtttcggaccctgttgatgttcagcacgccggcgtttatctttatttcggaatttctgcttgccaggtcatacccgaaaggcgttccagcgggttttttaaagaaaaggggcaaagtcattttcgtgccgtttctgtttattgccgcggtggatgccattttaatgaaaagcgtggcggaagaaggagccggattcgtttcagtgatcggtaaatttttagaaaatgtgtttttaggaaacttcatcggctacttcattcttgtgatctttcaattttacattctccatatgctgctgcaccgctggctgaacaacacatccccagtatgggtgctgtctgtttcgtttatcatcaacgccgtctatctggcttacttttcgatctttcatccgccggcatcatcggggcttgattctatttttccgttcttttgggttccgtttccgggctgggtgttttatttctgtctggcattttattgcggaaaggaatatccgcgttttttatcgctcatcaatcagtaccgttatgcggtttacttcagtgcggccgtatcggcaatattgattgtggccgtttcatatatcagcggcggctccatttcctctaagcgtccggatattatgatttacgcggtcagtatgatctttctgtgttttcatctgttttcaaagctcaaaaaagtgcccgcgattgtgatgatgatcagcaactattcgttttcaatctatctgctgcactcctactttttaatcagcggatatcttctggaaggctatttgcggtcaatgcctttagcggctgccattcttcttttatttttgatctgcacgctcggtcccattttcgtatcgtgggggtgcaaccatttcagatacggatacctgtttgtcgggaaagtgtatcagccgaagcagaccaaaagaaatacggcggcgcatcaaggccgcacagtctgaaaaaaaggcggcgtttcggccgcctttttgatacgggtccgctttatcctgcacgaggacggatagttgtacatcctgcaaacaaagcccccgcctgcggctgttttgacggatgcatttatgacaaaataacgccattgattttctcccttgtgaagaccgatatattgtatacttataggaaatactttcaaaaaaagtgaaaaagagaaaaactgtgagcttggatgaacgactaaaaaggagcggggacattatgaatgactgtgtcaaaacattcggagaacttccggccgaactttattcctttgcgggaggaaaaggaagcattctctctaaaatgtatcaaagcgggtatcctgtgcctgaagggtttgtgattttgccgtcagcctttcaggacggacagctccgccatcaggcgagagaggctgttgatcaatatgtgaattccatccgcagccgccatgcagctgcgttgtttgccgtacgctcatccgcgctgagcgaggattccgctcaggcttccttcgccggagaattcgatacggtgttgaatgtcaaaacagatcaagacatgtccagggcgattgatgaagttcgccggtcggtacagtcagaaagagtaaaagcgtacagcgccgttcagggaatggaagatgagcatgaaatcgcaatcgtcatccagctgatgataccgtctgagatatccggagtgctgtttaccgcagatccgattacggggagcaggcgggagatgacaggcaattacgtctacggtctcggggagcagctcgtttctggggaagccgatgcctattcttttaaactggcacggcccaagaaaaaatatgacggccccggggaatttcgcaaatatgcgtcaaagctctataaactggcgaaaaagctggaaaaagatcttggagggccgcaggatattgaatgggccgccgcgggcgggacattgtatattcttcaatcccgcccgattacgaccttacaagccggaaatctggaaacctatgaatggaacgattctttcagcggtgattttttatggacaaacaccaatataggagaagcgattcccgatgtgatgacgccgctgacatggtcgctcctccggaatctggatgaagagtcgggcatcattccgggctattatgtctggtccggcaatatttgcggcagagcctataacaatatgagccagcctctttccgttctcgccgctttcggtctgaatccgaaaggcggaaaaattggaaaaatgatgagcgatacattgggagaaatcccggcggaaatgaagattcctttatatccgttctcaaagtatgaacttttgaagatcatcccgaaaaaactgaaaccgtatctgtcgaaaatgaagcaagcgaaaaaaaacatgtcctcctacttggacgaatcgccggagtggtgccggaatattgaggaaaagctgaaacgcgccgaaacggagcgggcattattagcgatatggaacaatgagatctatccgtatttatgcaacgcgtggtttgcgttaatatccggcgggcgtgattctgcgcaatcctcttcgtcgttaacctctcaattaacaaaactcgcaggcatagaagatgcgaatctcctgctttccaatctgaggggaaaaggcggactggccagcctggagccgattatcggcattgatcaagtcatgaaaggccgtatgagcgaggaagaatatctcaggaaccaaggccaccgtggtccgcatgaatacgaactttccataccgcatccgggagaaaaccgggattggctgacgaagcagatcaaagaacacaaggagtcgggtattgatgccgaacaactgcttttgaaacagcagcgggcgcatgaacaggccttccgaagatttgaaaaaaagtttcctcataaggtcaaatggctcaaagccaaaatggaaaaagcgtcagaatacgcgaatatgagagaaacaaccagatccgaatttgtcagggtgtaccggacagccagagcattcgcgctcagagcggcggaaatgaccggcatgaaggacgatattttctttctgtatctgcatgaaataaccgatctgctcgcggggaaagagccggcggttgcgtcgattcaagcgagaaagcaaaactatgaaacctataaaaaactgccgccgttcccatccgttattaacggaagattcaatccgtttaaatgggctgaggatcctgacagaagagcggattattacgatgcttttatgcctgcggaaacggatgatgcgcatactttaaaaggtttcgcgggagcggccgggagagtggagggcattgtccgtgtccttgatgtcccggaagacggggattcttttgcggcgggggaaattttagtgacgtcgacaactaatgtaggctggaccccgctttttccaagagcggctgctatcataacggacgtcggcgcccctttgtcccacgcggcgatcgtcgcccgggaactggggattcctgccgttgtcgggtgcggaaatgcaacgtcaaaactgaaaacgggggacagggtggccgttgacggcgggcaaggaatcgttcagctggaaccgcggcagactccggtcacttctgaagaggaaaatggtaaactgatagaataaaatcaagagaaaggagccgcgcatgaataaagcagttattaacggggagcaaatcagaagtatgagcgacctgcaccagacattgaaaaaggaacttgcccttcctgaatactacggtgaaaaccttgacgctttatgggattgtctgaccggctgggtggaatatcccctcgttttagaatggagacagtttgaacaaagcaagcagtttacagaaaatggcgccgagagtgtgcttcaggtctttcgtgaagcgaaagcggaaggctgcgacatcaccatcatactttcataatacgatcagcgggagagagacaaaaatggaaaaacaaaccctcagctatccgattggagaatatcagccggctgaatcgatttcgtccggacagaaacaagaatggatcaatgcgctggaacacgctccggccaaactgaaacaagctgtcagagcgatgtcggacagtcagcttgatacgccgtaccgcgaagggggatggactgtccgccaagtggttcaccatctggcggacagccacatgaacggctatacccggtttaaattgagcttaacggagaatgaaccggaaatccgtccttatgatgaaaaaggctgggccgctcttcatgattccaaaaccgccgcttgcggggatgcgcttgagctgttaacgatcctgcacagaagatgggccgctcttttgcactccatgacggaagcccaattcaaacggacatacttccatcctgtatctaaagagacggttacgctggaacaggcgctcgggctatatgtctggcactctgaacatcacatcgcccatattactgagctttcccggcggatgggctggcatctgtcttagaggatgccggcttccggaaaaacgccaaaacagccgcagacacgatcgtgcataatgaaatgacggcggctgccgtataaagatggtggtagccgctggaaatgcccgcttcaatcgcatcagaaaccgcttttttgacggcgggaacggggattcggcttacctgctcctgcaacgaagaaagttcgccgccaatatcgggcgtttgcgcctgatcagcgggaatgccgcttttcattaagcggtttttaatgtcatctccgatccggtcaaagcccgctgtaatgaagccggcatataaagccggagagagcgtcagcccgacctgccttacgagtgacagcgtgccgagcgctgttcctttgttatggcccgctgtttctgatacaagcacattcagcggagccccgagcagaaatccgaaaccgatccccgcaatgacactcgccgtgacaaattcccatttatccgtcacccataacggaaacaggctgaatccggcaaaggcgatggcgcctgatacagccgcggagaagaccggcccttttttatccgtgaccgccccgccgagccacgctccgatgcctgacgccaacgcaagcggcgtcatccaataacccgctttctccgccgatacgtgcaaatattgctccgcataagaaggaataaaaatgaccgcagcgagcagccctcccgataaaaatccgatgacgagcgtccattgaaacactttattttgcagcagcgagtaggcgagaatcggatcgccccccaggttttcaacccgcttttcgaccttaagcagcaccagaaagagaagtgccgctcccaaaagatacccgtacacctttacgtccattatgctttctgacagcttcgccccattgagattcgtgataccgatcatacaagataagatcgcaagagacagcagcattgtgccggcgagatcaagccgtttcgcctcaggctctttcgtttcagcgataaacaaaccgccgcacacaaccaaagcggcggcaatcggcaggttaatcaagaacagccaatgccacgacccggttacatcaagcaaaaagctcccgatattcggtccgaggacggccgccataccgttcatcgcccctaaaagcccgagagctttcccctgtttctccttcggaagcacggccagcacatgcgaactcccgattataaaaattccgccgccgccaagcgcctgaatgagccgtgccgccaaaaacatcgggaagctctgactgagtgcgacaagcaaagagccgagtccgaacagcccgacctccatcataaacagctttttccgcccgtatcggtccgacagcttgccgacaatcggcacactgacactgagtcccaatgtgtaaagggtcactccccacgatccccatgaaggagaaacatcaaaagagctgttaatcgccgtcagagcagcggaaataattccgttgtccagcgccgccatgaacacaccgatcgtaaaaagagtgatggcccggctctggtttttttctgtttgcaatagctcccccatactgatcaatccttccgtttttagttcacttcgagtatattattcactttaagtgaattaaatgtcaaacaaaaaaaggccgccgataccggcaggcctttttcatctctatgcctgtttggaagaatcaagcgctcttgccaaaatggcaagtccttgattgaccgtttgtttttcttcagcggtcagcgtttccaatgaacgcttcaattttacatgtcctttttgataaaggctgcggaaaatatcttttgcgttttccgttaattgaacgacgactgaacggcggtcttcttctgacggagcgcgtgtaatgaaacatgatttttctaaacggtcaaggagccccgtcgtatttgaaagagaagcgcccattttctccgctatgtcactcaccttaagcgtcccgtggttgttcagaagcatcagcaccttcatttgcggcatgctcatatcaagcttcatccactccgacacatcgccgagtcccgccgaggtcatcactttcatgtacagcacccaaatatcccgttcctcaggagaaaaaatatcgccgcctaataccgttgtatcatgcagattataatccatcgtctcacttcctcattcatactcctgcataccatattactgattttaatcagagaaagaaagttgcagacgagttttgtttgaatgtgaggtggtagtgtataatatgttggagattattgggggaattataataaataagctattttatgatgattggagagaacattgctgactaaaaagaatgccttatcgatattaaaagtattatttcctattgcagttttgcttttagtcatttatcagtccaaaaaggaattgacagacctttcttttaaacgaacgctgtatattattaacgggattgagcgttacgatttatttattctcgttctgctcggccttcttgccgtcagcgcgatgtccttttatgactttgtgctgaaacggacgcttcgcctcaacattccgaattggaaagtattcagggtctcctttatcgccaattcctttaacaatgtccttggattcggcggtctggcgggcgtcgggctgcggacgatgctttacaaagagcatacgaatgacgtaaaacgccttgtcgcaggcatcgcctggcttacgtcctcagcgttgctcgggctgtccgtcttcagtatcctgaccattgcccgcattctgccggtcggagagattacaggtgagaaaccgtggctgtgggctgtaatcgccggagtggcgcttattgtgccggcagccttaatcgccgcttggatcaacaataaaaaagctcgcgcagaagacggtgaagcaaaaccgaggcatccggttttttcttacatcggggcatcgtttgccgaatggtttgcggcggccgtcgtcatgtattattccctgtatgtcatggggattcacgcggatgtccgccatgtattcggtgtatttgccattgccgctatcgggggaatcatcagccttgtgccgggaggattcggttcgtttgaccttctgtttctgctcggcatgcagaatatgggctttccgcaggaggcggttgtgacatccatcgtcatctaccggattgtgtattcatttattccgtttgtgttcgggctgttctttgcggccggcgatttaacggaaaatacgcttaaacggctggaatcaaatccgaagatggcgcccgccgtggaaacgacgaacgtgcttctcgtattccagcgcgccatcttaatcagagtgctttacggttcgctgtcgcttttggtttttatggcgggagtcgttgtgcttgcgtccgtcgccctgccgattgacagggagacggtcatcccgcatattccgcgcccggcgctccttgcgtttaacgcgttatcgttaagcgcggctttgattcttttaatcttgccgattgaattatacaaacggacgaaacgttcttattcaatggcggttgccgcgctggtcggcggttttgtgttcagtttcttaaaaggattgaacatcagcgcgatctttattctgcctgtcgtcattgtattgctggtgctgttaaagcggcagtttatcagagagcaggcatcgtatacgctcggccagatgatttttgccgccgctctgtttattatcgccttgtttaactacaatctcattgccggctttatttgggataaaatgaatcggctgctgcgccacgattatttcgttcataacaattctcacattacatatgccacgatgacggccattattgttgtgccgctgtttttccttttgtttacggtcttttatcataaaagatcgaagccgatcggagaaaaggccgatcctgaacggctgaagtcctttttggcggaagaaggcggaaacgccctcagccatctcggctttctcggggataagcggttttatttctcaagcgacggcaaagcgcttttattgttcggccagatttccagaaggcttgtcgtgctcggtgatccgtcaggacagagagactcttttccgcttgtgattgaggaatttctgaatgaagcgcataagcaggggctgagtgtcatgttttatcagatcgaacgtgaagatctggcgctgtaccatgacttcggctataacttcttcaagctcggagaagaggcgttcgtggatatggaagcatttacgctgtcaggtaagaaaaaagcggggctgcgggcgattaacaacaaatttgaccgcgaaggctacacatttcatgtcggggaaccgccgttttcctccgagtttatcgccaagctgaaagacatttcggacgaatggctcggaccgaaaaaagagaaaggtttttctctcggtttcttcgaccgggattatctggaacaggcgccgattgcttacgtgaaagacgcggaaggggagatcatcgcttttgccaacctgatgccgatgtatcaggaaggcgagatatcagtcgacttgatgcgttatcggaaaagtgcgccgaacgggattatggacgcgcttttcatccgtctgtttctctgggcgcaggaaaaaggctataccacctttaatatgggcatggcgcctttgtcaaacgtaggaacggcttttacatctttctggtcggaaagaatcgcggccgtcattttcaacaacgtccggtatatgtacagcttcagcgggctgcgggcctttaaagaaaaatacaaaccggagtggcgcgggaaatacttggcgtaccgcaaaaacagatcgctgtccgtcacgatgattctcgtcacccgcctgatcggaaaaaccaaaaaaagacgccgttaaaaggcgtctttttttgaagaattaactaaaaattctaattttactctgttatactgaacaacatgatcataaggtgaaaggaaggctgatgaatgaaacaggcaaccgtgtttaaatatgaagcgtttaccgatattcctgatttgggaaatcccgcaggaatcgtctttaacggagatgattattcagatgaagagatgcagatgatcgccgaattggcagggtacaatgaaacctcatttctctgcaaaagcggagaagccgatctgcgcatccgctattttacacccggccacgaaatgaatttatgcggacatgctaccgtcgcctctctttacgcattaattgaaaagggaaggcttcaggctgatcagacatatcaaattgagacaaaagccggcattcttcccgcaaaagccgctgaacgaaacggccgggtatacatcacgctcaaacaggcacccccgcaatttctgccgtttacgggcgacaaagaaaagcttgcggcctcgctcgggattacggctgaggattttcacagcgagctgccgattgtttacggatcaacggggatctggacactgattgttccgctgagatcacttcaagcatcacggaatatggtgccggaaaacgcacaattccccgctgttttgcgcgatcttccgaaagcgagcgttcatccgttttctctggaaaccgttcatccggaaagtgatctgcacggacgccatttttcttcccctttctccggaacgaccgaagatcccgtcacgggaaccgcttcaggcgttatggcggcctatatgaggcaatacggaggctctgaagccgaatgcctcacgattgaacaaggccacgaaatcgggaaagacggaaaagtggaaatcaggattacagaagataacgaaaagatgaaaatcgagatgacgggaacggccgtgtatgccgaatcaatcaattttcagcttccgtaacggtttacaagagacggtcgtatccgttatattataaatgataatcattttcaattgaataggaaggtgaatcggcatgccgaaaaccgaacaactacagcaaaacgaaagtcttgcacatacaatcagaaacagaagatccatccggtcgtttaagccggaaaccgtaccttctgaagtcatattagatatgcttgaaacggccgtttacgcgccgaaccacagactgacggagccatggcgttttatttacgcagcaaacgaagcgggaaaagcgaagcttgcggacagctacgtctcatttttcaaaaaaataaaagatgatttcaacgaggaaaaagagcggaacatgagaaaaaacctcagcgccgttccgggatttttgcttgtcgtcttaaaagaagatgaaaatgaatttacgagaaacgatgatttcgcggcgctgagcggcatgattcaaaaccttcagctgctcgcacatgaaaacggcatcggcatggtctggaaaagcggccgcatcatgtatgacaaacaggtgcaccaagacttcggccttgcagacaatgagcgcttcgccgccatcattcaaacgggctatccggatgaacagcctaaggcgaaagaacggacgccggcaaaaagcctgtttaccgagttgtaaaaaaatccccgtctctatacagaggcggggatttcgtattagcgggttttgcttttagctctgttgtcagcggctttcatccgcgcctgcgcttcgcggtcagcggaatcagcaagctcgcttgaatattcctcgtacgtgccgtctgtttcgcgtttcaaagcatccggaacttgaggaagtttttgtttgtttttatcacggtttttgtgagtatgatttctgcccatatcaatcgccccctgaaaaaagtgatatcaaacaaacatagtatctgcccggtcccgatttttattcagtttatttccgtttggctgctctttccgcttttttgaattcaccggaataaaggacttcctgcatttttttcagattggctccctgctgatgtttttcgcgcttcttttccataaaagaagaccctccttcaaaacagaataccaataggattggcttttatttccgtttttatgcagataagagatcctttaaagccaactcaagttcttcatacgtaaattgaaaaccggatgtcagcgcctgcttaggcagggcgcgctggccttttacgatcagcaggctcatttctcccaaggtcttctccagtaaaaattccggtacgggaatccaatgggggcggtgcagaacgcttgcgattgtctttccgaattgcttcatttctacgggattcggcgatgtcacattcatgggaccggacaagtcatcatgctccgccgcaaaagcaataagttccgcggcgtcatcgacatgaacccatgacagccactgccgtccagagccgacggtgccgcccgctaacagcttataagggagaaccatgagcggcagggcgcctttttcaccgagcatcacgccgaatctggcatataccgtccggatgccgagcgcttcaattttctggccttcacgctcccacatatgagccgtatgactgagaaagtcttcatttgacgtatcggactgctcagtgaacgttttctctgtgcttgtgccgtaaatgccgactgcgcttgcctgaatcaaagcccggggttttttcggctgctgcttcataatccgtctgacttctctcgtcgcttctattctgcttgaaatgatttgttctttcgttgtgtccgtccagcggtcaaagatggatttgccggcgaggttcacccatacatcaatagggggaagctcgcgctcaggcgccgcgttttcggccagccattgaacatatgtcacatttttttgttcggtttctctctgttttcttgataaaatatagacatgatgtccccggcgggtaaacacacctgtcagatgccggcccagaaaaccagtgccgcctgtcatcgcgatattcatatccatctctccttacacgttgatacatatactgtacctcatttgctaaaaagaaaacgcctgaacatcggggcgggaaaggagaccgggatgccgtttattacaaaaatatcgacccaaaagaaaaataccgagcgcttcaacatctttcttgatgagaaatatgcattcagcgtcgacgccgacgtacttgtgcgttttgacctgaaaaaagggaaagaactggacgagcttgacattcttgagatccagcacggcgatgacgtgaaaaaagcctttaaccgcgccgtagaatttttatcatatcggatgcggtctgaaaaagaagtccgggatcacctgaagaaaaaagaaacaccggacatggttatttctgaagtcatccataaactgtacgattaccgctacttaaatgacaaagaatttgccgaagcctatgcgagcacccacaaaaaaacaaacggcaaaggtcctgacgtcctattccgcgagctgaaagcgaaaggaatagacgacgataccatcaaggagacgctcagcgcgtttacatttgatgagcagatacaagaagcgttgaaacatatcggcaaaatcctcaaaaaagacaaaaagctgtccacaaaagagatcagacagcgggcgcagatgcagcttcagcgaaaaggtttccctttcgacgtcatcaatgccgctctggagcagacggagtatgaaaatgatgatgaagccgagatggaagctctgaaggctcatgcggaaaaagcgatcaggaaataccgctatgacggcagctatgaaagcggaatgaaggtcaaacagtacttattcagaaaaggattctcgattgacgatattgatcaattcttgcaggaagaggagtaaactgaaatggacaaacgatacagtcaaatgacgcctcatgaactacagacagaaattgcgggactgacggaaaaagcgcgaaaagcggaacagatgggcattgtaaatgaactggccgtgcttgaacggaaaatgacgatggccaaagcttacatgctgaacccggaagactttcggcccggcggggtgtatcagatagaaggttctgatgacactttccgcattgattacatcaacggcgtattcgcctggggacacagatcttccccgtctgacggggaagaagcactgccgatttccgttttaaaagaaaaataataacaaaagaggccggttccggcctctttttcttttcgggcacattcgtttcagcctttcagtaaaaaatgattgaattcatttttgatatcttttaagatggaattcgttgttttttaataaaaaggaggcgatttgcgttgaatatcaaaatgaaacagccatctgtgaaattaatgatttttgttttaatgatttgcacattttccatcgggtatacggaatatgctgtcatgggtattctgacgtcgattgccgatgactttcatatacatgtatcttcagcgggcatgcttgttacggcgtacgcggcaagcgtctgtctgacgggcccgatcgtaaccattatcgcggttaagctgccgagaaagccggtgctgctagggttgatgggcatcttcgtccttgccaacctgatgagcgtctttgcgccgaacttcgccgtgctggcgatttccagaattttatccgcatccattcacggagccttttttgcgatcgccatggtgtttgcgagtgaaatggtgccgcctgaaaaacgttccgccgccgcggcttccatgaacggcggattaaccgtggcgctgatgctcggcgttccgttcggctcttatttaggggatgcccttaattggcgtgccgtctttttcattatttccgttttaggcctgatcgggctgatcggactgatgctggtcgtaccgaaccggaaaccgaaagtgattccgatgctgatgaatgaatggagtgtctttaagcataaacaagtgattttttcctttgcgatcaccattctcggctactcaggcgtatttatcgcttacacgtttattgagccgattttaagagattcagcggggttcggcacagtcggcatcacaggcgcgttatttgcctacggtctcggcggagtggcggggaatttcttcgcggggaaagtgccgctcaaactgctgacgcgcacgatgatcggtgtgatgatcggcctgatcggcgtcttggcgattttcccttatatcgctgtctttcccgccgccgccgtttcagcgacatttttgttcggcgcatgtgcgttcggcacgccgccgcttttgcagaccaaggttatttcttcctctgaaaacggcacgacaatagccgctgcggtgagcgtttccgcctttaacctggcaaacgcgctcggcgcctggatcggcggattgattctcgggggaacgggatcttactcatggctgtttgccggcggtgcgctgatgacggctctcggccttgtgctttccacgttcgctcatctgtctgagaagaaagatgtttatgaataccaagtgcataaaggataacaaaaagcttgcaggggatattccgcctgcaagcttttttcagtgtttcaatgtaaaactgatcaccgtatgtttatcactctcagctaaggaaatattccgggtttccggtactccgtctttttcaaaaacgacggcataggttcctttcgcgccgcttttccatgcaatatcgccgtggtgatcagtcttgcctattatctctccgcggtctatattcggctgatgatctgactccgccgctttcatcacggtaaccgtcacaccggccgccggtgaaccgcctgcatgctcaacatggagcgtaacgggcattgcctttttggcggcggaatcatccgctttgccgcatccgcataaaacggccgccgcgagaaagataacaaaagctttattgatttgaccaatattgaatgttgtcgaatacactgtttgtcacccttgttcccagattgtaagacgacccgccgtttgtatgaatggcaatggcggtctggccggtgtcgctgtaattgcggtaaacgggcgatccgctctggcagccgaacgtatctgtcgtgtaagtgagtttatatgtctcggcagaacgtatcggcttgctgtccgaccacatggaaccggacactttgtcgcacggatatcctgtcacggttgaggaaagcccggccggactggaactgttggtcgtccggtagccgtaccagccgacagtattcccgggcgatccgtttactttgattgcgccgtaatcatagtttgtgtcaccgttttctgtccaccctttgacactgtagaatgtcttgcctgaataagagccgtacgggtacgatgacccgttgcggccgggagctgccgtaattttcgatgcccagccgtttttctgatcatacacgcaatgtcccgccgtaacgatcgtgtcggcattgacaaaaaaaccggtgcatccgtaggtgcttgtgctgccgctgtatgtaacggtcagctgtgctgtcgcgcgatatggaaatgatgttgtgggagaaattctgattcgttcgtctgtcccaataatactggaaggctttaatgacttgatgtcagctttgctgttttgtgcaagctgtcttttggtgaggcccgttccttcataagcgggggatgtctgtgttgtttgtacaggctgattctgatttgcgtcaaactcctcaccgctgtttgatacagatgtctgcgggctgcccgctgcttcagctgaaacagcaaataatgaaactgacagtaagaatgcggtaaggctcagcaatcgttttgaaactgtcttcattttataaaacccctccttttttgtctaccggctttcgttttaacatttaacatattatggaatttatttagcgttatgaccgcaagaggatgttttttttcgcaaaaaaaaagaccgggtcattcccggtctcttacggtgtgtgttatcgtctgcctgaagctctcatgcgctcttgcgggtgcgaattaattgaaccgtccgcccgtttagaagcgtagtcatcctttgcccgcggttcgccttcaaacttattattgttctgattaggaaatccttttgccttgttccggaccatttgttttccccctcggccaatatcaaaaggttgcgccttctggactgaagacgtaaagttagtatatgcctgtgacgagctgcgtaaaagcagcaggttttcccaaggaaaggagacagagacatgaatacatatatcgacaaactgacgaatttgctgcttgagaaaaatgacatgctcagctatttgcaagcgcgaacttgggttgagcttttatggggagatttcgaagcgacttacgcaaaagccggtcgcccgtatcaaggagagcaaatgacggaacgcgtcgtcaaggaatggatcgaatcatacggcagcaagctccatatgttccagagcgttcgggaagacgtttctcattatttggatcaaagcaggggtctcctgcattaatatagcagtgcgcccgccggataccgtccggcggttttttctttttataaaagaaatgggaaaatcatgtttgacgaccggcggaatgtggaaatgtgtaataacttataaaatagcggggaggaaccacaatgaacatgaaaaaggggttaaccgcatttattccggccgcaggactttgcttatttttagccgcaggcaccgttttttttgatccggcagcgaatgccgcagcagttcaccagacaaaaatagacaccgcagcagatacatatatcgtgaaagcaggagaacttaatgtccgcaaagaacccaataaacaagggcggattatcggcacgcttcgttcagaggattccgtaaaggttaaacggcttcaaggagcagattgggctgaaattgactacaaaggtcacaaagcctatatttccacgcattttctgatgaagcagccggtgaaggcggtgaccgcgaaacaaaccgatttttatacgccgactttggaaaccggcaaaaaagggtccgttaaagcgggtgaaaccgtcaatgtgctcggctgggggttcagccatgacggagggtttgaccgtaaatgggcgtacatcacatacggcgggaaagcaggttatgtgaaaacggccgacttaactcaaaaataaagattcaggcaggcgaatgagcctgctttttttctgaaacttttcgcctttcctttcgtaaaagatgaaaaggagagtgatggatatgataatggtgatcggcggccttctgatggctgcggccggcatttcagtcacattttttccgccgaagtcgatcaacagcctgtacggatatcggacgaagcgctctatggcggatgagtcgcagtggaaagaaggcaatcgattcagtgcgctcctcatgattctgttcggccttatttcggcggcagctggattttcgggcagcctgcttatcaggatgactcagccgttcgccctgattgttcaggccgtattgttgattgcgatcagcgtactgatcatcgtcttaacagaaagaagattgaaacaaacggggaggagaatcgatgaatgacattacgtttcacatgatcgaaacaaacggagtgacgctgcacacggcttcagccggtccgaaagacggtcctctggcggtgctgctgcacgggtttccggaattctggtacggctggaagagtcagatcaaaccgctggcggatgccggataccatgttgtcgtgcctgatcagcgcggctataatctcagtgacaaaccggagggcattgaaaactataccattgatacgctcagagacgacattatcgggctgatcactcattttacagatgacaaagccgtcgtcatcggacatgattggggaggagccgtggcctggcatttggcatccacgcggccgcaatacgttgaaaaattgatcacggtcaatatcccgcacccggcggttatgcggaaggtcacaccgttctacccgccgcagtggaagaaaagctcttatatcgctttctttcagcttccggaaaagcctgaacggagattgtctgaagacgattaccgcgtattggatcacgcgatcggcttatccgaacgcccggcgcttttttcacgggaagatgtcgacagctacaaagaagcatggggcagaaaaggagcgctcacggcgatgctgaactggtaccgggcgatcagagccggcggtttaggccctgccgttccgcttaaaatgcccgttccgtaccggttaatatggggcgtcaacgaccgcgcgctgagcaaaaagctcgccaaggaaacaaaacggatgattccaaacggcgacttaatcttcatagatgatgcctcacattgggtcattcacgaaaaaccgcgcatcgtcagccatttgattcatgaataccttcagcaataaagtctgtcccgcgtacagactttttcttttttttctcatatctgccgaaaaacatgacaaaatataaaccatatgcagaaaaaaatttctttccctgtaacaaaaaaagggtttaaacgtcattaaaaaaaggaaaagccttactgaagttttgcggacaattcctttaaggccgtcctaaaaaaagaataatacaaagaaggtgccttcatgaaacaaaggttaatctcaattattattccgtcttacaatgaagggaacaacgtcaagctcatccatgaatctttaaaaaaagaatttcagacgattcattatgactatgaaattttctacatcaatgacggaagcgcggatgacacccttcagcagattaaagaactggccgccagaaaccatcgcgtcaaatacatatctttttcccgcaacttcgggaaagaagcggccattctggcaggatttgaacacgtgcagggcgaagcggtaatcgtgatggacgccgatctgcagcatccgacccatctgctgaaagacttcattcaaggctatgaagaagggtatgaccaagtcatcgcgcagcgcaaccgaaaaggggacagccccgtgcgttccgtgctttcttccctgtattataaatttatcaacaaagccgtcgaagtggacttgcgtgacggggtcggagatttccgcctgctgagccggcaggccgttgatgctcttttgaagctgagtgaagggaaccgtttctcgaaagggctgttctgctggatcgggtttgaccagaaaatcgtattttatgaaaatgtcgaaaggaagaacggcacgtccaaatggtcattcagcaatctgttcaactacggaatggacggtgtcgtctccttcaacaacaagcccctcagggtatgctttttcaccggtattctgatattgcttctgtcgatggtttatattgtaacgacctttgttcatattctgacacacggcgtgtccgtacccggatacttcaccattatttccgccgtgctgtttttagggggcatccagcttttgagtctcggcatcatcggagaatacatcggccggatttactatgaaacaaaaaaacgcccgcactatttaattaaagaagcgaatataacgtacggagaacaaaatgaaacgaattatacaaaaaagcgcaagtggaaccattaaacagccgccgctgtgcgcagggtctggggacgttgtatgaaaaaaaataaatggatcttgccggcagcctgtgtgctggctgcggcagccgctcatatttttttcttaaaagagtggtcggcaggccgctatatgacggggtctggagacgggatcgcccaaatggtggtcttcaaaaagctgctgtttgatcaatatatgaacggcaggctgttttacagctattcgttcggactgggcgggggagtgtacagtcagctcggctattatttctctacttcttttctattcctgtttatctccgccgctgtccgctttttgcagcttattcagctgacgggtgaggctgatgcgctgttttgggcgcaggcctccgtttttatcagcatcgccaagcagagtttcatcatattcacggcggcttgtgtgttccgctatttcgtcaaacggacggtgcctgcttttgccggcgccgtgttgtacggggtctcgattatctacttccggcatgaggtgtattgggactttttcactgacagtatggtgtggctgccgctgctcgtgctcggcgcggaaaaaatcatcaggggaaaaaagccggcgtggtttatcttcgcctgtgcgctgacattgatcaacaacttttattttgcatatattaatctgattttcatcggcatttacatcttattcagatggatcattcatcttgaagacaatgaagccaaaaagctcactcaatgcagaatgtttattctgtcaggtctgctcggcttcggcataagcgcagtctcctttatccctgtcgtatacggatatcttcataatctgcggccgccgtattcagagcaaattgcatggcttgatttttccgacaacattttattttcaagccggataatcattctgccggcggtttttttgctttttctatttacattttctttatataaaaaccggctgttccggctgtttgcgggaatcagtctgctgtacattctgtttcacttcagtccgtttgcggcaagcgcctttaacggtttttcagctccgcaaaacaggtttgaatacgtcctgtgcttcacgattgccggaacggttgcagcagggctttctaagctttcagacatcagcatgaagagtatgctgatatccgccgtactcgccgttctgctctattggagccaagtgagacggttcagcctggatatttctgatcaggccaacctgcctatcctgctccttctggggctgaccattgccgctttccttgcagcaaagacaagactgaaaggcgcggtgcccgccgtctatgccgtcattctcttgacggcggtgctgacggctaatacatatgaaaaatatgcgttatcagaaggcgggaagatttatacggtatcgcatacctttatgacgggtcctgactataagggcaaagaacaaacagagcttattcagcgtctgaaagaaaaagaccctgatccgtttgcccgtttggattggatgaacggtgttttcaataacaccccgatcatatacgggttcaacggattcagcgtatactcaagcatactgaacagcaatctgctgtccttttactggaacgacctccggattgacatgggcagagaaagcgtcagccgttatgcgacattaggaaacagggctaatttatacagcctgctttacggaaaatattatatgacggaaaaaacaaacgaggccggcgtgccgtacgggttcaaaaaaatcatggaatcatcccattatgcggtttatcaaaatcaatatatgcttccgttcgtacggacagctgatcgcgtatataacgaggacgatctgaaaaaagcgcccgcccttgccagagaacgggcaatgcttgacgggatcatcacggaatcaagcacagccaacacgaaaaaagcgcctgaggcgaaaaatatgatccgtcaggcaaaggtaacggccgaccatgcggattatcaagacggcatcctgacggtaaacgaagacggcggcggcctgatcattacgccgcaagccgctaagatggacggcggcgattattacgtcagcttttatttgaagaataaagcgaaggaccagggctttacattaaaagtgaacgattacatgacaacgagaaaatcgaatcgatccatttacaaaacaggtgtcaacgatcttactgtcagagtgccgaaaacaaaaaacatccaaatccgtctgccgaaaggatcgtatcagcttgacagactggcgctttacgaagaacggtacgatacgctgaaaaacgcataccgaaaagcggaaaaagaaccgcgggccgatctcagatggcgcggaaatacgcttcatatctcgtatgaaaacaaaacccgcgcgccgtatagcatgcttccgattccatatgaaaaaggctgggagctgaagataaacggcagaaaagaacagattgaaaaagcggattattcctttatcggatttaaagcgcaaaaaggaaaaaacgatattcaattaacgtattacccgccgttttttaaacccgcggccgctctatcggtgatcagcctcgtgtttgccgctatatatgtgagaagacaaaaaaagcccggctcttaaacagagccgagctttaattttttctgcagtttttcctcgctgaaaatccagcccgtgtaggaagagagaagctctaaatcatgattgaggtggacgatggcgacaaaaggatagtggcctttgctccggtagcgcaaatcaataaagcgcacctcataatgatctttaaaagtatcgacctcccacctgtaaacgggggaaaatgaaagaaaggctgcaatattttcgtcctgtttcgcggccttcatcacatcggtttccggaacgggcactcggttgaatgtatccaatatcacgacatggccgtcaaggcttctgccgacataaaaggcatgcgccgtcgtcacggcgatacgccactgcctgaatttcatcgtcggcgaaataatgatggtttcaatctcctcttcaatcatttcgcgcagccttcgctttatccgcagctgcatcaaaaaccggacggcgtaatatcctgcgaggatgatataaagcatcagaaatgtcacgcccggatgacctccgatataccacacggcaatcgcggccaaatggctgacgaaaataaacggatcaaaggtattgattaaaccgagagcgatccattttctcgaaaacgggcggatggcctgtgtgccgtacgcgttaaaaatgtcaacaaacacatgcaaaacgacagccagaagcgtccacagccacaggtgcaaaaagttcgcttccggataaaacataaacaaaatgcccggaatcagaacggaccaaaataatacggcgggaatggagtgcgtgaatcctctatgatttcgaatataaacggcattatttttcagcttcaatatggtatcaatatcaggtgcctgagagccggcaagcgcggcgatcataactgcctgagacatgggggtgtgcatgccgacggcaggatcaagagttgcgattccgccaagcgcgatacccatgacaacgtgagtgccagtatccattgttgacctcctagcaggcgttaaaaatcagccgcccgcatatttcgcattataagatattccccattttctgtttgcccaatcatggcgtttatccgccgttctcatatgtttccgctttttctttatcactatttaatgtaacatattatcgtaacgtgcccttagtttacaccaaaatacagtgtcaagaaaagcggaacccgaaacatctgaggagaagatatgaacgcacttgaagaaaaaatgaaacaaaaagatatagacaaatttcgcgaggacttaattacatggttcgaaagagaacagagaattctgccgtggagagaaaatcaggacccgtatcgggtgtgggtgtcagaggtgatgctgcagcagacgcgcgtagataccgtcattccttatttccggcggtttgttgagcaatttccgaccgtttcggcgctcgctgaagccgatgaggaaaaagtgctcaaagcctgggaagggctaggttattactcccgtgtaagaaatctgcaaagtgccgtaaaagaagtgcatgagcggtacgggggagtcgtccctgccggggaaaaggaatttggcggactgaaaggcgtcggcccttatacaaaaggcgccgtgctcagcatcgcatacaacaaaccgattcccgccgtagacggcaatgtgatgcgtgtcatgtcgagaattctttccatatgggacgatatcgcaaaacctaaaaccagaaccattttcgaacaggcggtatccgctttcatttctcatgaaaaaccatctgaattcaatcagggtttaatggagctcggcgcgatcatctgcaccccgaaatcgccgtcatgcctgctttgccccgtacaaaagcactgttcggcatttgcggaagggacagagcgggagctgcccgttaaaagcaaaaagaaaaagcccggaataaaaacaatggcagccgttgtgctgacagacgaccaaggcgatgtctatattcataaacggccgccaaaaggcttgctcgccaacttgtgggagtttccgaataccgaaacccagaaaggaatcaaaaccgaaagagagcagcttgaagcctatttagaaaaagagatgggaataaccgctgaaatcggggagctggaaggcatcgtagaacatgttttcacccatctcgtctggaatatttcggtctttttcggtaaagtaaaacaagtgtcggatacaacggaattcatacgggtcacaaaagaggagctcaaggaatacgcatttcccgtttcccatcaaaagatatggaaaatggcggaagaaagcggccgctaaagagcgtcagtcatagctgacgcgagtgccgtggccgtaatccgcttcattccgtttcagtccgccgcgggcttcgatttcctgaatcagttcccggtatttggactggccttcttcgtttaaatacggcataatttgctggaaggcatgatggaaataggcgagctctgaatctctccaatcttgtttgggcatcatggccaattcgcccatatcacgtccgacatacatataaaagacccctttcaacacatattgcttttattgtttgttgaatgaaaagaactatacacagcaaggagctgaggaaaaatggaacaaaataaatgcgcactgatcacgggaagcagccgaggcgtcgggaaagcagccgccatcagactcgcggaaaaaggatacaatatcgtcatcaattacgcccgcagtaaaaaagcggcattagaaaccgccgaagaaattgaaaaactcggcgttaaaacgctcgtcattaaagctaatgtcggccagccggcaaaaatcaaagacatgtttcaccagattgacgaaacattcggcagactggacgtgttcgtcaataatgcggcttcaggcgtgctgagaccggttatggaactcgaagaaacacactgggactggacgatgaatatcaacgcgaaagcattgcttttctgcgcccaggaagcggcaaagatgatggagaaaaacggaggcggccacatcgtcagcatcagctcgctcggcagcatccgctatcttgaaaactatacgacggtcggtgtctcaaaagccgctttagaatcgttaacccgttatctggcggttgagctttctccgaaaaacatcatcgtaaacgcggtgtcaggcggagcgattgatacggacgcgctgaagcatttccctaacagagatgaactgctggaagatgcccgccaaaatacgccggccggcagaatggtcgagatcaaagatatgatcgacacggtggagtttttagtttcttcaaaagcggacatgatccgcggccagaccatcattattgacggcggacgctctctgctcgtataagttttaaaaaagatgaatagccttatcgtctcctgcgcattctaaagtgcgtggaggtgataacaatggcaaactcaaaatacagcaaaacagacgttcagcaggtgaaaaaacaaaaccagcaatcagcttccggtcagggtcaatacggcactgaattcggcagtgaaactgatgcgcagcaggttagaaagcaaaaccaatctgctgaacaaaacaaacagcaaaacagctaatcactgaaacgaaaaagcacttcatcttcggatggaagtgcttttttctgttgccaaaacgacaaaacttgtgattcctctacagaatgagtcaaagggttttccggcgtaaaatcgaaatggtaaggagtatcaacctaaaagcctaaggaggaacccgatgtcagagtttgaaaagcttgtaagtgaacagatgaaaatcatggatcagcttctcgagctgcagtcagaacttgaccgctgccggcaggtggaagcggaactcatcagtctggaaagagatgcaaagctggacaatgtacaggacgaaattgcgacaaagcgaaaagacctggccggcatacaggagttattccaaaggcagacagagcaagtcatccagtcttatcgcagcacggaaaagccgtcttcctatgtgcagaaatgaatgtgccattccggaagcggagtggttcttttattttcattttttaattcgtaacgttataatagtgaaaagacttgtcggaaagcaattgcggctgcattgactgcagggctttacagaaagtaggggagaaatatgggatatcccaaggaaggagaaaccattcaaattcacagctataagcataacgggctgcttcatcgaatttggaatgaaacgacgattttaaaaagtacggaattgtgtatcatcggagctaacgaccggacaatggtgacggaatccgacggacggacgtgggtgacgagagaaccggcgatctgctactttcatgcccgtcagtggtttaacgtcatcggaatgctgagagatgacggggtacactattattgcaacatcagctcgccgttcgcttatgacggagaggccatcaaatatattgattacgatttggatgtcaaggtgtttccggatatgacatataacattcttgacgaggatgaatacgatgaccaccgcaaatcaatgaattaccctaaagagatcgacagcattctgaaggagtatctgaatacgctgctgcactggattcatcagcggaaaggaccgtttgctccggaatttgttgatatgtggtatgaacggtatctgcgctatacaaaataaagaatacaataaaaaacctgttggggtgtcaacaggtttttcacatgggctcacacgccttaaagagagaggggataaagtgtgggcgtaatcagacgctatatgcaatttgtaaaaccttataaaaaacaaatttttatcacagtgttaatcggcattataaaattctccatcccgctggctctcccgcttctgttaaaatacgtggtcgatgacattattcaagggagcggaacggcaagcgctaaaacatcatcgctattcacgataatgggcatcatgttcgtgctgtttttaattctgcgtcccccggtagagtactatcggcaatacttcgcgcaatggacgggcagccgggtgctctacgatatcaggggggtattgttcgatcatattcaaaaattgagcctgaggttttatgccaacacgagaacgggcgaagtcatttcccgggtgataaatgatgtcgaacagacaaaagactttgtcataacgggactgatgaatatctggcttgatatgatgacggtgctgatcgtcatctgtattatgtttacactcgatgtgaagctgacattgatatctgtcattttgtttccgttatacggaatttcagtgaaatacttttacggccgtctccgaaaactgacacgtgagcgttctcaggcactcgcccaagttcagggacatttgcacgaaagagttcaggggatgcccgttatcagaagtttcgccattgaagattatgaacaagccaattttgatgaaaaaaacggacattttctggacaaagcgatccgtcatacgaattggaacgcgaaaacgttcgcggtcgtgaacaccattacggatttggcgccgctgctcgttatcgcatttgcgggttattttgtcataaacggcccgctgacggtagggacgatggttgcgttcgtcggctatattgacagaatgtacaatccggtcagaagattgatcaactcatcgacgacgctgacccagtcgatcgcttcaatggaccgcatatttgaatttatcgacgagccgtatgaactgactgataaaccgaatgcactaaaagctgacggcattaagggcgaagttgaattccgaaatgtctcgttccgttatgaggaaggaaaagaaacgattttgcaggacgtttccttaaaggtgacaaaaggggaaaccgtcgcgctcgtcgggatgagcggcggcggaaaatcgacgcttgtcagcctcataccgcgtttttatgatgtatccggcggcagcctgctgattgacggcacagatattcgcgattatgaagcgagaagcctccgcaatcaagtcggaatggtgcttcaggatacgtttctgttcagtgagacgattcgtgaaaatatcgccatcggtaaaccgggagcgtctctggatgaggtggttgcggctgcgaaagcggcaaatgcccatgaatttattatgaacttccccgaaggctacgaaaccaaagtcggcgaacggggcgtcaaattgtcaggcgggcagaagcagcggatttcgatcgcccgtgtattcttaaaaaatccgccgctgctgattttggatgaagcgacatcggctcttgatcttgaaagtgaacactacattcaggaagcgatggaaaagcttgcgaaaaaccggacgacttttatcgtcgcccacaggctgtccacgattacgcactcggataaaattgtcgtcatggaaaacggcgccgtcgtcgaaaccggcacgcacgaggaattaatggcccgaggcggccagtacagacacttatttacgattcagaatttgaactgatacaaaaacgtatgccgtccgaatgggtggcatacgtttttttgaatgcaaaaaaacccggttttacggaagcaccgggttactcttcgtctgtttctaattcgctgtctttcgggtggtatgtctgaaaactcgtaattaatgtatcgagatgctccagctgctcgcggtattccgcaaccgcagccataatgctgagcatattgtaatcaagcagttcatcctcgcagttctgctgatttttcaagaaagacttcgtcaaaagctgtttatatcttatgctttcttcagcatcgtcatcatgcggtttgatcttgccgaccgtccgcatcagaatcctttcgtgccaatgaagcagataatcaatttcttctgtcagcgtctcctgaaattcctccggcatatgataaatttcgttttcatagcggtgcagctttttcagcgtatcaagcgcccgatttgccgtaataatcgcctgtctgaataaaacaagcttgcgcgactttacatacgtcgttttcttaaagtagcttctctcctctttataaagaaggtacgtatgatcaagcttcatcattttttccttcagcttctcaatatcctctttcaatatcgagtgttccgtggactgacgcatcgtcagcctgatccatttcatgatctcatcggtatattcaaccgtatgatgagtcagcttcgtttcgtatttcggcggaagaaacacaaggttcacaataaaagaagacagcacgcctaaaataacggtgcttgttcgtatcagagcgaacgtcaggaagctgtttcccggtgtttctaaaatcgcgataaccgtcacgagcgcaatcgaaatggtgtgttcaattttcagttttaacatgatcgtgatgacaatcactgcggtcaatccgatcataatcggactcggtccgaaaatcagtccgaataccgtagcgatgacagcgccgatgatatttgcctgaacctgatcaataatgataagaaaagacctgtaaatagagggctgtatggcaaatatagctgcaatcccggcaaagatcggcgacggaagtccgatccatgatgctaagtagagcgcgagcgtaatcgcaatccctgttttaaaaatgcgggcaccaagtttcattggtttgtgcgtgcattcctttctctaataaattatgtgccgaacgaacggctgacacttacatttccctgtcggctgatttgctaaacaataaagtaatatacagggatcataccaattattcaaggtctttttttgaaaaaaccattatctcacaaatcggacaaaaagaaaaagcggaagccccgggctcccgcttgtttcagcagttattttttcatatgtctgaacgcatcttcaacggcttgtaaagtggcgtcgatatcctcttcagtatgtgcggttgtgataaaccaagcttcatacttcgatggagcgagattgatgccgcgttcaagcatcagcttgaagaacttggcgaatgcttctccgtccgtattttccgcctgctcgtaattgacgatcttttcatcagtgaagtaaaccgtgagcgcgccttttaaacggttgacggtgatggtaatgccatgtgtctccgcatgggcgagaatgccttgctcaagtctggcgccgagctcatcaagccgctcgtaaacgccttcttccttcagcacttccaggcaggcgatgcctgataggatagatgccgggtttccggccatcgtgccggcttgatatgccgggccgagcggagcaacctgctccatgatctcttttttgcctccgtaagcgccgatcggcaagccgcccccgataattttaccgagcgccgttaaatcaggcttcacttgaagaagatcctgcgcgcctccgtacataaaacggaacgccgtgatcacttcatcataaatgacgagcgcgcccgctttatgggtcaactcatttacctgttctaaaaatccttcttcaggttcaacgatgccgaagttgccgacgatcggctcgacgagaaccgctgcaatttctgaaccccatttatccagcgcggctttgtagctttcaatgtcattgaaaggaacggtaatcacctcattggcgatgcttttcggcacgccggcggaatcaggggtgccgagcgtagacgggccggaacccgcagcgacaagtacgagatcagaatggccgtgatagcagccggcgaatttaatgatttttgtccggcctgtataagcgcgtgcaacccggatcgttgtcatcaccgcttcagtgcctgagtttacgaatcgtactttatcaagtgaaggaatggcctccttcagcattttggcgaaagtgacctcatgtttggtcggcgtcccgtacagcacgccgttttcggccgctgttttaatcgcttcagtaatatgcggatgggcatgtccggtaataatcgggccgtaagccgctaaataatcgatatactgattcccgtctacatcccagaaataagcgccattcgctttttccatcgcaacgggtgaaccgccgcctaccgctttataggatctggacgggctgttcacgcctccgacgatatgctctaacgcttccttatgaagttcaactgattttgtatacaaaaaatgaccctcctaatatctccttacatcatgttctattgtagcatgcttcattgcgagcacaacggttcatgcttccagaaaagagcggggggataacggttgtaatcttaacgtgaattggatacgcttaataaaaaacccggaggtataagaaatgacgattgaaatcggacaaacagcaccggatatgaaattagtgaatgacagcggggaagaagtagcactgacggattttaaagggaagtacgtcgttctctatttttatccgaaagacatgacacccggatgcacgacggaagcatgtgatttccgtgatcagcacgaaagtttcgcgggacttgatgcggttatcatcggagtaagccctgacagccgtgataaacatgaaaaatttaagcaaaaacacgatcttcctttccagctcctcgttgatgatgagcacaaactggcggaagcttttgatgtgtggaagctgaagaagaattttgggaaagaatatatgggtatcgagcgatccacttttttgttagacaaagaaggccgtcttgtgaaggagtggagaaaggtaaaagtgaaagatcacgttgcggaggcgcttcgcgaattggaacaaattgcgtctaattaatggacaaatgctgaactcacggggttttcttcagattacatttgacaggagaccggaaaaagatgtacactaattataaacattataaagtaagaatcttttttagaagagaggtgcatgacggatggctgcacatgaattaaaagaagccttagacacgttgaaggatacgggagtccggattactcctcaacgtcatgccattctggaatatctcgtggattctatggcacatccgacagcggacgatatatataaagccttggaagggaaattccctaatatgagtgttgcgacagtgtataacaatttgcgtgtattccgggaagcggggcttgtaaaggaactgacgtacggagatgcgtccagcagatttgactttgtcacctctgaccattatcacgccatttgtgaaagctgcggaaaaatcgtggacttccattatcccgggcttgacgaagtggaacagcttgctgctcacgtcacagggtttaaggtaagccaccaccgtttggagatttacggcgtctgccaagaatgttccaaaaaagaaaaccactaaacgaagctgaccgctttgatacggtcagcttcgtttattttacactgttttttctgttataagactcatcgaacgcttggccttccaatcctttatccaatgtaagcggctctctgcaatgcatgcacatatccactctgcccagaatcttcgtttctttctcgcaagcggggcacatcacccggaccgcttttgtggacagcatgccgatccaaaaataaacggcggtgctgagtccgatcgacagcaggccgagaatcataaacaagctggcaagcaaaacagactgcttaaagaacagcccgatgtacataatgataaacccaacgaaaaccaaacttaacgcaaacgttctgatcttattaattttgcttgagtatttcgccatgtccatccccctctcgtttaactatagcacaaaacagatggcatattcttcatgttttcgtaagaaaagggaagaataaatatggcacctgaaaggaaatttgttataatagtgcaatgtgtttagaaaaaaggactttcatgttttatcatagaaatgtagaaacaatagctagtgaaacaatcgcattggaggaatcgtaatggacaatcttctccgtccaatttaccaagaaagagcaagtcatcccgatacgctggccgtccttatgattgagagaaggagtaaagcatcatccatcacggataactttgatgcggtcatgcttgtcattgtcaaacaggctgatgaacctctttttataaagcattatgaattcgaacacaaaaccgcttctttacatattgtaacggatgctctgcttcaggaatggattctgcttgggacaaatagaagagtcatagattggatcatcaacggtaaagtgctgtttgaccgcaatgaatatatatctgaactcaatgaccggctcagcacttttcctttcgcggagcggaaattaaagatcggaatggaatacggcaagctgatcagaagatttgtagaaggaaaagcgttttttgaagctgatcattttctggatgcatattatgcggtagtgcatgctcttcaccacttggcccgcatagaagtgattgaccgggggttttatcccgaaacgacagtctggaaccaggtccgtcacattgagccgcaggtatataagctatattccgaacttgtcgagagtcacgaaagcttggagaaaaggcttgaattattattcttagcaaatgattttctcatccattcaaaagctgaaatcggttctgcgcacctttttcaagtgatgaaagaaaaagaaatgtggcagtttggagaattgcttcagcaccccgaactggtgcacttcacccaagatctcggtgtcatgcttgattacctgacggaaaaaggctttgttgaagtatctcaaatagagaccaaagggcaggaagtatatcatcgaggatattctttcaaaaaaagtgttgacgctgaatcataggcatggtatattattaaacgtcgctgatgcgcttcaacaaaaagctcacagcggcggagaaataaaaacaaaaaacatttgacagcaaagcgctgaaatgttatactgaaaaagtcgcctcgagatgaggttgagatgatctttgaaaactaaacaagacaaaacgtacctgttaattcaaagttttaaataaatcgcacagcgatgtgcgtagtcagtcaaactaaggtctgcatgatgcagatcacacagacgttactgcaggatgcagtgaacttagtctgtgatccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcctacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggatcattcgattcttcgagatgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccatagaaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgctttctgttatctagttttgagagaattttttaaaaaaactcttgctttttctgaaatacatagtataataatacatgtcactaaaacgtctggtgatgatggcgaagaggtcacacccgttcccatgccgaacacggaagttaagctcttcagcgccgatggtagtcgggggtttccccctgtgagagtaggacatcgccaggcagacttcattccgcagtagctcagtggtagagctatcggctgttaaccgatcggtcgtaggttcgaatcctacctgcggagccatttatggagagctgtccgagtggccgaaggagcacgattggaaatcgtgtaggcggtaaccccgtctcaagggttcgaatcccttgctctccgccactaattatcaatacataacaaacgaaaaaataccagggcccgttggtcaagcggttaagacaccgccctttcacggcggtaacacgggttcgaatcccgtacgggtcacttatatgatggaggattagctcagctgggagagcatctgccttacaagcagagggtcggcggttcgagcccgtcatcctccaccattatcatcgcggggtggagcagttcggtagctcgtcgggctcataacccgaaggtcgcaggttcaaatcctgcccccgcaaccaaaaaaaatggtccggtagttcagttggttagaatgcctgcctgtcacgcaggaggtcgcgggttcgagtcccgtccggaccgccatttataaaaaggctcggtagctcagttggtagagcaacggactgaaaatccgtgtgtcggcggttcgattccgtcccgagccaccatttgccggtctagctcaattggtagagcaactgacttgtaatcagtaggttgggggttcaagtcctctggccggcactctaaatgatggaggggtagcgaagtggctaaacgcggcggactgtaaatccgctccctcagggttcggcagttcgaatctgcccccctccaccattttataaataggggcatagtttaacggtagaacagaggtctccaaaacctccggtgtgggttcgattcctactgcccctgccactatattatttattcatcttcagattatggcggttgtggcgaagtggttaacgcaccagattgtggctctggcactcgtgggttcgattcccatcaatcgccccatattatcattgggctatagccaagcggtaaggcaacggactttgactccgtcatgcgttggttcgaatccagctagcccagttgcattttttaaaaaaaacagcataagatgtaataagttctttttacatgttgcggaagtagttcagtggtagaacatcaccttgccaaggtgggggtcgcgggttcgaatcccgtcttccgctccaattacggcggcatagccaagtggtaaggcagaggtctgcaaaacctttatccccggttcgaatccgggtgtcgcctttctattgccggggtggtggaattggcagacacacaggacttaaaatcctgcggtaggtgactaccgtgccggttcaagtccggccctcggcaccaatttaactttgagcgaattatgttaaattggtcatcaattttcttattataaaacatatatgagagtgatttgcatattgcaggtcgcttttttttatataataaaagcgtgaagactatcaatataagtttcttgcttgtatcgtatatactgcattaccatttgaaaaaactttactaaaaccattgacactttataaaatgcatgttatatttatatacgtcggttgaacacgacgcattatatgccggtgtggcggaattggcagacgcgcacgactcaaaatcgtgttccttctggagtgccggttcgaccccggccaccggtatacaaaggcatctacatattgtagaagccttttttgttgtatgaaaatatctccaaggcttgtgaaaacatgatacctgcagcaggaggagctggattcggcgtaccgtgcttatattaaggaaacaccgattcggccgtggagtttaatctttccgatcggctgcttttgctattaacactgtttctcagctggtggggcggccattcaaaagcgatatgtttgggggcatgttaaccgcattattggcagcggttattgcagcattagctctttttatgtttcagcgctttcctgcaggcgagcttgttacccattttattaagggcggaaacgaattggtcaacgttattattatgttatcgctgatttgggccgtaacagcagtagctgaaaatctgggattctcgaaatatgttacttctcatttaacatcatggatccctcatatgtttattgcgccgtctctttttatactgggggctgttatatcctattttatcgggtcatcctgggggacttgggacgctggcggttcagttacataccagcttattattagcgatcggggccgtgtttgtgagcggaacattggatttgcttctcccctcagtgataatacggtgttggggatcgatgttgtgaagtatgcccgttcgaagcttgttccggcgcttatcgccgcagggatctccgttatgttatacgggcgtatttttcagataacaaatactttttgaaggcgttatccgaaattgggataacgcctttttaatgagctgttatacttgagaaaaaaaaagggtgatgacattgaagcagattattgcaatgggcggcggggggttttccatggagccggatcatcttgtgctggatcagtatattttagagcagtcggcgcggtcaaagccgaaagtttgttttttgccgacggcaagcggagattcggagaattataccggcaggttttatcaggcctttcaaaagctgcggtgtgagccggatcacttgtcgctgtttaaaccgccgggttctgatctcagatcctttctcatgaagaaagatattatatatgtcggcggcggaaatacgcgcaatatgcttgtcttatggaaagagtgggggcttgaccttattcttcgtgaggcttgggaaaacggcatcatcttggcgggtctcagcgccggagcggtttgctggtatgaagaaggtgtgacggattcagcgggggatttgcgagagttaagagctttaggatttttgccgggcagcttttgtccgcactatgacggagaagcggagcgccggccggtttatcaccgtctgatttccgaaaagaaactcagggagggctatgccgctgatgacggcgctgcgcttcattataaagacggtcagctgttccgggctgtctcttcccgggaaaccgcaaagggttatcgggtttttaataccgaagaaggcgttcgggaaacagagcttatgaccgtctcgttatctgaattttgataatatgcttttttttgtacacaacttatgttacgatgagagcgaaatcaatagttactgggggtgcccgtctgagcgggctgagagagaagcagcggcttcttaaccctttggacctgatctggttcgtaccagcgtggggaagtaaaggttttattattgttgatgaaaacaataatagtttctttctgactgcaaaaccgggttcttctttgaacccggttttttgtgctggtgctgagcttggttctgttattcaaatgataaaggagagatttgtatgcaaaatcaatcagtacagcaagcgaacatttccattatgtcgagcttttccggcagtaaaaaggtttatgcagaaggttcttcgcccgacatacgagtgccgatgcgggaaatcagccttagtccgacaacgggggcgttcggggaagaggagaatgcgccggtccgtgtctatgatacgagcggaccgtatacagacccggatgtacagattgatattcatgaaggtctgggggcgctccgcacaaagtggattaccgggcgcggagatgtagaagaatataacggccggaccgtgagacctgaagacaacggctataaaaaagagggccgtgccgccgaataccccggcctgcagcggaaaccgcttcgggccaagccggggaaaaatgtaacacaattgcattatgcgagaaaaggcatcattacgccggaaatggagtttatcgcaattcgcgagcatgtgtctcccgaatttgtcagagacgaggtagccagcggccgggcgattattccttctaacgtcaaccacccggaaagcgagccgatgattatcggccggaattttcatgtgaaaattaatgccaatatcggcaactcggctgttacatcttctatcgaagaagaagtcgaaaaaatgacgtgggcgattcgctggggcgccgatacgatgatggacttatccacgggaaaagacattcatacgacgcgtgaatggattatccgcaactgccccgtgcctgtggggacggtgccgatttatcaggcgcttgaaaaagttaatggcattgccgaggatttaacgtgggacatttatcgtgacacattgattgagcaggcggagcagggcgtggattatttcaccatccatgccggcgtattgcttcgttacgtcccgttaacggccaaacgcacgacgggaatcgtatcccgcggcggggcgattatggcgcaatggtgcctggctcatcatcaggaaagctttctgtacacgcattttgaagaaatttgtgaaatcatgaagacctatgatatcgctttttcacttggtgacgggcttcgtcccggttcgattgcggatgccaatgatgaagcgcagtttgcggaattggagactctcggagaattgacggagattgcgtggaagcacgatgtgcaagtgatgatcgaagggccgggtcatgtgccgatgcataaaattaaggaaaacatggacaaacagctggaaatttgtaaagaggcgcctttttacacgctcggcccattaacgacggatatcgctccgggctatgaccacattacttcagcgatcggcgcggcgatgatcggctggtacgggacggcgatgctttgctatgtcacgccgaaggagcatttggggctgccgaatcgtgatgatgtaagagaaggcgtcattacgtacaaaatcgcggcacatgccgcagaccttgctaaagggcatccgggtgcacagatccgtgacgatgctctgtctaaggcgcggtttgaattccgttggcgtgatcaatttcatttgtcacttgatcctgaaagagcaatggaatatcatgatgaaacactgccggctgaaggcgcaaaaacggctcacttctgttcgatgtgcggccctaagttctgcagcatgagaatttctcaggatattcgtgattatgcgaaggaaaacggacttactgaagacgaggccgtcaatgaagggctgaaagaaaaagcaaaagagtttgcagagaagggaagccgcttatatcaataaaagaaaagatgaagatggagagtgtccatcttcatcttttttagaaaaacggtgaacggcgaagcggcggaatgctctgctcgaagcggaatatattttccggatcatatttcgttttgacttgacggaggcggtgaacattttctccgtaatacgtttgcagccagtttctgatttctctatcaggccaattcacataatctcccatcgtttctcttgatagggacgttctcagtccttcgatccagcggacattttgtctttcttcttcagcagatgtccaagttgtaatatattcttgggcaatgattgcgttgcgatagtagaatgccgtttggtccggagcgatccgtccggccgccccgccgagagattgctgccagacactggcgttttcgttcggagcgtgctctaaatagcgctttaaagtggatattgcgcgtgttgataatggtttttcaataaaggatcctgaccgcttcatcttttgcggctgattgcctcccgggctgttaaaaaaggctgccgctttaataaatggcactgtcttgaccatgccgcttgtcggttttcccgctttcattaacggagccagcagttctttcagctcctcttttgtcccggtaaattgaccgagcgcttctatgcggttgacttccttaggccaaaactgaattgatgaggtaagccggttgtctgtaaatggagcccagcgctgccacgtgttaaatacttcctcgaaatcatcccagccccaagtgacagaaaaaacagacacgcacgagatcggcacggctttaaacatcatggatgtgacaatgccgaagttgcctccccctccgccctgagatgcccaaaatagatcagagtgctttgagcggttgaccgtgatcaagtcagcacccgctttttcgtccgctatgatcatttcgagctggaggagacgatcgcaagtcagtccggcagtccttgttaaatatccgattcctcccccgagcgtcagccccgtgattcccacattcgcaatggttcccgcaggaagggtcaagccgtaccgccagagtgtccggtagacttcccccaattcggctcccgcttcaatcgagaccagccgcttatcctcatttactcttattttcttcatttcactgagatcaatgactagtccgtcatttaacagagaaaaattttcgtagctgtgtcttccgcctctgatacggaagggcacattgttctcacgcgcccatctcaccgcattgagggcgtcatgtttgttttgacaaaacacaatgatgtctggatatctttgcaggcttaaattgatattggttcttgcagcattatagtccgggtcatcttttttgacgatgcgaccggtcaatgttgtcttttccacattctcactcactttcacttgtaatctgctatgttttctagcatatgcggaaaaatgagagagtgtatgaggaaaacccccggaaggacacgatattttaaattatagttgacaggtagggattgtatgaattaacataatcattacatatttccaaacgatggctgatcggatcaccgaaggctcttatctattaaacagataagggccttttttgcgtgaaagtcattaaatgaaaagcggagggatgaaaagtgggtttaaaaaaggtgacacatgtgcgcaaaaagagcaaaaaacggaaaaagtacagaaaacacacattgaatttcgaactgcttgtagagaaaaacaaacgggagattatgagaaatgaggaacagatggagcagatttatataaagatagatgaaaagcatgcgggggttcgataaagatgaaggagagaaaatggaggataaaaacaacggtactcgcgctgtcggtatccatcgtgttatcagggtgcgcgttagggagtgccggggaagaaccgtcatctgaggctgataaaaaggaagaaacacgtatcgcccatgtcaagacaaaggaatttaaagcttctcatccggcggcgattcccgctaaatcgaaagccagaactgacacttttgttgctgggatttccgcgccgggcggcgtgtttctgccgtacttttacgaaaacggctgggatggaaatgcgacagatcctatttttgaaccgttagtcaaactggataaaacggggaagcctgctccggctcttgcggaaagctggaaaatttccaaagatcagctaacatacacgttccgtttaagaaaaaatctcgttttcagcgacggttcaccgttgaccgcaaaggatgccgcattcactttaacactgctgcatgatcctgcatacgcgggctatgaagatatcaccacggcttatattaaaggcggtaaggcttacaaagaaggaaaggcaaagacgatagagggcattcgcgtccttgatgacagaaccattcaaattacgactgagaaagtcagtgcgaagtcgctgcttcttttgggcgggcaggtgctgtcagaagcttactacgggaagaaatatcaattcggcaaactggattatttaaaagagctttatgccaaacctctcggagcgggaccttaccaatttacagaataccttccgggacaggaaatacgctatcaggctaatgaacactattatgccggaaaaccgaaaacggaaaagctgatttataaaattatcgatccgtcaacttcccttcagctgtttgaaacgggtgaccttgattacgcttctttctcacctgatgatgatacggttcagcatttaaaaagtctcggttttgccaatataagcgtatctgtcgtgaatgattacgggcttgtatacgtcaatcacaagcgtccgccttttcaagataagaaagtgtcccaggcgcttatttacggacttgaccgtcaaaaaatcgtcgatgtccgctttaaacgctacggagaggtcgcgaatgttccggtgtctccggtttcgtgggcttatgatgacaagggtgtcaatcggtacgcgtttaaccctgaaaaagccaaaaagcttcttgatgaagcaggctggaaaacgggcaaagacggtgtacgtgaaaaaaacggcaaaaagcttgaaatcagctattacacatctaaagcggatgatgatttcatcccgatagcgaaagaaaattatgcggacatcggaatctcattaaaaccggaagtgatggattttaatacagaagtagcgaaaatcaatgacaaacaatatgaccttgccgccgtttccacctcgcagattcttgatccgaatgacacggtggaaaagctggcttccggccatcccaataatgtgacggggtattccaatccgaaagcggaccggctgatagagaaaggagccggcacgcttgatatcagcaaaagaaaagagatttatcaccagctgtaccgggagctcggggaaaacccgccttacattctgattcattaccgtcagagcgcaagggcggtcagcggaaaaataaaagggcttgagcctgataattattctggaatcagttcaagtctctcaaatgtctcaattcgatagaacggttgggcaaaatacccgatgcatcctggggattttgccctttcagcggaaaggaggggctttttatgaaacggtatgccgcagaacgattcattcaaatgcttgtgatcttattcggtacgtcctttattatttttttcttattcgccatgctgccgggcgattatattgattccaatgtaaatctgactccggaaagagcgaaggagttaaaagcgctttacgggctggatcagccgatttggaagcgttatgtgacgtggctcggaaatgtgctcagcggagattttgggttttctttgaaatatcaggagaacgtcctgtcactgcttcggaaatatgtctggaattcgttttttgtcgcctttttggcgttgcttgtcacatggtcagccgcgatgatcacgggtgtcatatccgctgtcaggaaatactcatggtttgacgggatcgtgacgtttcttgtttttgcttccatggcgtttccatctttttttatcagccttctgtttattaagtggtttggggtggatttgaaaatattgcccgtcggcgggatgattgataccggaagcacgagtacaggtttttcgtacgtgcttgaagccgccagacatatgattcttccggtcgtgattttatctatgctcggcatcggctcgctgacaaggtatttccgctccggcatgctggacgtgatcagacaggattatatcagaacggcgagagcgaagggattgaaagagcacaccgtcatctggaaacatgcgttgaaaaacgcgcttattccggccatcaccctgcttgcttttgaactgccgggactgttttccggagccatcattattgaacagattttcgggtggccgggtgtcggccgtattcagcttgaatccgtgcattatcgtgattatccggttttgatggcgtttaccttgtttttgtcttgtttaacgattgtggggaacttcttggcggatatcgcttatgccgcggttgatccgcgggtcaggctgaaataggaggtgtgcggaatgaaaaaacaaaaaggggtgccgccttctctttggaagcagacgtaccgccgcctgctgcagcataagctgacggtcatcagtcttcttttcttatgttttatgtttttattgtgctttatcgggccgtctttttctccgtacataacagatcggacggatatttcaaatgccaatcagcatccgggaatccatcactggctgggcaccgaccagtacgggagagatgtgctgacgaggctgatgctggcggggcagatttctctgaccgtggggcttgcttcaatggtgctgtcgcttgtcatcggctctttactcggggctgcggccgggttttatcggggagccgctgatatgatcattatgcgcattgctgatatgctcatgtccatcccgggcctgccgctgcttttgattttggctgcggtgatgtcggagtggaaagtgccttctgaatacagaatgtacctgattatgatgatgttaagcctgatcggatggcccggtttggcgcggcttgtacgcggacagattttgtcgctgaaggagcagccgtttatgatggccgcggaagttttggggcttagtgataaacggaaaatcctctatcatttgcttcccaacacattgccgttattactggtagcggcgactttgcatgtggcgggagcgatgctgagtgaatctgcgctgagttttctcgggcttggcgttgctccgccgacaccttcttggggaaacatgatggaagcggcgaatcattttatggattttacactccgcccgtggctgtggattccgccgggaacggccatttttctgaccgttgtggcgattcatctgcttggagacggtttaagagacgcttttgatcctaaggtaaaacggcaggtgaaaatgaaatgaaaaaaccgcttttagaagtgaggcatttggaaacggctttttatacagaggagggtgcggtaaaggccgtggacggtgtcagctttacgatacatgaggaggaaacggtttgtattgtaggagagtccggctgcgggaaaagtatggcgtcattgtccattatgcagcttattcccgagacggggagaatcgaacggggagcagtgcatttttccggacagaatctgttggaattgaaatcaaaagacatgcagaaaatccgcggcagcgaaatcgggatgatttttcaggaaccgatgacatctttgaatccggtatttacaatcggtgagcagctgaccgaaccgattcgcgaacatttgttgctgagtaagaaagaggcatggcggagggccgttgaactgatcacgttagtggagatcccgaatgccgagcaggttatgcaccgatatcctcatgagctgagcggcggcatgctgcagcgcatcatgacggctgtcgcgctaagctgcgatccgaaactgatcattgccgacgagccgacgacagcgcttgacgtaaccattcaggcgcagatattggatttattgcgggatatgaaaaagcaatttcgcacgtctattttattcattactcatgaccttggcgtggttgctgaaatggctgattatgtgattgtcatgtatgcgggaaaaattgtggaggaaggaccggttgcagagctgttttctgatccgaagcatccgtatacgaaagggctgctcgcggccaagccggttatcggtcaaaaaagggagacgctttacaccattccggggcaggtccccgagcttgcggacctgtccggatcgtcttgttattttgcggagcgatgtgaacacagcacagaaatatgccggagatcgagcccgcattttactgaattcgggaaggggcatcaggcggcgtgctggctttacagagaggagaaagcagatgagtgatgtgttgctggaggtcaaggggctgaaaaaatattacgaggagcatggggggatgagaaagactcataaaaaacccgtaaaagcggtcgacggcgtcagttttacgataggaaagggagaagtgttcggcttagcgggagaatcgggcagcggaaagtcatcaatcggcaagaccattttgaggcttcatgagaaaacagggggagaggtgttttttcaggggcgtgatgtgtttcggatgagccggcgcgagctcaaaactttcagatcggaagcgcagctcatctttcaagatccgttcagttctttaaaccccggcgccggatcggagaagccatcggtgaagcgatgatcgagcatcaattggcggtgaagcggaatgcgcgtgataaagcggcggaggttcttgaagcctgcggactttccgcaacctttatcgaccgatatccgcatgaattttccggagggcagcggcagcggatcgtgattgcaagagcgatggcgctcaagccgcaatttatcattatggatgaacccgtggcggcgttagatgtctccatccaggcgcagatgatcaatttgttcagcagccttcaaaaacagcacgggctgtcatatttgttcatttctcatgatttaagcgtggtggagcacttatgtacgaaggtcgccattatgtatttagggacgattgtggaatacgcgtcaaaggaggagctcttttcacggccgcttcacccttatacgaaagcgctgttatcagccgtgcctgttcctgatcccggagcgaaaagggagcggataattttaaagggtgatataccgagcccctctgatccgccttcaggctgtaaattccgaacgagatgtccggaagccaagaagatatgtgctgagaaaagtccggcgctgtcagaaaaagggcttcatcattttgcggcatgccacttcgtgtaattgagaaaaaaacggttttattgataataaacaggaaaaacctgccgggcagaccggcaggtttttttgatgttattttggtgacggcagtccgagtccttcggcaacgcgtctgccgtattcaggatcagccttgtagaagtggccgatctggcgcagcttaatttcttctttttccacaggtttcatcgcactgacaatattggcgacaaggcgcgcgcgctcttcctcgctcatcaggcggtacaggtcgccggcttgtgtgtaatgatcatgatggttatagcttacactgtcagcgaaacctgatacaggatatgccgcctgtttatcttcaggtgactctttagggcccccgaagctgttaggctcgtaatagacggagcggccgccgttatcatcaaaacgcatttgtccgtcacgctgatagtttttcacttcattgcgggaacggttgatcggcagcgcctgatggttcgcgccgacacggtagcgatgcgcgtcatggtatgcgaacaaccggccttgaagcattttgtcaggtgagacgtcgacgccggggactaatgtgccgggagagaacgtcgcctgttctacttccgcaaagtaattttccggattgcggttcagaaccatgcggccgacttcgatcagcggatagtctttttgagaccacacttttgtgacgtcaaacggatcaaagcgatatgtgtttgcatcttctaacggcatgatttgaacatataatttccatgcggggaaatcgccgttttcaatcgcattgaacaaatcttccgtatggtaatcgggattttcgcccgcgatttttgcggctgtattaacatcaaggtttttcacgccttgctctgttttaaagtgatatttaatccagacgccttcgcctttatcatttgtccatttaaatgtatggcttccgaatccgtgcatatggcgaagagtcgccggaatgccccggtctgacatcagaatggttacctggtgcagggattcgggtgacaaagaccagaaatcccaaacggccgtcggatttttcagatgtgttctcggatctcttttttgtgtatggataaagtcagggaacttgatggcatcgcggatgaagaacacgggtgtattgtttccgacgatatcgtagtttccttcttctgtataaaatttaacggcaaatccgcgcgggtcgcgcactgtgtcactagagcccagttcgcccgcaacggttgagaaacggatgaaaagcggcgtgcgtttaccgacttctgacagaaatgcggctttcgtatattttgtaacgtcatttgtgacttcaaaataaccgtgtgcgcccgcgccttttgcgtgaacgacacgctccggaacgcgttctctgttaaagtgcgccaatttctcaagcagatggacgtcttgtattaaagcaggaccgcgatcgccggccgtcattgagttttggttatctccgacaggagcgccccagctggttgtcaatttatttgaactcatgtgatcacctctttaaatttataagaacataatatcacctatcagtaaaaagtcaatattattttataatgattataaaataattatttttattatcgaaaagaaagttcgggtttgaaagaccacttgactgaggggaataatgggtttaatatgagaaaaaatagaaaccgctgacttggacacaagaggctcttattcttcactggataagggcctttttttattgtcaggcggtaagggaggcggcaattgtatgcttttcaggcagcattttaaacctgtcgatattcacggtcatctgccgtacagccttaatttcggcaaaaacgataagacattttccgattataaccgggagcggtcggaaagaatgaatctcacttgggattttcctgatccgcatgatgttgatggcgatgacggcgaaatcgctttgatgacaagatgggagaaagaattagataagtacggcattgacgtgctgaattttttaacagcagagagcaatgaccggatggcggcgtttattcaagccaatcccgcgaggtttaccggatttgcatatcatcctttggaacaaaaggatgcgtatgaggagctgaaaagagcggttgaagagctcggtctgaaaggatataaactgttcgggccgctgacagacatcgagtttcatgatccgtcgctgaaaaagctgtggacgtatctggctgacaaaagactgcctgtattaattcacttcggacttttagggagagcgggtggcattgtcagccatcgcaacatcaacccgctctccatctatcgcgtcgcgagagagtatgctgatataccgttcatcattccgcatttcggcgccggatattatcaggaactgctgcagctgtgctggagctgcccgaatgtgtatattgacacgtccggctcaaatcagtggatgaggtggatgccgtaccggcttgatttggaaattctgtttcgaaagacatctgaattaatcggtgctgaacggatcatcttcgggacggattcgaacggatttccgagaggatatgtatacagatatcttcaggagcaggtgaggacctgccgggaaatcaatatgcgggaagaagatatagaaaacattttcggcaacaacgcgcggacattattgaaaatcgcccggaaagaaaaggaagtaaatacgtgatacagccgatgcgctctttggcaggtttatgccggaaggcgcatttttaattcatacaaaaaacagttgacaagtcggaataatttgaattaacatgatattcaaatttaaaaacaaacgggttgccgatcggaccgccgaaggctcccatctctgcaagcaatcggagatgggggcctttttgtttttcgatcgcatgcggcagaaagagaggggaagacagatggctgtaaccatcagcatacaagaaaaagtgtttgagcatgaaggccggaaaacgccggtgctgaatgatattgagctgtcaattgcatcgggagaatttttgactgtcatcggaccgagcggatgcggcaaaagcacgcttttaaaattgattgccggtcttgataccgattataaaggctctgtcacaataaacggccgcaatgtgtcgggaccgggcatccggcagggatttatctttcaggagcaccggctgtttccctggctgacggtaaaacaaaacatcgctgccgatctcaatatgaacgacccggccgttcggaaaaaagtggatgatctgattgaggttgtcaggctgcagggagcagagaacgcttatccgcgcgaattatccggcggcatgtcgcagcgggttgccatcgccagagcccttttgcgtgagccggaggtgctgcttttagatgaaccgttcggggcgcttgacgcttttacgagaaaacatttgcaggatgtgctgcttgatatatggcgcgagaaaaaaacgacgatgattctggtcacgcatgatattgatgaatccgtctatttaggcgataagctggcgatcctcagggcaaagcccggccggctgcacagcctgatgccgattcagcttccgcatccgcgcaatcggacgtcagcggattttcaggccgtccggcagaaggtgctttctgaatttgagaaaacggaagacctccggtttgcggacgggtccgggatatagaagggacgaagcgaagtgaaaaaaatcatcattcttttagccgcagcagtcatgatgtcagccggatgcagtgcagacgggacaggggggagcgggaaaacggtgaaagaaatccggatcggcatccagcagagtttaagcccgcttctcattgccaaggaaaaaggctggtttgaagaggccttcaaaaaagacggaataaaagtaaaatgggtcgaattccaaagcggtcctccgcaatttgaaggtcttgccgccgataagcttgatttttcccaggtcggcaattcaccggtcatttccggtcaggcggcaggaattgattttaaagagatcgggctgtctcaggacggattaaaggcaaacggcattctcgtaaacaagggcagcgggattcagagcctgaaagaattgaaaggtaaaaaaatcgccgtagccaaaggcagcagcggctttgattttctctataaagctttagataaagcggggctttccgccgatgacgtcactatcatccagcttcagcctgatgaggcggtttccgcttttgaaaacaaatcagttgacgcatggtccatttgggagccgtatttgtcgattgaaacgctgcagcacggggcggaaatattggcgaacggagaaagcacagatttatattctcccggtttcacgttagtcagaacgggattttccaaagaacacccggatgaggttgtccgttttctgaaagtgttcaataaagcagttacatggcaaaaggaacacaaagatgaagccgtctccttatatgcgaaaatcaaacatcttgatccgaaagtcgtcagaaacgtgcttaacaatactgagcctcttaatgaaccgatcaatgatgatattgtcaaagcccagcaggaaaccgctgattttcaatttcgaacaaaagcgattcataagaaaattcacgtaaaagacgttgtcgacaattcatttattaaaaaagcgcgtgaaacgggggatggcaagtaatgaaagcagaagcaccaacggctgccggcgcaataagccaatcagaaaagaaagctctggcaagatcccggaagtattcataccaatggatgaaagggattgtactcccggctgcggtcatcgcagtatggcagtttatcgcaagtctgggcatcgtctctgcaacggtgctcccgtcacctgtcgtcatcttgcagacgtttcaggaacttcttctttcaggtgagctgtggggtcatttagagatcagtttataccgggcggctgccggatttctgcttggcgcgggcctcggacttgttttcgggctgctggtcggtttctcaaagcggacggaagcgtatctcgatccgtctctgcaaatgctcaggacggttccgcacttggccgtgaccccgctgttcattttgtggttcggatttgatgagacatcaaaaatcctgctgatcgcattgggggctttttttcccgtgtacattaatacgtttctcggaatccgcagcgtggacgcgaagctgtttgacgtcgcgcgggtgctggaatttaattggtatcagcagatggcgaaattaattcttccggcatctctgccgaatatcctgctcggcatcaggctctctctaggcattgcatggctcggtcttgtggtggcggaactgatgggatcgagcgagggcgtcggttatatgattatggatgccagacaattttcacagacaaataaggtgtttgtcggcattatcatttttgcggctgtcggcaagctgacagatgcattggtcagaatgctcgagcggaaactattaaaatggcggaacagttatgaagggtaacctattaaaaaaggagagattcatatggagattctttggtttattccgacgcatggtgacggccggtatttagggacgcaaacgggagggagaacggcggatcatctttattttaagcaagtggcacaggcggcggacagactcgggtatacgggggttctgctgccgacggggagatcatgtgaagacccgtggctgacggctgccgctttagcgggggaaacgagtgacttgaaatttttagtggcggtccggccgggactgatgcagccgtctgtcgccgcgagaatggcgtcgacaatggaccggctgtcagacggccgtttgcttgtaaatgtcgtagcaggcggagatccttatgaactggcgggagacggcatgtttatcagccacgatgaacgttataaggcgactgaggaatttttaaccgtctggcgcggactcatgcggggcgaaacggtgacatatgaaggggaccatatcaaagtggaaaacagcaacctcctgtttccgccaaaacagtctccgcatccgccattatatttcggcggttcatcacaggcgggaattgaggctgcggcgaaacatacagatgtctatttaacatggggagagccgccggagcaggtaaaagaaaagattgaaaccgttaaaaaacaggctgccaaggaaggaaggacgatgcgttttggcatcagacttcacgtgattgtccgggagactgaggaagaggcatgggaagcggctgaacgattaatcagccgcttagacgaagagacaattgcgaaagcgcaggctgcgctccggcgcgctgattcatcgggacaaaaacggatggccgatcttcataacggtgaccgctcgaagcttgagatcagcccgaatctctgggccggcatcggactggtcagaggcggagcgggcacggcgcttgtcggtgatccgcagactgtcgctgatcgaattttagagtatcaggcactcggcattgagtcgtttatcttttcaggctatccgcatctggaagaagcttattatctggctgaactcgtgtttccgcttctgccgtttcagaatgaacggactaaaaagcttgagcgcagactgggtgaagcaatgggaaacgaccattttgcaagaggaaataaagcgacagtctgatgacgtcgcaaggcggatcattgacggcgggcgctttctgcggattcatttccggggaaatgccggcagtgaaggcgggtattcacccgcctttttaagcgcttagcttgcacgatgctcctatggatgatatgatacaaaacgtaattattacgatttgttaggagtgctgaaatggcaaaaaaatcaaaagtgatcaaagagctcaagcggcagaagcttgttgaacaatatgcggacatccgaaaagaattaaaggcaaaaggagactgggaagcgctgagcaaactgccgcgtgattctgctccggccaggcttcataaccgctgtacggtgacggggcggccccgcggatatatgagaaaatttaaattgtccagaatcgcattcagggagctggcccataaaggccggattcccggggtgaaaaaagcgagctggtaatgtaaaaaactccggatctgtcatgaaccggagtttttgccgtgcttatgaaatgtgaaaacataagccaaatgctgaatcatcatcagaatgaaaatcaaaagaatcggaaaaaagggaagatgcggctgaatcagcggataaaacaaaagcagaacggctgcggccggcaatgagaagtaaacggcaatatacgaggaacggcaagctttagccgtcatcattcgttctctttcatcctgttcctcaaattcatcgggcacaagcctgtgctttttgccgtttcgttttttcttttcggcatagatatacaatgcggcacaaacggtaaacagcagaaacggagtgatattcagctcaaatgaaccgctcccctccgtttggaaaaactgagcgatccgcggtgccgcttccataaaggaaataagcgtccagcaggccaatccgtagagtgcaaggtgaaaacacgcttttcttttcaaactcattttttctcctcctccagccagaaaacttcctccatcggcagtgagaaagcccggcagatgttaagcgccaataagagtgaaggcacataatctcctttttcaatcgctgcaatcgtctgtctggtggctccggcttcttttccgagcgtttcctgagaatagccgaatctggctctcagctcttttactttatttttcatcatcagggcgtacctcaagttttcttcttttttatattgtatgagattcttaacaaaatgtaaacctgacttaacatgtggacaaaaaaagaatttttttcgacaaattttttaacattcccttgacgaaaaaaaaatatacatgtaatattagaaacatcaaatcggtactgacaaaaaactttgatgcgggtgtagtttagtggtaaaacctcagccttccaagctgatgtcgtgagttcgattctcatcacccgctccatacatacgttattaacgcagtgtttcgtttctctgataaacgaagtattgcgtttttttatgtgaaaaaagacacgaaggcgtgtctttttatgaaagccaagagacggtatgcgtgcctccgtgaatttgttcaaacattttggttaaagatgatagcagctcatccgccgcgtcggcatgaaatgaaggcgggaaaaagatcagctgcagcattttctttgtgccggttgttacagggcgggtattgagatgtccggtaaggccgccgaaaatgccaccagagtcggaaaaagcaagtacgtgttctttttctccgattgtaatcgaaatcggttcatctatttctgcggcgtcatacgccatgataggcaatgaatatttcaaggagaaaaaaagtatggtatcatgggctgaattcacactttcaatgaatcgttcccgggaaatatcgccgagcataagctccatcggcgttttttgtcctgaaaaggcgggactgagctgttccattatacgcgcccactctttaacaaaaggctgctcatctataccgccgtcagcataatcaaagtaaagagattcttgaaataaacggaggcggcctttcagcatttgcggagcgggcccgacttcgatctgttcatataagacggctgccgctttgatccccggcacccgttcagcaataagtggatctaaactgatgttcaagtgtgttcactccatttcgggatgataaaactctattatacccgtgcgggagcctgatcacaaagaaaggaggctgtgcaaaaaatgaatattcataaactgaaagaggaattaatcgaatacgccaaaagcatcggagttgacaaaatagggtttacgacggctgatacgttcgacagtctgcgggaccggctgattcttcaggaatcactcggctatttatccggttttgaagagccggatattgaaaaacgggttactccgtctttgcttctcccgaaagccaaatcaatcgtcgccatcgcccttgcttatccttccaaaatgaaagatgcgccgaggagcacgagagacgggcggcgcggcattttttgcagagcttcctgggggaaggattatcatgatgtgctgcgggaaaagcttgatctgctggaaaattttctccaaagcaaacatgaggatatccgcacaaagtcaatggtggatacaggagaattgtccgacagggccgtggctgaacgggcgggaatcggcttcagcgccaaaaactgcatgatcaccacgcctgaatacggttcttacgtctatctggctgaaatgatcaccaatctgccctttgaaccggatgtgccgattgaagatatgtgcggtacgtgcacaaaatgtctagacgcttgtccgaccggcgcactcgtcaatcccggacagcttaacgcccagcgctgtatttcgttcctgacccagacaaagggatttttgccggatgagttccgcacgaaaatcggaaaccgtctgtatggctgtgacacgtgccagacggtctgtccgattaataaggggaaagattttcatcttcatccgcagatggagcctgatccggaaatcgcaaagccgctgttaaagccgcttttgaccataagcaaccgcgaattcaaagaaaaattcggacatgtatcgggatcatggcgcggcaagaagccgatacagcggaatgcgattttagctttggctcattttaaagatgcctcgtctcttccggaattaacggtcttgatgcaccaagatccgcgccccgtcatcaggggtacggccgcctgggccatcgggaaaatcggtgatcctgattatgcggaggaattagaaaaagcgcttcaaaaggagcaggatgaggacgccatacgggaaattgaaaagggactggagctgttatcggtttctgagaagactaaaaccggccggtcctgacatatgtatagagaaaaagcacttggccggagttcaagtgttttttctttataaaatcgtatggggtggagcgcttgaagcatattattgaagatttagcggaggcccggcttcattatttaatcaacggaaccgagatgaggcagaatgggcaggccggcgatcttgaggtcctgacgagaaaaaaagagctgtttgaaaaacggaaagttgatatcgtgaaggcgaaggcaaaagccgtcattgtcaaaagcagtcttgaggacgacggcacgttatgtgtcatgtacacgattcatttcgaatatttgtgcaaggagcatgacggacacctttacttagaagagcagattgaggaacggattgcatttctctatgatgagcttttgattaaagaccgggaagtaaagaaaaaaccggctggattttctgacggaaacagcgtaattgaatatgagcggagtgaacgggaagatttcgggcgggcgtttcaatacgaccgtctggctgccgtgcagtacgcggagaagttttggaataaacgaaatcccgcttataaaaatttcagcgataattgcaccaattttatttcccaatgtttacatgccggaaaagcaccgatgcgggggcatccgaacagaggctcaggctggtggatgaaggcaagctcgtggagctacagctggacggtcgcgcattcgatgaagatgtatctggcccaatccaaggcagggctccgcgcattgcaagtatcaagagctgaagaactgatgcccggagatatcatttgctatgattttgaaggagacggccgttttaatcatacggcgatcgtggtcgcaaaagataaaagcaatatgccgctcgtcaatgcccaaacgtatgacagcagaatgagatattggtcatatgaggattcaacggcgtatactccttccatcagatatgcgttttttcatattacggatgatacgacaaaagagtaattaatgatataatggtgggcggaataaaaaacagaggtgaacatcgtggcattacatgtcgttttatatcaacccgaaatcccggccaatacgggaaatattgcacgtacttgtgcggcaacagacacaacgcttcatttgatccgcccgctcggattctcaaccgatgataaaatgctgaagcgcgccggactcgattattgggagttcgtcaacgtcgtatatcatgattcattggaagaattatttgaggcatatgagaacggaaagtttttcttcattacaaaattcggccaaaagccgcacacatcatttgattactcaaatacggaggaagactttttcttcgtattcggcagagaaacgagcggacttccgaaagaattgatcgaaaacaatatggaccgctgcctgcgtctgccgatgaccgagcatgtgagatcattaaacctgtccaacacggccgcgattcttgtatatgaagcgctgcgccagcaaaattacagagatttgacgtgagaaaaaacgcccgcatccgggcgtttttttattgaataaaaagacgggcagcagcggttcacggcatttttatattttcagccttaacaacgtaacagtgttatgttacaatacattcatcgaaggagctggattcatggaggaacaactgatttctaaaaaagatttgctggaagaaacatcaatttcatacgggcagctgtaccggtggaaacggaaaaatttaattcctgaagaatggtttatccgaaaatcgacgtttacaggccaggaaacattttttccgagggcggaaatattaaaacgcatctcaaaaatacagaaaatgaaagaaaatctgtctctggatgaaatgagagaaatgctgtctccgcaaatgactgatgtcaatataacgtctgcggaactgcttcaaaagggactgatttcaaaagccgcgctgcaagtttatggcgaagacggcgtgacattcacgtcccgcgcgctgctgtctttatatgtgcttgaagggcttttgcaatcgggcaatatcagccttgaggaaggaaaattggcagcaggggtgctgaaaacgtatgaggcttccgagctgaaagcgaatacggagcttgtcatgctccgaaagcttggcgtaacgacgtgcttcatcgcagacgcggaacatattttgtttgaaccgactgtcaaagtggttgaacgggtggcgcttgctgcggcatcggaagaattaaaaacgaaatggatgcaggaggaccatcaatggaagtaacagataaattaatcattaacggttcgggaagttcaaaaggaggccgttttcatacagtggagatcaacggaagcggcacggtgtcaggtgatgtggagtgcacgagccttttgtttaacggcagcggaaaaacagacggacatgtcaagacgcaaacgctgacgatcagcggttcggggaaaatttccggcagcgccgaagctgaatccatccgtatcaacggaacgggtgtcattaaaggtgatgtcaaaacggagcggctgaacgtcgcgggattttcatctttcggcggcggtgtgaaagctgatgatattttcatatccgggaaagccgggattgaaggcgattgcgagacagagacgttccgttcggaaggcaaatgcaagatcggcggcctgctgaatgctgatgaagtcagtattaagctggcggcgggagagagccgggtgaaagaaattggctgccgccatttgaaagtgatgagcagaaagagcgtgcttacgcgttttaagctgatgccggccccggtgctgacagcagagctgattgaaggtgacatcattgaattggcggacacgaacgcgaagacagtccgcggaaatcatgtgcggatcggcgcaggctgcaccattgggacggtggaatacagcggcgattttgcatgtgatcctaccgctttggttaacaaagtcatgaaacgataggaggagctgcgatggaaacgacaaaaaaattgagtcatttaaaaatgtacggagccggacacgcctccggcggttcctaccaaaatgtaagcattaaaggggaaggaactgtcggcgaaggacttcaaagcgaatgctgccggatattcggcacgggactttttctcggagatgccgagatcaacaggctgaaaattttcggagagcatgaagttgcaggagatttatcagcacattcagcaaatgtgatcggcacattgaaagtcggcggctccatgcgtttcgccagaatgaggctgaaaggacttgctgaaattggcggcggggccgcgggagagcagtgtcacataaaaggcagtctcaccgtcggcggcgattgcgagacggagctgcttcatgtaacaggatgtatcaatgtggcgggattgttaaacgcaggggacgtaaacatccatttgcgttatgaccgaagccgtgtgaaagaaatcggcggcacatcgatcaccgtcagacggaaacccggttttcttaaacggaaagccggcatgctttctgctgaattgatcgaaggagacgcaatttacctcgaatacacggaagcggacattgtcagagggaagcgtgtggaaatcggcccggggtgcaaaatcggaaaaatcgagtatcaaacaagctgcaagtctcatgaaaaatcaactgtccaagaacatattcaaatatgaaacattgttatgttgtacaggaaagggtgctctccataaagagcacccttttgccgttatttgttttcaggtttgctgtcgtaacccgccgtaaaaatggatactaaaaaagtgagaatgaccccaagtaaaatgatcgttttcatcatgtctcctcctctttgcttttccatttgatgtccgagtctggatgaaactgtatttatttcattatgaacggtgcaccggacccttgtcaatgacggccttatcacgtctttatttttaagaaacgaaaagcatgtattatcacgtcaccgcatagattgtaacaaagtaccttatttctagtgcattaaccatgatagaggaggttcttatggatatattaaagaaaattgaaaagtacagagaggaagagcagcgtctcaaatgggaagggacgttcgctgattatttggagatcataaaagaaaatccattggtcgcgcagtctgctcattctcgcgtttttaatatgataaaagacagcggaatcgaagagggtgacgggaaaaagacatacagctttttctcgagggagctgttcggccttgaggaatctctggaacggctcgtggaggaatactttcacccggctgccaagcggctcgatgtaagaaaaaggattttactattgatgggacccgtcagcggcggaaagtcaactcttgtcaccatgctgaaaaaagggcttgaagcctactcattgacagacaacggcgctgtttacgccattaaaggctgcccgatgcatgaagatcctctccatctcattccccatcatctgcgcgacgacttctacagagaatacggcatcagaattgagggcagcctttctccgcttaatgtcatgcggcttgaagaagaatacggcggcagaattgaggatgtaaaggttgaacgtatattcttctcggaggataaacgtaccggaatcggtaccttcagcccgtctgatccgaaatcacaggatatcgccgacttgacggggagcattgatttttcgacgattgccgaatacggctcggaatcagatccgcgcgcttatcggtttgacggtgaattaaataaagcgaaccgcggaatgatggagtttcaggaaatgctgaaatgcgatgaaaaatttctgtggcaccttctgtcactcacgcaggaagggaatttcaaagccggacggtttgcgctcatctccgccgacgaattgattgttgcgcatacgaacgaaacggagtaccgctcgtttattgccaataagaaaaatgaagcccttcactccaggatcatcgtgatgcctgttccttataatttaaaggtgtcagaggaagaacggatttatgaaaaaatgatttctgaaagtgatgtttctgacgtacacatcgccccccatacattaaaagtggccgcgatgttttctattttgacccggctgaaggaaccgaaccgctctgatattgatctcgtcaaaaaaatgagactttatgacggagaaagcgttgaaggttacaattccgttgatctggaggatatgaagaaggaattccatgatgaaggaatgagcggaattgacccgcgctatgtcatcaaccgcatttcctcaacgattatcagaaaaaatatggaatccatcaattcgcttgacgtgctgcgttccttaaaagaaggactcgaccagcatccgtccatctccgccgaggacaaagagcggtatatgaattttatttccgccgccaggaaagagtacgatgacatcgccaaaaaggaagtgcagaaggcgttcgtctattcatatgaagaatccgcgaaaactcttatggacaattatttagataatgtggaagcgtactgcaataaaaataagcttcgcgatccgctgacgggtgaagaaatgaatcctgacgaaaaactgatgagatccattgaagagcagatcggcatttcagaaaacgcgaaaaaagcgttccgcgaagaaatcttaatccgcatatccgcctatgcaagaaaaggaaaacgctttgactataattcgcacgaaagactccgcgaagcgattcagaaaaagctgttcgcagacttaaaagatgtagtgaaaattacgacctccaccaaaacgccggatgaacagcagcttaaaaaggtcaatgaggtagtggcaaggttaatagatgaacacggctataattcgacaagcgctaatgaactgctgaagtatgtcggaagcttgttaaaccgctgatatttgatttcatcgagaggcccgtctgtaaaaggacgggttcttttgtctgtttttcgcaattgtttgtcaattggagagtccggccggcataagataaaaataaatcttttcgccggacttgtttcataaacaggaccaagccggaatacacatgtaaaacgaccataacggttaaggaggggaattcatgtcccgtaatgacagcggaaattttttgatttcagaggaagactggtccctccatcgcaaaggctttgacgaccagcagcgccaccaaaagaaagtgcaggaagcgataaaaaacaaccttccggatcttgtcactgaggaaagcattattatgtccaacggaaaagatgtcgtgaaaatcccgattcgttcgcttgatgaatataaaatccgttataactatgataaaaataaacatgtcggccaaggcgacggcgacagcgaagtcggcgatgtcgtcgcaagagacggcgcagataaaaagcagggcgccggaaaaggccagggagcaggcgatcaggcaggcgaggattattatgaagcggaagtttcattgatggatctggaagaagcgctgtttcaggaattagaactgccgaatctgcagcaaaaggaaagggacaatatcgtccataccgatatcgagttcaatgatatccggaaaaccgggctgacagggaatatcgataagaaaaggacgatgctgtcggcctataaacgaaacgctatgacaggcaagccgtcgttttaccctatttatccggaagatctgaaatacaaaacatggaatgatgtgacgaagccggaatcgaaagctgtcgttttagccatgatggatacaagcggttcgatgggcgtatgggaaaagtatatggcgaggagcttctttttttggatgacacgatttttacggacaaagtatgaaacggttgatatcgaatttatcgcccaccatacggaagcgaaggttgtgtcggaagaagattttttctcgaaaggcgagagcgggggcaccatctgttcctccgtttaccggaagtctcttgaattaattgatgaaaaatatgaccccgcccgctacaacatctatccgtttcatttttcagacggagataatctgacttcggataacgcccggtgcgtaaagctcgtcaatgacatcatgaaaaaatcgaatctgttctgttacggtgaggtcaatcaatataacaggcattccacccttatgtccgcctataaaaatgtcaaagatgataaatttaaatactacatcctgaaacagaaatcggacgtatttcaagcgctgaaaagcttttttaaaaatgaggaagccgatgtaagcaaagcatcgtattaaatataaagccgagtgaagaatcgtgcggcgcggttctttacccggcttttttaaattaaaaataaagagaaaaaccggcataaaaaaaatccttaaaaaatgaaacttttctctttacaaaccttctttcatttattaatattttatcttgtgaactattattaagggaatgaggtgaaaatacggtgattgaatcagagctcgctttgctcagttttgaacaactgtttgatacttccagatcgatttacaaaaagcagaaaatgattctggagacagtgcttgaaccttttgatattacagtgctgcagtatctgctgatgttcaaaatacataagagcaaaagcacgcagctttcaaggctggctttgtcgcttgatctgaaaccggcgtctgtcacgagaatgaccgatattctgtataagcgccgcctaatggttcggagcgactatcacgacgaccggcgtgttgttatgattcagttaaccgaagagggggaagaacttctaaagaaagctgctgttcaatatgccgaaaaagcggcggtcttataccggcagctcaataccgctgaactgcagtacctgcgcaagcttgcggaaagtttaacgaagcttgcaaacggctgtgcagtgaaaaacggaaaataaaaaaatccccacatatttttatcatcattccacaaaatgatagaggaagaaacgaaaggagaaaacaaaatgaacagaggacgtttaattctgaccaacattatcggtttgattgttgttcttgcaattataggcggaggtgcttactactattatcaaagcacacactatgtaaaaaccgatgaagcgaaagttgccggcgacatggctgctatcacagctcctgctgcgggtaaagtaactgactggaaccttgatgaggggaaagaagtaagcaaaaacgacgttgttgcaaaaattaaaggacagcaaaatgctgacgtaaaagccatcatggatggaacaatcgtgaaaaacgaagtgaaaaacggccaaatggtgcaagccggtacgacaattgcccaggaaattgacatgaaacacctttacatcactgcaaacattaaagaaacagacattagagacattgaagtaggaaacaaagtagacgtaattgttgacggcgatcctaatacaacatttgacggaacagtagaagaaatcggttatgcgacaaattcaacatttgatatgctgccttcttcaaactcaagcggcaactacactaaagtaacgcaaaaagttcctgttaaaatttcactcagcaacccatctgacaaggtgcttcctggtatgaacgcatctgtaaaaatctctgaataatacagatcagtcatcaaaccatgaagggaggttgtcttaggtggctaaatcagataatcaagtaaaaagtcctaaaacattgcttattgtgcttatggccggattattcctggcgatcttgaaccaaacgcttcttaacgtggcgatgccgcacttaatgaccgagttcggtgtgagtgcgacgacgattcagtggcttacgaccggatacatgctggtcaacggtgttttgattccgttatctgcgttcttaattacccggttcggacagagaagcctctttctcgtagccatgttctgttttacagcgggaacgttagtctgcggaatcgcgcctaacttctcaaccatgctgatcggccggttaattcaggcggtcggcggcggtatcctgcagccgctggtcatgacaaccattctgcttatcttcccgcctgaaagcagggggaaaggaatggggattttcggtcttgcgatgatgtttgctccggcggtcggaccgactctatccggctggatcatcgagcattacacatggcgcattatgttctacggccttgttccgatcggggcaatcgttattatcatagcgtttttcctctttaagaacttggtggaaccgcaaaaaatcaaactcgacagcttgggtgcgattctatctattgtcggattcgcctcattgctttacggagtcagtgaagcgggcagcgacggctggggagatccgatcgtgctgtctaccgtcattgtcggtgtcatcgcgattgccgcgtttgtcattcagcaattgcgctctgaaaaaccgatgctcgacttccgggtatttaaatatgatattttctcactttccagtgtcattaatatcattattaccgttgcgctttacacaggaatgttcctgcttccgatttacctgcagaacttagtcggctttacggcgctgcaatcgggtctcttgctattgccgggcgcgattgtcatgctgatcatgtcgccgatttccggtattctgtttgacaaaatcggtccgagaccgcttgcgattatcgggctggtcatcacggtcgcaacgacattccagtacacaaaattgacaattgacacaccttacacgcacattatgcttgtctatgccatccgcgcattcggtatgtcactgttaatgatgcctgttatgacagccggaatgaaccagcttccggcacggttgaacagccacggcacggcgatgagcaacacgctccgccagatcagcggatcaatcggaacaagtttgatcacaacgatttatacgaaccgtacgacaatgcattattcgcagattgcggataaaacaagcacggctgatccaagcttcatgcagtcgttccaaagcgcggtttctaatttaatggtcaacatgaacatgtcgcttgatgcggcgaaacaaaccgtttattcatatctctacaaaacagcttcacttaattccaacgttatggggattaatgacgcgtttatgtgggcgacgatctttgcggttatcggcgtagtcctgagcctgttcttgcgtgacgtacggaaagacaaacagcgggcgaagaaaaaagaggagctgtcattgcttccggcccctaaagaagtgaaggaatcttaatcatctgaatgggaggtttcctgaatgaaaatttacgtagtgtacgatagtgaaggcgaacacacaaaacaccttgctgaagccattgccgaaggagcacgagaaaacgctgaggctgaagtcctgatcgaccatgtcgatcaagcagacatccgcaagctgaaagacatggatgccattatctggggatgcccgggacactttggcaccatcagttcaggcttaaaagcgtggatcgacagactcggctatctgtgggctgaaggcgagctgattgataaagtcggcgctgtattctgtacgacggcgacaacacacggcggattagaaatgacaatgcacaatctgatcactcctatgtttcaccaaggcatgattgttgtcggtcttcccggcaacgttcctgaaaacgcgctgtacggctcttactacggcgcaggcgtcacatgcccggttgacagcgatgtgctgatgacggaagaaggccttcaattaggccgtgcgcttggcagacgtgtcagccaggtcactggtaatctaactgccggacgacagtaaggagagggttatatggccattattatagcggttattgctgctgtcattgtgattgcacttcttatcacattcaatgtccgcagcacttctgcaggacaggatgtcaaagaagaaaagagagaagcgatcggcactacagccgaacagccggaaaagcatgatccggccgaggagcgctcagccgagcatgctcccgtcgttgtaaaatctgaatctccccgtgagaaaaagaatacaatgggcgatgatgtgtaccgtcaggcgcttcagaagtttaagacttctgagacggatcaggaaccaaacgatcctgatagcggcggcaaaatgcaggatagcagctatcgtgatgcgctgctctccttaaaaaacaaaaagaagtaattgaaaaggcaaatccgcgtaagagcggatttgtcttttttttattgaagatattgtaatacatgatgatctagtgtactatgttactcatacacttgatccgaatggagagagaaagaatgacatcgtttttaggtttgctgaaaaaagatgcgaaagtttcatggatttggctcgcggtgtggctttgcggcatgatttgctgggcgtttgcagcccacatcatcgctgcccgtcagaaagaaccgctcgtcattttcggcttttttacggcaatggggttttttcaatttcttgtagcgccgctttttatgtactatcaccttcataaagaaggaaaaaatcagctgtggctttacaatccgaatgggggattttatctgctggcttccaaactgacggcctcactgctgtatcagttgatcgggcagctggcgctgaccggttacggcatttggatgtaccggatgctttctgcaaaaggagtgctggaacacaccattcccctggccggcacattaaccgggctgaatgcttacctgctgatcagttcagcgtacttatctgtgatcgtggccgtattttggactgtttttcactcattaaaacattttcccgtcctccgttgggtgatctgcatcgtgcttgcgtttgtctggacctatattgacgataaaatcattacgcctttcacttcatctcaacatgatttatggccggtaaaagtgtatgcgaattttcattttcattatacaaaattgaccggatggacgatggagctgaaagccgtccacatttcgcttttcagcttcctggcagtgatcgtgcttgcagcgctctgtctcgcgctggcctctatgctgctgaatcgaaaggttgaggtgtaatgatggagaatgaatttcggtcatccaagccgatttatctgcagattgccgatcgtatatattaccggctgatcagaagtgagctttcaccgggggacaaactgccgtccgtaagggagatggccgtacagatgaaagtgaatccgaacacgatacaaagaacgtacagtgaaatggaaaggctggggatcgtggagacgagaagaggacagggaacctttatagcggaaagatccgatctgaaagcagagctgaaagacaggctgacaaaagacgttttcaaacgctttattcaggaaatggcggagctggggttatctcctgaggaaatgctcgacgggatcaaacaatatgcggaggaagcaaacgatgaatcttgattttgaacgcgtaacaaaaaaatacggccgcaggatcgcggtcagcgatgtatcattttcattgtctccgggtaaaatctacggaattttagggccgaacggaagcggtaaatcaacaacgcttaaaatgcttgccgggcttgcgttcccgacatcgggcgccgtccggatgggagactgcgcagtaagcaggaacatgctgtttcgtacggcttatttaaccgaacatgatatgttttccgcccggacgactgtcggtgatatgctcacattttatcattcgcaattcccggattttcagctggaaaaagcacataacctattagcggaaatgaatctttcagcggagcagaagataaaagagctgtccaaaggcagccggggcaggctgaaaatcgttttggccctgtcgagaaaagcatcggtcattctgctggatgagccgttttcaggtcttgatccggcggtcagggagtcgattgtcaacagtctcgtatcttatattgattttgacagccagatcgttgtcatcgccacgcatgagatcggcgagattgagacgctgttagacgaagtgatggttttcataaaagggaaaatcgctgaacggcgcgaggtcgaagaaattcgggaacaggaaggaatgtccgtgctgcaatggtatagaagcgtcatgcaggcgcacgaaatagaagggggattctaattggaaacggtattagaactgcaacaggtaaagaaaacgataaaaggacgaacgattattcatgatctgagcttctccgtccgggcgggcgaagtgtttggatttttagggccgaacggagcggggaaaaccactacgatcagaatgatggtcggattaatgaaactgtctcagggagacatcgtaatctgcggggaatccattacgaaaaactattcaaaagcggtcaggcacgtcggagccatcgtggaaaacccggagctgtacaaattcttgagcggctataaaaatttacagcagtacgcaaggatggtaaaaggcgttacgaaagaaaaaatagatgaggtcatcgagctcgtcgggttgcaggacagaatacatgacaaagtaaaaacctactctctcgggatgagacagcgtctcggcctcgcccaaagcctgctgcataatcctaaggtgctgattctggatgagccgacaaacggcctcgatcctgccggcatcagagaaatcagggaccatctgaaaaagctgacacgtgaaaaaggaatggctgtcatcgtctcaagccatcttctgtcagaaatggagctaatgtgcgatcgaatcggcattctgcaaaaaggagagcttgtcgatattcaaaaagtaagggatgaaggaaaagaggataaagatacatactacttccatattgaacaaagagaagaggctcttgccgttttgagtcagtttgactgtgtgaagaagacaaacggcattgagatccagctgtccaaacaggaagtgcctgatgtgatatcactgctcgtccgtgaaaacatccgcttatatgaagtgaaaatcatgacaaaatctttggaagaccgtttcttggagattaccggcgggacgaaagaggaggttcaatatgtttaagctgatctataatgaatggataaaaattttcagccgcgtcgggacgtgggctatgattgtgattttaggcgtttcgatgatcggttttgcgcttttgtcaaaccatttcacctcgagtgaagccaatccgaattggaaacaggagctccaggccgaaaacaaagaaatgaaacagcagatgaaggaaaccggaaatcagacgctcattgataacctgaaacagaatgtcgcgataaatcaataccgtatggatcataacatccccgaggatacagggtacacagtgtggtcatacgtagctgattcttcgatgatgactgttttgaccgggctgtttacgattatcattgccgcaggcatcgtggcgaatgagttcaactgggggacgatcaagctgctggccatccgtccgctcagccgttttcagattttgctatctaaatatatgacggtgctgctgttcggactgctgatgcttgtgattttatttgccggctccgctctgttgggattggtcttttttggtacaggcggagatactgcggctgatgttcatctcgtatacaaagacggccatgtttttgagcaaaatatcatcgctttcctcgctaaaacatatgtctatgaatctgtctccgcttttatgcttgcgacgatggcgtttatgctgtctgcggtattccggaacagctcattagcggtcggattttctatttttctattggttatggggaacacggcgacggtatttcttgctgcgaaatttgaatggaccaaatatattttatttgcgaacacagatttgtcgcaatatatgaacgggactcctttagtagaggggatgacgatgacattttctgttgtgatgcttgtgatttacttcgttatttttctggcgctcgcattcggcgtcttcttaaaacgggatattgccacctgatataaaaaagctgttttgcctttgcaaaacagcttttcgttttagatgaaaaaaacctgccggcgtacaccggcaggttttttaaaacaatttatgcttttgttacgttagcagcttgtggtccgcggtttccttcaacgatttcgaaagaaacagattggccttcttctaaagttttgaagccttcgccttgaatagcagagaagtgaacgaatacatcgtcttgaccttctacttcgatgaatccgaatcctttttcagagttgaaccattttactttaccttctaacatgaaatttcctcctaaagcgacataacgcttaaattcactattcttgctctaaaacaaacttccaagacgaaaactcttacaaaactttcttcttaaagatagttcgaacaaaaataattacctttactctaccagcaatccgaagaaaaaacaactgctaaatgtaacttttttcgaaataacatgttttaagaggaaaatgctctgatacggaaatctgatttgagaccagaacggcccattttcagctgataaaaaccgcattgcagcctcttaaggaagcaattgacaaccctttttttaatcggtattgtatgtaatcatgagcccgaataccatggtgcagcttctgtacataaaaatagatagggagtaggtcaacttgaacctgcggcttataaacagtctgtttcttttcattttgatcatgtcacttacttcatgccattatcctgatgggaaccggaccattactatcggaatcaatgaatctgatcaatcgatctgggagtttgtcgcgaaaaaagccggtgaggaaggattgcggctttctttggtaacgttttcggattatgccgaggccgatttggcacttgccggcggggatctcgacgccaatgcgtttcaatccgttactaattttaaatctttgcagcctcatgtgaaaaagaagctggctcctttaggaacgacatatgcggcatcgctgggggtgtattccaagcagcataaacggctgaaggatataccggacggagcggtcattgccgtgcctgatgaagcggcggccttcggcagggcgctttttctcatgcaggaggccggactgattacattgaaaaagggattcaccggtacgggttcaacggatatgatcaaggacaacccgaagcatctgaccttaaaaacggaaacaaaaaagaacgcctatcaggcggcggaacatgctgacgcagcagttctcagtcaaagcgaggcgaaaaaagcaggatttcatgcggagaaggacgcgctgatccgatcggcgcaaatgaaggaagcgtatattcatctgatcgccgtcagagctgaggataaagatgatgaacggctgcaaaaactcctgtctttgtatcaatcagacgataccgcggcgttgattgaaaaagaatatgagggcagcctgattcccgttttcctgaggggcggctttctcactgaaaagaaagaatgatttcctcttcgggcgatcattcttttttttcagtgctgcacacttgattgcgccctgatgttttcgctttgtacagcatccggtccgcgatcaggggcaatgtctgaggatccggtgtatttgtcggataatgcgcgatgccgagggaaacggtcacgggaattgtatctccgctcgtcagcagaatcgggttcgcgtcaatcgtgtgcctgatttcctctgcgaggtgaagcccttttgtataggtgcaattgggcataagcacggcaaattcttccccgccgatgcgggctgacgtatgagaactgctgagtaagaacctcaggcgcgcgcccagttccttcagcacttggtccccttcataatggccgtattgatcattgatctgcttaaagtgatcaatatccaaataaataagcgcgagctgagacgagggggattgagacgcccgatcgtacagaacgcgcgagacgtcctcgaattttctcttattaaaaatccccgtcagaaaatcataattcgcttgaaacttgtattgcttgaacaaaacgcgggcatcggcttcgtgtttgatgatatacagtgacagcattccgcccaagacggaaatgagccaataataaacgagggccccggcaggctgttcaggcataagaaacagcagcgtcagggtgaaaataacatttgaaaaaagcagcataacgaacgcctttttgtgatccggcttttttcctctgaggacggccgcagaaagtatcgcaataaccccgactgcggcgatggaaaaaatggcgctggcattgaaattgatcaggatacggcctgcgacgataatcgcaaaggcggctgccgtagacacccagcctccgtaaagagcggcgatgataatggggatatttctgagatcaatgatggaatcggagtaagaaaagccgaaaacaatcagaaaaacccctaaaagcccgcagaccgttcccttcagtaattgaaacatcggacggtcttctttatacgaaagcgactctttaaaaagaagggtgaacagataattaaatgtgattaaaatcgttaaattaagaaacagttccttcagcataacaatcacccttatataagttactagagaaagggtggaaagaaaagagaaaaatcaataaaaatacatatattgtcaatccttacttgaccgatcggaattgatataatatagtgttaaaggataatgagcaagggagtgtttacctgttttggagaatttatttgtagtcttacatgtttttattatgcttttgcttatagcaggtctgtttgtcatgcaaaaaaaacacgtttccttttctaaacgtgtctttaccgcgctcggactaggcattgtattcggttttgcactgcaattgatttacgggccggcatcacatatcgtgacacaaacggccgattggtttaatatcgccggcggcggttatgtcaaattgcttcagatgatcgtcatgccgctagtctttatttctattctcggcgcatttacgaagctgaaactgacccataacatcgggaaaatcagcggactgatcatcggaattttgatcgccacgacagcaattgccgcggcagtcggaattgtttcggcgctttcttttgatctgaaagccgtccatatcgaccagggaagcaccgagttatcaagaggccaggagctgcagcaaaaatctgaggatatgacggccaaaacgctgcctcagcaaatcgttgagcttctgccgggaaatccgtttcttgatttcacgggagccagaccgacttccaccatcggagtcgttattttcgccgctttcctcggcatcgcttttctgggcgtgaaacggaagcagccggagcacgctgcgacgttcagcggaattgtcgatgcggtatacgcgattattatgcgcgtcgtgacgttaattttaagattgacgccttacggggtattggcgattatgacaaagacgatcgcgacaagcgacatcgacagcattgcgaaactggggatgtttgtgatcgcttcatacgccgcgcttatcgtcatgtttatcattcacctgctgctgattacgttcagcggtttaaatccgatcacatacgtgaaaaaagcatttcctgtcatggtgtttgcgtttacgtcccgttcaagcgcaggggctttgccgcttaatattaaaacgcaaaaaagtatgggcgtccctgaaggaattgcgaacttcgccggttcattcggtttatcgatcggtcaaaacggctgtgccggcatttacccggcgatgctcgcgatgatgattgcgccgacagtagggcaaaacccgtttgaaccgggatttatcatctccgtcatcgccatcgtggcaatcagttcattcggtgtagcaggcgtggggggcggcgcgacatttgcggctctgctcgtcctatccgctttgaacatgcctgtcgcgcttgccgggctgctcatttcaattgagccgttaattgacatggggcgtaccgccttaaatgtcagcggcagtatgaccgcagggctgttaacaagtaaaatgacgaaggaaaccgataccgcggtttacaatgattcctcaatcgtcattgaagctgaagaagcttaataaaaaagcagatagcgctaaaacgaaaaatccttcatcgttgaactaatgaaggattttttcgtttctaatgatttccgggttcaatttcttccagcatattcatcacggtgctgtcatttaaaacatttaccgcgctttcttcgaagtgaatcggctcggtatagtgaggcttcggcgaagtttttttactgcggtctgcctgtccgtccgtatgggatgagccggagtggttgcgggaagtctgctcatgctgctgtccgccggattccccgccgaaagcctgtttgatcagctcggcaggctgcatggagccggtttgtgaatgccgtgctttgtccgtgtgctgctgtccgccggattccccgccgaaagcctgtttgatcagctcagcaggctgcatggagccggtttgtgaatgccgtgctttgtccgtgtgctgctgtccgccggattccccgctgaaagcctgttgaatcaggtcagcaggctgcatggagtgtgtaccatctttatgctgcattcggcctgaaaccattccggagattttccggcggatttcgggtgataaagctgcgatcagaatcgatgatccgatcagcagcgctgtcgggctgatgccgcttttttgtctgaacaagttaaatccctcctcattcaattgattacgcttacctttccctttccttctgatatttatccaaaccgctcagaatgcaaacggcgtgcataaatcccgccgaatagaaaaacctatacgtaaagtgagaaaggaggaattcacatgataaaaaaacaagcagttatttctgcccttcttctgccgatgctgattaccgcagggtgcagtatggggaaccagggagaaggaaaacgaaatgacaaccgcacccagaatgtaaattaccgcaacacgcctaacgacggtgcgacaaatatgaatacagtgaaccgtcataaccaaaacaccgatcacaatgacaaccgtaacctgagagtggctgataaagccgccgacaaggtgactgatttaaaagaagttaaaaatgcgactgtgatcgttgccggaaacagcgcttatgtagccgttgttctgacaaacggacaaaaaggcgccatcgccaaccatttgaaaaataagattaccgataaggtgaaatcagccgataaacatgtccggactgtatatgtatcagcgaacccggacttcgttgaacgtatgcaaggctacggaaaacgaatccaaaacggccatccggtatccggactgtttgatgaattcggccaaatggtgcagcgtgtattcccaaaccccaataaataaatgaatggaaaagccgcatttgctgcggcttttttattttatctgccgtcacgacccagcgctcctgagcataaagtaaagaatgagatgaaaattaaaggatcggggaggggagcttgtttgcgtgacggcatggggaaacgggcggcattcactctgatcctgtgcggagtccttgtcatattggctgtcagttcagccgtttcagtaagtatgatgtacgtcctgtcaggccaaaacagccgctctgttccgacgaaggaacaagtgactgaacacatgaataaagaaatttacaaacatacagcgatttactatacggcggatgaaaagccgctcttggatctgaccaagcttacgctggaccacgcaaagcgtatcaaccaaatcattgtcggctataaaggagcggcgcctcttgaactcattttcttttcggatgaagctgaaatggagcaatactcaggattgaaaaatgtagtcggtttttattcagagcaggagcagatgatggggcttttgcctgaagagaaaaaacagcttttgaaaaaagatgagctggccgttttcatgtataagcaattgattatacatgaatatacacactacgcgtttcatcaaaaaacgcggcaattggggacggatacgtctgtatttccgctttggtttcatgaggggctgagcgagtgggttgcgcattatgatgtggtcattgatccgattgcattttccgtcgtgccgtttgatcaattaacgaccgaccgaaaatggcagaaatcgcgtatggaatatgaaacggatgtctatttgcaaagtttctatatgataaaggatttaaccgaaacattcggagaaggcattatcttaaccattatcaataaaaccgccgaaacacaggattttgaaaaaggctttgaagcggctacgaaagaaagtctgaaacaatttgaacatgatttcacaaaagcatatgaaaaaaagaaaacggcattggagagtcaggtttccaacgccgtttttttcattaatggaggttttgctgctgctgtcccatttgtcctttaatcggaggcatttgcggctgtccctgcgccggcgcaaatgaattcagcatggtctgcatatcttgtgcattgagctgaggaacctgataataaccgtgtttgttttggtataaaaagatttcatacgccatttcgacatattgctgaatttgggcggagagcactcttcttgtgacgggattggtcatttcaagcgagctcatcgtcaagagagaagcttgagctttaatcaggccgagcatatggccgcttattccgagatctttgacatcatttaatgattgattcggttttttcggctgagtcggttttataccgtagacggcctggttctgttcctccatcatatatgtcgacgtttcctgagaaggtttttggccggtcttaaagcattctgccgtcagattatagagtccgagaatgaattgatactggcggtcaagaatgtcggccagctgctgatcctgaataaactgtctgagcatcataaattgatccaaaacgccgactgttccggccagcacttcatgcatatcgaaaagctcatgtcctccgtgattcacttgcggtgaacccggaatcccctgatttactggcggctgctgctgattctgctgctgttccactggttgttttcctccttcatgtcaaatcacatttaagatgtgaaaaaagccgatccgttatacatcaagacatatttcgttacatggggattatttactattttgcgccagcgaagacaatctttacaaaaaagtgatgtgattcttaagaaaataagctaacgtatttcttagaagacaagggggaaatgaatgaagaaaaaaaggggtttgcgtctttcgtgctgtttgctgacggtttgttttatgatgttcagcgtgaaagatgcggaagcaatcgggcaagccggatcactgaatgaagctggaacggataaagcgtataaagaacggcagactgaagactccggccgtatcccgctcagaatcatcagcatgaatgatctgcacggaaaaattgatcagcaatatgagcttgaccttaacggagacggtaaaccggatggcactttcggacggatggactacgccgccgcgtacattaaaaaggcgaaagccgagaaagaacacgcctttgtcgtgcatgcgggcgatatgatcgggggcagctctcccgtgtcagccctttttcaggatgaaccgacagtagaactgatggaagacatcggttttgatgtcggaactgtcggcaatcacgaattcgatgaaggaacgaatgagcttaaacggatcatcaatggaggagatcatccggacggtaaggggacaagcggttatgacggccaagatttcccgctcgtctgcgccaactgtaaattgaagtcaggggagtcctttctgccgccgtatgaaatcaaatacgtttccggaattccggtcgcatttatcggggttgtaaccagatcggccgcgggcatggtcattccggacggaattaaaaatattacgtttacggatgaggtaaaggccgtcaatgacgccgccgctgacctgaagaaaaaaggaattaaagcaatcgccgtgctcgcccatatgtctgctgaacaaaatggctcagccatcacgggagaatccgcaaagcttgcaagcggaacagactcagagattgacgtgattttcgccgcgcacaatcataaagtcgtaaacggagaaatcaacggcaagctgatcgtgcaggcatttgaatacggaaaagcaatcggaatcgccgatctcgaactagataaagaatcgaaggatatcgtgaaaaaatcagcggaaatccaatatatcgatcaaagtaaaatcaagcctgatccggatgcggcaggcatattaagcaaatatgaagagaaagtgaaaccgattatcagcgaaacggtcggggaagcggcccgtgatataacgggcgggtattcaaatgacggcgacacggcgctcggaaatctgattgccgacggtatgaaagcgaagatgaaatccgattttgcgcttatgaatgggggaggcatccgggacggcataaaaaaagggacgatcacatggggagacctatataatgtacagccgttcggcaatgtgctgacgaagcttgaaatcaaaggaaaagatttgcgggagatcatcaacgcgcaaatatctccggtgtacggaccggattacagcatcagcggattttcctatacatggaacccggaaaccggacaagcggtggatataaagatggcggacggcacagacatacagcccgaaaaaggatatacagtaacagtcaatcaatttatggcgacagcggcgggggcaaaatacggtccgatcgggaaactcggcaagaatccggtgacggggcctgaggatttggaagcgaccgtagactatgtcaaaagcttttccgcaccgatttcttatcaaaccgacggccgcatccgcacggcatcagccaccgaaacacctgatgacaccggcaatcagccgggaagcggggaaacaccgggcggcaccgggcctgataaaggagaaaaacctcaagcggaaaaacccgctaaaaaaccggatgcagcagaacagcctgatcaagccaaaaaacttgaacgtcctgtcgcagaagaaacagcatctgatacagtgcagtcaattcccgaatcccgtccggcgtctgctgcaaattcggaacaaagcacagaacagactgaaagcggcacacaaaaaggccgcccattgcctgatacttcagcgggcagccatcagacggcattggccggcctggtgatcacgggtgccggcgtatattggcttttcagaaagaaaaggggaacccgcacacgatgaacaaactgaaacatattccgcttctcgtcatcatcgcaggtgttatcatcacatgttacggaagctggaagatcattgattcacatatgaaaacgaaccaatcgcttgaagaagcaaaaaaagcaacagaacctgtcttggaaaagaacgaaacaaaaagcgctgtgctgacacagcgcaaaaaagaatttcaccccgaaacgggtgaggcaagcggcattttagaaatccctgaaattgacgctgagctcccgatcgtcgaagggactgacgcagatgatttagcaaaaggcgtcggacattataaggacagctattatcctggcgatcacggccaaattgtgttatccggccacagggacacggtgttccgccggaccggcgaactgaaaaaaggagacagactgaacgtgattttgtcttacggcacgttttcttataaaatcagccgcacaaaaatcgtcagccgggatgatacgtctgtcatcacccttcaacacaagcgggaggaactgatcctgaccacttgctatccgttttcttacattggaaatgcgccgaaacgatatattatatatgccgacccggtttaagaaaaatacgtttcggtaaaatgagccagatcagccggcatcggcgcctcggcaacgatttcttctcctgagatcggatggacgacactgacttttttggcgtgaagcgcctgcctgtgaaacagcgccctgcttccgccgtacaggtcatcgcccgccaacggatggccgatgcttgccatatgcaccctgatttgatgtgttctcccggtttccagttcaagctctgccaatgtaagctgcgcaccgggatgatagcctttcactttgtaatgggtgacggcggcttgtccgccgggtgatacgcgccgtctgacggaatgtgacctgtcgcggccgatcggcgagtcaaccgtgccttttttcggcgtgacttttccttccgccgcggcgatataggtgcgttttaatgttttggtttcgagctgacggtcaaggattgcatgggccaggcggtgtttcgcaaaaacgaccgcgcctgacgtgtcacggtcaagacggtgaacgtggcgcactttcgcctgttcgccgttgatttgaaaatggtaagcgatcaggttgctgagggttccggtctgaccctcttcatttggatgagtcggcattcccgccggcttatttgcaatcagcatatgactgtcctcaaataaaatgtccggctctccgtattcaggaatcaccgaagaacccgttttttcctgaagatcaatgaataagcggtctccggttttcagtatgatgttgtttttcggggatgtccgattcacctgaatgctttcttggttcatccattccgttatcacgggttttgacgcctggaattcagatttcaggactgaaaacagccattgtccggcgtgtttttccgtaatcaggagttccagaccgcggtcattttgtttcatatcataaagctccttttcaagcggaaagcggctgtttcaataggaaacacttaccttagctttcgcgtttttttctatgctattcttgataaagattaaggatattcacatggcaagaaaggtgattgatgtgagaattgtgaacgcagcgactgacggacaagaaagcgcgatacaagagctttcctctgaattgtttcaaaatgtctttcctctttatttctccgaactggaaattcagcgctttaaaaaaaggggcgtattgtctttacaaaaccaacgttaccaaggaactttaaaagaagcgtttcaaattatggcttgtctgcaaacggtacatatcatgctgtcaaagccgcaccccgtatatgacgtcaaagagcgggcgctgtttgataaaaattgcgctttgctgaatgaatgcggaatgaattttccctttacctatgatgatttcgagacaggggccggatcagaagcctgcggtcacagaaggctgatctgacgggtataaagagccttttgacaggctcttttttgcttccttgacatgataccacaatttctttcctctaactccctttataatgagtcaaatccccgagcataataaaatgcgaaaggggtgctttacaatgagttcaatcaaacaatcaatgactacccacgtggctaccgtttctcccaaccaaacgatccaggaagcggctgcgctgatgcaccagcataatgtcggagcaattcccgtcgttgacggaggggaattaaaaggaatgctgacagaccgtgatatcgcattgagaacaacggctcaaggccgcgacggccaaacacctgtttcacacgtgatgtcttctcaagttgtatccggaaacccggaaatgagtcttgaagaggcgtcacatctgatggcccaacaccaaatccgccgccttcccattgtcgatcaaaatcatctggtcgggatcgttgcgcttggagacttagcggtcgatcagcgttcaaatgagtctgcgggagcggctctttccaatatttccagtcaaaacacacagtaacggatgaagagagcttgcactcatgcaggctcttctttccgtgagaatgttacattttgaatgcaaaagaaattcacggtatagtgtatacataggtcagtacgtttagctaaaggagctgtaaccattgataaaagcattaatctttgattttgacgggttaattttagatacagaaacccatgaatatgaagtgctgcaggaaatgtttgaggaacacggttcaacattgcctttatccgtctggggaaaggttatcggaacggcggcgggatttaagccgttcgcatatttagaggagcagctgggaagaaagctcgatcatgatgaactgacggcgatcaggcgcgggcgcttcgaacagcggatgaagacggaaacggcgcgtcccggagtggaggcttatttagccgcggcaaaagaattaggattgaaggtggggctcgcttccagctcagattttaaatgggtgtcgggccatctgaaggaattaggcctgtttgatgaatttgaagtgattcagacggctgacgacgtagaagaagtgaagcccaatccggagctctatctgaaagctgcggaacatttaggcgttgaaccttctgaatgtcttgcctttgaggattcggtcaacggctcaatcgcagccaaacgcgccggcatgaaatgtgtcatcgtgccgaataaggtaacgagcgccctgttatttgaagaatacgatcacagactggaatcgatggcggaaatggaacttgaattactcttacagcgattgaacgatcaaaacgaaccggcagggggaagcagcattgtctgagaaacttgatctgacccgttttgaaaagaaaatggtcatacggaatatggaagagaaagatatcaacaaaattattgagctgcaaaaggattgttttccggggatggagccgtgggagcctgagcatttaatcagccatctcgcgcactttccggaaggtcagttttgcgccgagtatgaaggggaaattatcggttcatgctcaagcctgatcatcaatttcgatgaatatgatgaccgccacacgtggcaggacattacagacgacggttatatcacgaaccacaacccggacggattgaatctgtacgggattgaggtaatggttcacccggaatacaggcggatgaaaatcggacaccggctgtatgaggcgagaaaagacttggcgagacgattgaatctgaaaagcatcattatcggcgggcggattccgaattatcataagtatgcggaagaaatgacggcgagagcctatgtcgaacaggtgacgcgccatcagatttatgacccggtgctttctttccagctgatgaacggatttacgctcatgcggatcaatccgaattatctcccggatgacaccgcgtccattaaatatgcgacattaatggaatggaacaatgtcgattatctgccgcagtcaaagcgctattacaaatcggcatttccggtgcgcatctgcgtcattcaatatgagatgaaaaagatttattctttcgaggaatttgccaatcaggttgaatattatgtcgatgtggcttcagatgcgagatctgatttcgcggtattcccggagattttcacgacgcagcttatgtcatttctcgaagagcgttctccgagtctggccattcagaggattaccgaatataccgaggactatatcagcctctttacagatctcgcggtgaaatataatgtgaacattatcggcggctcccacttcgttgaagaagaggggaaaatttataacatcgcctacttattcagacgtgacggcacgattgaaaaacaatataagcttcacattacgccgaatgagcggaaatggtggggcatcagcgccggagacagggtgcgcgtatttgatacggactgcggaaagatcgccattcagatctgttacgatatcgaatttccggagcttgcgagaattgccgcggatcaaggggcgaaaattatctttacgccattctgcactgaagaccgccaaggctatttgcgcgtaaggtactgctctcaggcgagagcggttgaaaaccaaatttacaccgtcatctcaggtacggtcggaaacctgccgcaaacagaaaatatggatattcaatacgcgcagtcagccatttttgctccgtctgattttgaattcgccagagacggaatcgtcggtgaaacgaatccgaatatcgaaatggtcgtgatcggggatgtggaccttgaaatcttaagaaggcagcgtgaaaacggaaccgtgcgccagctgaaagaccggcgcaaagatatttaccggattacgcatctgaaatgaaaaaacgcccgctccgcttaaggggcgggtttttttatataaacacttgcgccggccccggtttcgggatatgctcttgtagccctttcgcttactgggagaaagcgtttttttaattgccgccgctttattgactcgcccatgccgcgcctttatattcttattaagaggaaaacttcaccatgagaatcggcgcagaagccgggcagctttcgatacagtgcaatgatattgaaagggagatgagcggtgtggaacatgtacaaaaaaatcagtcactcaaacaaaaggataaagagctgatttggcacgcgatgaaaggggcggagccggatgacagcataatcgtccaaaaaggggaaggcgcctgggttacggatattgacggcaggcggtatttggacggcatgtcaggactgtggtgcgtcaatatcggatacgggagaaaggagcttgccgatgcggcttacagccaattgaaggagcttccgtattatccgctgacccaaagccatcaacccgcgattgagcttgcggaaaaactgaatgaatggctcggcggcgattatgtaatcttcttttccaacagcggatcggaagcaaatgaaaccgcgttcaaaattgcccgccaataccatattgaaaacggcgatcacagccgcttcaaattcatctcccggtacagaggctatcacggcaatacgatgggggcgctcgccgctaccggccaggcgcagagaaaatataaatatgagccgctctcacaaggttttttgcacgcggcgccgcctgatctctatcggaatcccggcgatgccgtcacattggaaagcgcgcatgaaatcgaccggatcatgacgtgggagttaagcgaaacgattgccggcgttattatggaaccgattattacaggcggagggatactgatgcccccggacgggtatatggcaaaggtagaggacatttgccgccgccacggcgcgcttctgatcagtgatgaagtcatttgcggtttcggccgcacgggagagccgttcggatttcagcattacggcgtttcaccggacatcgtcacaatggcaaaaggcattacgagcgcttatctgccgctgtcggcaacggcagtaaaacgggagatttttgaggcgtattcaggcggtgagccgtacggccgcttccggcacgtgaatacattcggaggcaatccggcagcctgcgcccttgctttgaaaaacctgcaattgatggaggacgaaaatctgatcgcccgctcccgggagcttggagaacggctgctccgtgagcttgagccgctcagagaacatccggcggtcggtgatgtacggggcaaaggccttcttgccggcattgagctcgtcaaggacaaaatcacgaaggaacccgctgatgccgcccttgtacagcacgtcatcaccgcctgcagagaaaaaggcctgcttgtcgggaaaaatggtgatactgtagcgggatataataatgtcattcagctgtctccgcctttttgcctgtccgacgaggagctctctttcatcatttcgaccgtcaaggaaagcgtgctgagcattgatttttaatgtaaaggagtaaaacatgagttttcacaaccagaagattctaccggctatccggaacatgaagcaattcgatgcatttttagagagtccgttcttatacggcgtcattttagatatccacctcggtcaattaaaaggtgtcgtgaatgaagcgaaaaaacacggaaaacttctgatggttcacgtcgatttaattcacggcattaagcatgacgaatacggtgcggagtttatttgtcaggatatccggcccgcgggcatcatttcgacgagatccgccgtcatcgtcaaagcgaaacaaaagaaaatatacgcgatccagcgtctgtttctcttggatacgagcgccatggagaaaagcatggaattcgtcggaaagcataagcctgactttatcgaggttctcccgggcatcgttccgactttaatcagagaaattaaagaaatgacggggattccgatttttgccggcggctttatccgcacggagcaggacgttgaaaacgccttgcaggcaggagcaacggccgtgacgacttcagacaccgaactatgggctaaatatgaacattctatgacaaaaaaagattgacaccgcttacacccattgttacaatagacctaggttaatactatgtgatggagacccggagacccacaacagctctttacggaagcaataaagcgtaaagcggtttgttgtgggttttttattctctataactctgtcaaacctgctattttgtcatttaggaggaatgatgatgacagcattttggggagaagtaatcggtacaatgctgcttgttattttcggcggcggcgtttgtgcgggagtcaacttaaagaaatcgctttcataccaatccggatggattgttattgtattcggctggggattgggagtagccatggcggcatatgccgtcggcagcatcagcggcgctcacttgaatccggctttaacgataggccttgcgcttgaaggcagctttccttggaaagacgtccctgtttatattacgggacagatgatcggagcaatgatcggtgcggttgttgtgtaccttcattatctgccgcattggaaggcgacggatgatccggccgctaaactgggcgttttctcgaccggcccgagtattcctcatacatttgggaatatgataagtgaagtcattggtacgtttgtgcttgtgctcggcattttggcaatcggagcgaatgaatttacaaaagggctgaacccgctgattgtcggattcctcatcgttgccatcgggatttctcttggagggacgaccggatatgcgatcaaccctgcgcgggatctggggccgagaatcgctcacgcctttctgccgatcccgaaaaaagggccgtcaaattggaaatatgcctggattcccgtaatcggtccgatcatgggcggtgcgttcggcggcgtattttacaatgccgcgtttaaaggaaatgtgacacctagcttttggtttgtaagcgttataatggttgtagtgcttttcatactctatatttataccaagaaatctcaatcacagaaaacattatcaaattctgaatatatttaaaaaggagagcggcatcatggagacctatattttatcaattgaccaaggcacaacaagttcaagagcgattctttttaataaagaaggaaaaatcgtgcattccgctcaaaaggaattcacacagcatttccctcagccgggctgggtggagcacaatgcgaacgaaatctggggatcggtgctcgccgttatcgcgactgtgatttccgagtccggaatcagcgctgatcaaattgccggtatcggcatcacgaaccaaagggaaacgacggtcgtatgggataaagataccggaaagccggtatacaatgcgattgtgtggcaatcgagacaaacatccggcatttgcgaagagcttcgtgaaaaaggatataatgatacattcagagaaaaaacgggacttttgatcgacccttatttctcaggaacgaaagtcaaatggattcttgacaatgtagaaggcgcgcgggaaaaagcggaaaacggaaatcttctgttcggaacgattgattcatggctcatctggaaaatgtccggaggcgcggcgcacgtaacggattattcaaacgcttcaagaacgctgatgtttaatatccatgaattaaaatgggatgacgagcttcttgatattttaggcgtgccgaaatccatgctgccggaagtgaaaccgtcttctcatgtgtacgcgaaaacggttgattatcatttcttcggtaagaacattccgattgcgggagcggccggagaccagcagtctgcgctgttcggtcaggcgtgctttgaagaaggcatggggaaaaacacatacggcacaggctgctttatgctgatgaataccggagaaaaagccatcacttctgatcacggccttctgacgacaatcgcctggggattagacggaaaagtcgagtatgcattggaaggaagcatctttgtcgcaggttctgccatccaatggctgagagacggcatgcggatgttccaggattcgaaagaaagcgagacatacgcagagcgtgtggattccgctgacggtgtttatgtcgtgcccgctttcgtcggattgggcacaccgtactgggacagtgacgtgcgcggctcagttttcggcctgacacgcggaacgacgaaggagcattttatccgggccacgcttgaatctctcgcatatcaggcgaaagatgtgcttgatgccatggaggctgattcaggcatctctttaaaaacattgcgtgtagacggcggagcggtaaaaaataacttcctcatgcagttccagagcgacttgcttgatgtgccggtcgaacgtccggaaattaatgaaacgacggcgctcggtgccgcgtatttggccggaatcgctgtcggctattggaaggacagcactgaaatcgccgatcagtggaaccttgataagcaattcaaaccggaaatggaagatgaaaaacgcgatgaattgtacggcggatggaaaaaagcagtaaatgcagctatggcttttaaataagataaaattatggtatactgaaaacaagttaataggaacggtcctgagatgaggagagaccacagcaccaaagtgatgacatgcgctttggctgttgtggtctctttttctataccgtgacaacaaggaggaagcgtaatgatgaatcaccaattttcaagtttggaacgggatcatatgctggaagacatgactaaaaaaacatacgatctgtttattataggcggaggtattacgggtgccggtacggcgcttgacgctgcttcaaggggaatgaaagtcgctttgagcgaaatgcaggatttcgcggccggcacatcaagccgatccacaaagcttgtccacggcggtttgcgttatctgaagcaatttgaagtcaaaatggtggctgaagtcggtaaggaacgcgccatcgtgtacgaaaacggcccgcacgtcacgacgccggaatggatgctgctgccgtttcataaaggcggcacgttcggttcattctctacttccatcggcctgcgtgtgtatgactatttagcgggagtaaaaaaatcagagcgcagaagcatgctgtctgctaaagaaacgctgcaaaaagagccgctcgtcaaaaaagacggcttaaaaggcggaggctattatgtagagtaccggacggacgatgcgagactgacgattgaagtcatgaaagaagccgttaaattcggtgcggagcctgtcaactattctaaagtgaaagaactgctttatgaaaaaggaaaagttgtcggcgttttaattgaagatctgctgtcaggcaaggaatacaaagtgtacgccaaaaaaattgtcaatgcgacaggtccgtgggtcgacgagctgagagaaaaagaccacagcaaaagcggaaaacatctccagcacacaaaaggggtccatctcgtattcgaccaatccgtattcccgcttaaacaggcggtgtactttgatacgccggacggccggatggtgttcgccattccgcgtgaaggaaaaacatatgtgggtacgaccgatacggtttacaaacaaaaacttgagcacccgcgcatgacggtgcaggatcgcgattatgtcgtcagctccatcaattatatgttcccggaactgaacattacggcggacgatattgaatcaagctgggccggcctcagaccgcttattcacgaagaagggaaagacccgtctgagatctcccgtaaagatgaaatctggacatctcaatcaggcctgattacgatcgccggaggaaaactgacgggctaccgtaaaatggctgagcacattgtcgatcttgtccgcgaccgcttgaaagaagagggcggccaggacttcggcggctgcaagacgaagacgatgccgatttccggcggacatgtcggcggctctaaaaacttcgagtcatttgtggaagcaaagacaaaagacggcttgaaaatcggtttatcacaggaaaccgctaagcagttagccatcagatacggctctaacgttgaaaatgtattcagccggattgaaggcctgaaagatgaagcggaaaaacgccagattccggttcacattctggcggaagcggcttacagcatcgaagaagaaatggctgcgacacctgccgatttcttcgtccgcagaacgggaagactgttcttcgacatcaaatgggtgcaaacgtataaaacggccgtgattgattacatgagcgaccgattccaatggaatgacgaaacgaaagaaaaacacactgagtggttaaatacgctgctgcacgacgcggttgttccgctcgaacaataataaccggagggctgtgccgaaaaggcatgagcccttcttttatctttttacataaagcatttggttaagttatcaagtgacacgggcagccgcttcatattaaaatatggtcataagctgaaattataggaggacgaacatgagttggagtaagagttacgaacgctggaatcaggccgaacaattagattcagaattgaaaaaattattggcggacgcagaaggaaacgagcagctgctggaagattttttctacaaaaatcttgagttcggaacaggaggcatgagaggagaaatcgggccgggtacgaacagaatgaacatttacacggtccgcaaagcatccgccggacttgcggcgtatatcgcgaaacagggggaagacgcgaaaaaaagaggggttgcgatcgcatatgactcccgtcataaatctcctgagtttgcgatggaagctgcaaaaacccttgcttcccaaggcattcaaacatacgtatttgatgagctccgcccgacgcctgagctgtcttttgcggtgagaaagctgaacgcttatgccggcatcgtcgtgacggccagccataacccgcctgaatataacggatataaagtgtacggcgatgacggcgcacagctgccgccgaaagaagcggacatcgtcattgcggaagtgaatgccatagaaaatgaattaacgattcaagttgaagatgaacagtcgctgaaagaaaaaggtttgattaaaataatcggtgaagaaattgataaaccgtatactgaaaaactgacttccatctccgtacatcccgagctttcggatgaagtggatgtcagcgtcgtgttcactccgctgcacggcacggcaaataaaccggtgcgccgcggtcttgaagcactcggttacaaaaacgtcaccgtcgtaaaggagcaagagctgccggacccggatttttcaaccgtcaaatcgccgaatccggaagagcacgcggcattcgaatatgccattaagctcggagaagaacaaaatgccgatattctcgtcgctacggacccggatgccgaccgtctcggcattgccgtaaaaaacagcgaaggcaagtacacagtgctgacgggaaaccagacaggcgcgcttttattgcattacctgctttccgagaagaaaaaacagggcacccttcctgaaaacggtgtcgtcatgaaaacgattgtcacgagcgaattgggccgcgccgtcgcttcatcgttcggattagatacggttgacacgctgacaggcttcaaatttatcggtgaaaagatcaaagaatatgaaaaatcaggccaatacacgttccagttcgggtatgaagaaagctacggctacttaatcggcgatttcgcgcgtgacaaagacgcgatccaggctgcgctgttagccgtcgaggtatgcgccttttataaaaagcagggcatgtcgctttatgacgcgctgctgtccatttttaaagaatacggatattaccgtgaaggcttgaagtcattgacgttaaaaggaaaacagggagcagagcagatttccgctatcctgacttcattccgaaacgatccgccgaagcagatggccggaaaacaaatcacgcaggctgaagactattcaacgggaaaacggactgtatttgccgatcatcatgaagaagatattgatctgccgaagtcaaatgtcctgaaatatttccttgaagacggctcttggttctgccttcgtccatcaggaacggagccgaaagtgaagttctatttcgccgtgaagggaacttctttacaagacagcgaacagcgtcttgccgcattatctgaagccgtcatgaaaacggtggatgacatagtggaaaaaacgaaataaacaacaaaccgccggaagcgacatccggcggtttttttatacgcctcatccgaaagtatgaggaaaattcatgctgaaaacaaaggaatatacagaaaagaattgatataatatggataattctgattggccggagtgagggaaattgacgaaaacgacggtagaaacgttaaaaacgttaaaagcgattgcggaaaccttaaaccaaaaccacgatttaaaggaagcgcttgataaagtgctccgcgaactgctcagcctgaccggactgcagacagggtggatttttctgattgagccggacgggtcttatacgctcgccgcatccgcttatttaccgccggctctcggtcagcgggaaaatgcactcatgtgcagcggagaatgctattgtctgaccaaattcagcaatggcggattgacaaaggccgtaaacataatgaattgtaaacggattgaatttgcggaacagacgacgaactgccgcgatacggagggcattacccatcatgcgaccgtaccgcttgaggacggcggccggaagttcggtttattaaacgtcgccgcaagtgaaaagacatttttcaacgaagaagaactgcatctgcttgaagcggttgcatttcaaatcggaacggcgattcagcggatgaaattggccgaatttgagcagcagaacgccctgttgatggaaagaagcagacttgcgcaagagctgcatgattccgtcaatcagatgctgttttctgtcagcttaacggcaaaagccgcaaagagctttacagatgatgatcggctccggcagatgattacgtttattcaagagctgtctcaggatgcgctaacagaaatgagggcgctcatttggcagctgaagccggaaagtttaacgaaagggctgtatgcgtctatcaaaagctatgccgctcttatcggcctggaagccgtttgtgaaacggaggatgagctggagcttacggatgaacaggaacacgcgctttggcggatcgcccaggaagccttgaataactgtaaaaagcatgcgggaacggaccgggttatcatttccgccgttaaaaagccgggttgcgctgagcttcacattagcgaccgtggagcgggcttcagcgctgatgcgcatgctgtgctcccatcgctcggcgtggccggcatgaaagcgcgggctgaagcgatcggaggccgctttacactgcaatccgagcttggcgccggaacgattgtctccgttcggcttccgtttcgggacaggaggtctgattgatgaaaattgtgattgctgatgatcatcatgttgtccgcaaaggactgcgctatttcttcgccactcaggaagacattgaagttgtcggtgaggcgtccaccggtgctgaagcgcttcagcaagctgaaaagacggagccggacatcattctgatggatttatcaatgcctgatatggacggcatagaagcggcaaaaatcgcggctgaacgatttccggacatcagtatcgtcgttttgacgagctattctgatcaggagcacgtcattcccgcccttaaagccggcgcaaaagcgtatcagctgaaagacgctcagcccgatgatttagtgaaaacgctccgggaagtgtattccggacgttaccggctgtcggcggatattgtgcctcacgtgctgacccatatggttcaggatgatcaggataaggaaaaatattatcagctgaccccccgtgaaaaagatgttcttcaagaaatagccaaaggaaaaagcaataaggaaattgcggcggccctgtttatttcagaaaaaacagtgaagacccacgtgtccaacctgctgtcaaagctgaatctttccgaccggacgcaggcggcattgtatgcggtaaaatataatgtttttggaaaggcggtaaaatcatgagcatattagtgatcagcggcacaccgagaaaaaacgggcggactagaattgccgcttcttatatcagagatcggtttcataccgattttattgatttgagcgaaagtgaactgccgctttataacggtgaagaagaacagaacgagctgtcttcagtgcaaaagttaaggcggcaggtgaaaaagtcggcggccgtcgtcttattatctcccgagtatcacagcggcatgagcggcgctttaaaaaacgccatcgattttttaagcagcgatcactgggcatacaaaccggtggccatcattgccgcggcgggcggaggaaaaggaggcatgaacgcgctggcgaatatgcggacggtcatgcggggcgtctatgcaaatgtcatcccgaaacagctggtcttagacccgattcacatcgacatggagcgccggaccgtatctgaggatatggcggtcagcctgaaagacatgatcgaagagctgaatatgttcacaaacacaagaaatcccggcgtctgacgccgggattgttttatgtcagcatggctaattgatcttcataagcgagttctgtcgcatgatcaatatacccgagtagggaatacagctctttttcaagcaccgcatgatcgtattcgaaatgatacgcgtgcagaaagtgctcaatacgctttgataataaatcatcttttgtacgaaccatcaaaattaataaattgtcccattgagaccggtgtgtgtaatacaaggctttatcataatcggcatgatccatcttacgcttctcctttcaatgagaagttctccgttagtttatgccgccgaagcccggatgcaacgggggaaaacttggtgtccttatcattgcggcatagcaatatgagggagacataaaataaaaccgcatatccgtctcttctttggacacgctaagattgacaaaaaacgactcaggagaacataaagatgaaatcccttccatttgcgcttgccctcttgttttgcggcattctcattgcctctatcgctgaaaaagggcatacagaacacctcgatccgtcagttgaaaaatgggaacagctcgcatggaaccagcttgaacgtgaatacaagggggccgagcttaccgattattcgtacatgggccgtacaaaagtgaaccgggaacagacgaaagacgtgtttcgcgtaacggtgcaaaccgcaaaagaaacgttttcatcccgtgctgaagtgtatttccatcccgtaacaaaacacgtgatcagcatcaatattttcagactgtaaaaaagctgcacagccttatgcggccgtacagcttatcagatatcagaagaaacgttttgcgccgaggtagcgctgtttccaataggaattgttcatgctggaaataacgacacccgaatcgttggcattaataaactggccgttcccgagataaataccgacgtgggaaggtccggctttataagttgagaaaaagacaaagtcaccgaccgccggctggctgactgatgtcatcgtattccagtagcctgcggctgaaagtctggatacagaagtgaccttattgagaacgtaataaatgaaaccgctgcagtcaaagcctctcggcgtcgtcccgccccatacatacggtacgcccagctgagcttttgcggcatcgatcattacattaatcttcgcgcttgttgaacctgtgccgccggactgattcggtgtcgtgtttgtctgctgcccggtaatcgtcagcttctgtccgatttgtagaacgtctgttttcagattgtttttctcgcggatctgctgggcggttacattgaacttttgggcgatcacccataaagaatccccgcttttcacggtatatgtagtggttttccctgtatttccggactggttcggagctgacggtgaagacgaagagccggaagaagacgttttggtcagcttcagcacttgtccgacccgcagcatgtctgacgtcagtttgttgatgcttctgatttgctgaaccgtcatattgtatgcgtttgcgattttccagagtgagtctccgctttttactgtataggaggacgtttgcgtctggtttttattttggtttgaattgtcttttgacggcgtgtttcccgaagaagacgttccttttgttttcaggacttggtttacgtagatcgtatccgtttttaagttgtttaatactttgagttccgcaatggtcatattgacgctgtttgcgatcttccatagggaatcgccgagttttactttataggtcccggaagatgatgactgatttttgctgctgtttgagctgctgcccggcgcggtttttttctgatcggtgcttgaggaaactttccccgtcacttgcagcttctgtccggcgcggattaagtcgcttgtcagaccgttcaattttttcagttcctgtacggacattttaaaatcagatgcgatcagccacagcgaatcgccgtttttcactgtataaacgcttttagtcgtgccgctgttctttgaagatggctttttgctgccggaatctgatttgccgttagggatggtgagcgtctgcccgatagaaataacggtggattttagatgattcgctgatgtaatggcatccacgcttgtattgtagttttgggcaagcttccataatgaatctccgcttttaaccttaatcgtttgtgcttctgccggtgttacagctaacgcagacccgacgatcgcagatgcagtcaaaccgaccgctaccttttttttcatagtgaatctcccttttcctgcgataatttttctatccccattcgttgcagccgcaaggtgaggatatcagtaatgataatctttatatcggcacttgtctgcaatcgtttatcatattaatagaaatagtccttttttcttatgccggcataaaaaaaagaaggaatgcggacattccttcagcttctgagcagtctcataatctcctctttgtttttgaccagatcccttaacgtatatttgtctaaaacggccaggtaagcttgcagggcttcattcagaaggttctttaagttgcaggcgggagatatgatacagagattttttttggagtcaaagcattctacgatgttaaagtcgtcttctgtatttcgaacgacttctccaatgtttatgtcttccggtgtcattcctaatcgaattccgcctccccggccccggatcgtttcgacatacccgagctggccgagacggtaaatgactttcatgaggtggtttttagagatggaataagtatctgcgatttcttttatgttggaaagttcgtcggaatgtctggaagccaaaaaaatcaaaacgcgtaaagagtaatcggtatagttcgttaatttcatagaatgacctcgaaaaaagagattttgcttctgttacagtctatcatatatgaatctaaaatgaaaaaaaaggaatttgctcccttaacttttaaaaaaaaacgtgcgctccttctgagcacacgtttttttcgttaagacatcggcggcttacgatcgtcagccgattgatgtttttcaattttgcgatccaattttgcgagataacgggaggcaaattcttttccgccaagcccgaatgaaagtccgaaggcaagcgcgaaaccgcccagaatcagaataaacgcggcatttacgatcgtgtcggcgacaccgagctgatccagcgccataaagattgagagagtgataatggtatatttggcaagcggggccaggaatctgaattcctttccgctcagcatgccggcaagcagcctgctgacgagctgtccggccaaaagtccgattccgagaataaatacagcggccagaacattaggcaggtaagcgataataccggttgcgataacgacgagaaattcgagatgaacaagctgcagcgcctctgccgtaaagagcaggacgatgatgatctgaacaatcatgccgaccgtctgagaaagcgtcagcttcggggtgcccgcctgttcaaagcccattttaccgagaagagagtcgaaaccggcccggtgcaggagcccggatacaatgctgttgacccattttccgacccagatgccggcgatgatcagcacaataccgatgatgatattaggtagcattgtgaagaccgtgtgcagcatggctgacgccggttcagaaatacccgccacatcaagccggtcaagcgcagagatgatcaccggaatgaaaatcagcacgtagacaatcgttccgatgattgccgacaggctcgtatccttcagataaattgaaagccccatacgtgcggcgagcctttccgtgccgatactcgccagaaagtttgtgacgatatcacggacgagacgggcaacaagccagccgattaaaacaatcagcgccgcggcgaataatttcggtataaaggacaaaacgctttggatcatatttgtaaacggccctgatactccgctgatttggagagcggacaagacgccgggcaggaacaagagcaagacgaagtaaaaaacgattcgtgaagcggccgtaacggatctgctcatctccgcttcttcagacaccattgtccattttctgagccgggcgttttcagcgagtttcatgcccgcttttttgacgagatagctgaaaagcgaagcggccgcccagcccacgagcagaatcaagccggcttttaagacgctcggcacagccgccgttatcgccgacagcatgctgacaaaaggcgaagccacggttgtcagatgcagaatgttaaagaatagaataaaaacgatgattaatgcgataaaataaatgactttactgatgactttttctgaggaatagcgcgccggctttttttcggcgaagagcctgtcgtcgatttttgttttttgcaggcctttgtatacggctttttcaatgattttggcaatgccccagccgataagcaggacgagcagtgcaatgatcagattcgggagtttgttgagatacgtcgtaagcatgtctgctgtattcaagtagaatcgctccttttctttttggggtatggtgtgtgttttacccacttacatataaagcaaacggggcggatgtgccgaaagttttcagtcggaaaccggcctgttatttcatcttttgagaggaggggtcatacattataaataagtccaagtaggggggattcgcttgaacgcggaggagacaaaaggtttacagcgggcaattgaggaaataaccgacattgcgaagggtttcggccttgatttctacccgatgagatatgaaatttgcccggctgaaattatttatacattcggcgcgtacggcatgccgacgagattcagccactggagtttcggcaaacaatttcataagatgaaactccattatgatctcggtttgagcaaaatttatgaacttgtcattaattccaacccttgctacgcttttttgctggacagcaattcgctgatccaaaataaattaattgtagctcatgttcttgcccattgtgattttttcaaaaataactgccgctttcaaaatacgaaccgggacatggttgagagtatggcggctgcggcggagcggattaagcattatgaaagaattcatgggataaaagaggtggagtcctttttagatgccattctggcgattcaggagcatatcgatccgtcgcttgtcaggccgaagctgctgtggagcgtcgatgacgaagaggaggacgaagaagaaaccgcgccatcgccttacgatgatttatggggaatggataagccgaagcaggtgaaaaagaaaaaagggaaaaaaccgtttccgccccggccggaaaaagatattctgctgtttatcgaagaacattcgcgggagcttgaaccgtggcagcgtgacattttaaccatgatgagagaagaaatgctgtatttctggcctcagctggaaacgaaaatcatgaacgaaggctgggcatcctattggcatcagcggattatccgcgagcttgacctgacttcagatgaagccatcgaatttgcgaagctgaacgcaggcgtcgttcagccgtcaaaaacgggaatcaacccgtattatttagggctgaaaatttttgaagacatcgaagagcgttatgacaacccgacagatgaaatgaaaaaaacaggggtaaagcccggttccggccgcgagaaaatgtttgaggtcagggaaattgaatcggatatctcatttatccgcaattatttgacgaaagatctcgtcatgcgtgaggatttgtatttattccaaaagcagggcagggactataaagtgatcgacaaagaatggaaggccgtgcgcgaccagctcgtgaacatgcgggtcaacgggggatttccttatctgaccgtcaatgacggggattacctgaagaataatgagctttatattaaacattggtatgagggaattgagcttgatctgaaatacttggagaaagtgctgccgtatctgtaccagctgtggggcaggagcgtgcacatcgaatctgttcttgaagacagagaagtgatgttctcgtatgacggcaaaggagtgcaccggagatatctgtaaaagaagaaaggatgcggggaaacccccgcatccttttttattttccgtgtttcaggatgtgaaaaatctttttggcctggtccgtgttgtttaaaagccccgtaaatgactctcttcccggaccgtatgcgtaaacgggaacttcttcgcccgtatgatcgccggttgtccagccgctgttggttttcgcattaaaaagcttaatgatcgatttgtagacgctcttgtcagcatcctgttttgcggccgtttcgatctgtttaatttcagcttttgaccatttcaggtctgtataacgcgcaagcacggaagatacggatttgcccgctttgatttggtcagccataaatgccggggttttcttggcggcaagaatcggttcaacatgccagtttttatcgtcatttgcgccgatcgtcaatccgccggtggtatgatcagccgtggcaacgacaagcgtatgtttgtcctttttggcaaatgcgatcgctgctttatatgctttttcaaaatccttcatttcactcattgcgccgactatatcattgtcatgtcccgcccagtctatttggctgccttcgaccattaagaagaacccttttttattcttgttcagcctgtcgatcgccgccgttgtcatgtcttctaatgaagggacggcgtttgaccgatcgattgctttatcgagtccgccatcggcaaacaggccgagaatcttcttgttacgatcttttttcagctcctgttttgatgtcacatagctgtatcccgcttttttgaaatcctttgttacattgcggtctttacggataaagtttgatttgccgcctccgaggagcacatcgactttttgttttccgttgatgcggtcatcaaagtagctgcttgcgatgtcatccatattctttcgggatttgttatgggctccgaatgccgcaggggtggcgtgggcaatctccgaagttgcgacaagtccggtggatttccctctttgtttcgcttcttcgaggacggatttgacccgctttccttttttatcgactccgatcgccgcgttatacgttttcacgcccgtagccattgccgtgccagccgccgcggaatcggtaatattggaatcaggatcgtcaggataagtcatcatcataccggcgagattggggtcgaatgccgtcagtttcataccatccgaaggctttcctttgttaatgaccgaacggtaggcgttcatatagggagcgcccattccgtcgccgaccatgaagatgacgtttctgatctcgtttttgtcaggctgtttttttgccgcagcctgttcagagtgctgaaaccccgcgcccgcaatcagaccggctgtcagcacggatacggctgccgccggcagaagttttgatcgaacctgtttaaatagactcattctcactcgtcctcctttaatcgtgtctgcatgtctaatggtagggggtgtttgtaaagagcgcctgtttctcctgtaaatttcaggtgaaacattgttagaaatgtaaattccggtgtaacttatgttttcaagaaagggtgaaaaccattcacttttttgaaaaagacgaggatttttttaacaaggagttatttggaaagtaaacttctttgtttttccaaaatacgaggatcacaggaaaaaaacatgacaaattgactcgtttttcgtcacgtttgaaatcaaattgaaatatttaatacccttaaaaacttttttcaaaaacgaattagtaagaaatttgtcacgggaagtcaagtctatttctagtggaaattgaaccttataataggaaacagataaaaacattaaaaaagagacacataaaatagatagaatcattcagggaggaaaatatgaaaaagcaacttgttacagcaacaacggcagtggttttggggacgactttgtttgcgggcgcggcatctgcgcaaacgattaaggtaaaaaaaggcgatacattatggggactttcaaatcggtatggaacgtcaattaattccattaaatctgagaacaaattaaaatcggatatcatttacatcggtcagacgctttcgatcaacggtaaatcatcttcaggttcaaattcgggcagcaagtcatcatcgtctacatataaagtcgtaaaaggcgacagcctttggaaaattgcgaataaatataaaatgacggtaaaccaattaaaaagtttaaacggtttaaaaacggacctgatccgcatcgggcaagtgcttaaagtaaaaggatcaacttccggttcagcgtcttcaggatcttcgtcatcaaagaagccttcatccagccataatattgcacagacgagcctgaatgtaaacaagctgatttctgatgcgcaatctttaatcggcacgccgtatgtatggggcggaacaacgacttccggctttgactgcagcggatttatctggtacctgttaaacaaacagacgagtgtcggcagaacaagcactgcgggatactggagctcaatgaagagcgtgtccagcccgtcaagaggagacttcgtcttctttacaacatatcaggccggcccttcacacatgggtgtgtacatcggaaacaacaagttcatccatgccggttctgacggcgtcacaacaagtgatctgaataacagctactggaagccgcgctacctgggcgcgaaaagattctagcagtgagagaacccgttcatccgaacgggttttttatttagacggggcagagctccatttgtttcacctaaaaatgaaaatgtgataaaaaatctaaaaaggttttctttttttcattttcatagagggcgatggcgtacgcgcccgcgctcggcatctgggcgaattcgcacggaatttcaatcatgctgcctgcggcgagttcggaccgtaccgctgacagcggcagaaatgagacgcccagcccctctttaataaatcgtttcgtaatatgcgtctgtgtcaccttcattgttctgacgaaagggaactgtattctgacctggcggagcaaatcatcccaatagtcaggatggttatgggtcaaaagcagatattgtccgaacaggtctttcacttcatccgccttccctgtcccgggttttcggccgggtggcgcgacgaggacaacggggtcattgtacagggggcggcaagtgagggaagatgattgcacctttaaacagctcagtccgatatcggctgagccgtttctgatttgagaggcgatttcttccgattcgaaaatggtgaccgtcatttcggtttctttattgtcctctgtataacgcttcatgacagacgggagaacggtgtcggcgataagcggcgaaacagcgagtgtcagcgtgtgcgagtagccctggcgcaccctgtgcagctccgccatgctgttttcatagtcttccaaaagtctcatggcaaacggcacgtatgcttttccttcttccgtcaattgtattttccggccgctccgctgaaacagcttgcagctgatttctttctctaataattttatatgaacggtgacggtcggctgagataaaaaaagcgtttccgccgtttttctgaaattctcgtattttgccgcggtgacgaaggtgtgaagccatttaaaatccatagatgcactcctctgattaaaagttttaattaattcccttaaaaatattcattattttttaaatattatatttactataataacagaaagaggataagggggaatgaaattgatttatcgtggattgaaagggattacttgtgcagaaacggcgatcagccacattgacggagaaaaggggcatttaatatatcgcggctatgacgcgaaggatatcgcattgcaattcagttttgaagaagcggcgtatctcattttgaacggggcgcttcctgatgagcggcaattgcttgcgtttcaggaagaacttgcagccgagcgcgggcttccgaaacatttgatcggcttactggaaacgcttccggatgaaatggacgacatggcggtgctgagaacggctgtttcgggtttgggcacagattcatttacatatccgcccaagccggaagaagcgattaaactgattgccgtcacaccgacgattattgcgtacagatatcgccgtaaacaagggcaggaagcgctgtcacctgaggcgcgatacggacacgttgaaaactatttgtatatgctgacaggcaggcagccgtccgcagcccaaaagaaagcgcttgagacgtatatgattctggcgatggaacacgggatgaatgcatcgactttttcagcgagagtcacggtttcgactgaatcggacttagtgtctgccgtcactgccgcactgggtacgatgaaagggccgctgcacggaggcgcgccttcaggcgtcacgaaaatgcttgaagacatcggggaaaaagaaaatgcagaagcgtatttgacagcgaagcttatgaggggagaacgcctgatgggcttcgggcacagggtgtacaaaacaaaagacccgcgggcggaagcgctgcgcataaaggctgaagaagtggcgggaaatgatccgtcgcttgacttggcgctttatgtggagaaggaagccatccgcttgttagagcaatataagcccggacggaagctgtatacgaatgtggagttttacgcagcggctgtgatgcaggccattgatgtcgacaatgatttatttacgccgaccttttcagcaagcagaatggcaggctggtgcgcacatgtgcttgaacagtccgctgacaacatgatttacagaccgtctgcgaaatacaccggcgcttttcccgaaacggctcagcagctttaattaccggcatatttgtccgtttaactccccgcactgcgtggtatcgtctcagtaataccaattgcaggagtgtgagaatatgaatccgatagacagacagacggaaggacaaaagccgcaggtgcaaaaccgccagcccggaatggagtcagacatggagccgaagccgctcttggaggacccggatgtaaaagggtcgggcagattaaaaggaaaagtcgccgttattacgggcggagacagcggcatcggcgcagcggctgcgatcgcttacgcgaaggaaggggcggatcttgccatcctgtacctagacgaacatgccgatgccgagagaacgaaaaagcgtgcggaagaataccaggccgaatgcctgttaattccgggagacgtcggtgatgaggcgcattgtcagaaggcggtccggcaagtcttagatcactacggaaaaatagaaattctcgttaataatgcggctgagcagcatccgcaaaacgggattcttgatattacggctgaacagctggagaagacattccgtacaaacatgttttctatgtttcatatgactaaagctgtgctgcctcatctcaaaagagggagcgccatcattaatacaacgtcgattaccgcttatcagggagacacatcattgatcgactattcgtgcacgaaaggcggcatcgtttcctttacgcgttcaatggcgatgtcattggccgatcaggggatcagagtaaatgcggtggcacccgggccgatctggaccgccctgattccggcaacgtttactgaagaaaaggtggaaaagcacggtctggacactccgatgggaagaccgggacagcctgtggaacacgccggagcttacgtgcttctggcttcagacgaatcttcctatatgactgggcagaccattcacgtaaatggcggcaggtttatttcaacataatacgcaagtcttatcccgcgcttttaaaaagtgcgggatttttatttgattacatatgaatacgatttttaaaaaatggaagtctccagccgaatcaccaatgttaatatttcacagcagagaatccgctgagttctgttttatgaaaactgaaataatatatagaattttcaaaaagttattttcatttttatatttttcgctataatatgatgtaggagaaaggaatgatgtgctgaaacatttcatgcgaaaaataagaatttagtcattattgctattgttatctgaatattctaacatatattgatttacaaggagtgaagcagatgaaggggagcatattcagaaagaaaagcattcaggacctgcttgccgcaacgggcggggaaaagtcgctgaaaagagagttaggggcctttgatttgacccttctggggataggggccatcatcggaacgggaatttttgtattaaccggaacaggcgctgtcacggcgggaccggggctgaccgtttcatttgtcatcgccgctcttgcgtgtttatttgcggctttatcatatgccgaatttgcttcaagcgtcccggtttccggttccgtctacacgtttacttatgcgacactgggtgaacttctcgcatttatcatcggatgggatttaatcttagaatatatgctcgccgtcagcgcggtttcggtcggctggtccggctattttcaatcattcttggcgggcttcggcattcatcttccgaccgcattaacggccgcgccgggatctattaaaggcacggtcacattctttaatctccccgcatttgttatcgtgcttgcgattacattcctcctctacttaggcattaaggaatcgaagcgggtcaataatattatggtcattttgaaggttctggttgttctattgtttatcgccgttgcggccgtatatgtcaaacctcacaactggcagccgtttataccgatggggttcggcggtgttttcagtgccgcggcgctcgttttcttctcttttatcggttttgacgccgtctcttctgccgctgaagaaacgaaaaatccggcgaaggatctgccgaaaggaattatcttttcattaatcgtctgcactgtgctgtatgtgaccgtatcggcgattatgacgggcgtcgttccgtttgcccgctttgaaggcgttgaccatcccgtgtctctcgtcctgcagatggccggacagaattgggtggccgggattattgatatcggtgcagtgttgggaatgacaacggtgatgctcgtcatgctgtacggccagacgagggtgatgtttgccatgtctcgtgacggtttggtgccgggggcgctttcaaaagtccatccgaagcataaaacgccgcacgtggtgacatgggtgttcggcatcctgtcggcattactcggctcactcgtcccgcttgatgagctggcgaagctggtgaacatcggcacgcttgccgcatttgtcctgatttcagtagcggttatcgtattgagaaagaaacagcctgatctgccaagagcttttaaatgtccgggggttccctttattccgatattatccattctgttctgcgtatttttaattattaaccttggcgccaccaccatattccgtttctttatctggctgatcatcggtctggtgatttatttcttatattcgagaaagcattcgaaattaaacggggatttgtaaggagcggcacccgccgctcctttttatttttcggaataatgaaacatattgaaatgggcttaagttatcgcagtgaataagggataatatagggcggaagggaagtggaaagtcgtgtctgaccaaaaaagggttcaatgggcctcaaaaataggatttattatggccgctgccggttcggcgatcggcctgggagccatttggaagttcccttacgtagcgggtacgaacggaggaggcgctttttttcttgtattcgtcctctttaccgtgcttttaggctatccgcttttgctcggtgaatttattttcggaagacggagccagacaaatgcgattgatgcctacaaacaagccgcgccgaagtcggtatggcacctcacgggttatgtgggtgtggcggcctgttttttagttttgtctttttacagtgttgtcggcgggtggattttgctttatgtgttaaaagctgttacgggttctttatccgggctcactcaggagcagtacggaacggtgttcgggacggtcattgaaaatccgatccagactctcgccgcgcagcttgtatttatgatcttgaccgtggcggtcgtcgcaaaaggcgtgcagaaagggattgaacgtgtcagtgcggtgctgatgccggttttattcgtgctgtttctattgcttgtgctgcgatcagtcacgctcgatcatgccgttgaggggattagatttttattggttccgcactttgaagatttgacgccggaatccatcctatatgctttaggacaggcgttctttacattaacgctcggcgtttcggtcatggtgacatacagttcgtatctgccgaaaacccaaaaccttccgggatcggcgggttccattgttgtgatgaatgtgctcgtcacgctgtttgcgggactggccatttttccggcggttttttcgttcggatttaaaccggatgaagggcctacactgctgtttaccgtactgccggctgtgtttgaccggctgccgttcggctcgctgttttttatcagctttctggcggtctttttctttgccgcgctgacttcggccttttcgatggtggaaattatcgtagcgactgtcgggaaaggtgatgaaacgaaaaggaagaagctgtcgtggacaagcggtctgctcattttcttagtcggaattccgtcgtgtttatcatacggtgtgctcggtgatgttcatttgttcggaaaaacgttttttgatctagcggatttcacagtgagcaatgtgctgattccgctcggcgctttattaatatcaatcttcatcccgctgaaaataccgaagcgggagctgttcgccgagatgaaaagcggttccgccatcggctatcgtttctttcaggtgtggtatttccttctgaaatatctcgtgccgctggctatcatcgtcgtattgctgcatttaatcggcgttcttccattttaaaaaaacaggcccccgtaaaagggcctgtttttatgtttaaaaaccgaattgcagattcgtatcaacggcaacgatcgtatatacacagacaatgacgaaaaggttgaggatgacaccgagcagtcccgggcccgtccgtccttttttaataaacagctcaatgatgccgaacggcacggcggccatcgcaaacggcagcatctgataagaatagaaagtcacattgctgatgattgccacgttcaaaagcagcagcgacaaaatcgcggtaccgactgatatccagccgaaaacattatgctctttaaaaattcttaccaattccataattccacctcaccgatgtttgctgcttttactgttttgtttttcagcagacgttcgatttcttttgtcggccccgtcacgacagagccgtatacgttcattccgtgatgttcaacatagtcgattcggctgccaagattcatgtctttgcgtttcgatattgcatgagcccattttttatggcgggacataaattcaagggcattgataaattgttcacggtctgtctgtccttgcgtttcgaaagaggacaccatcttggaatctttcccgggaaatcctaacggctcggcataaggactgtctttcagatttttctccgtttcgaccgcgttccataaaaacttcacatcgtattttttaaaagttgaatatacttgggaagaagggtaggcccggtcataagaaagatagacctccgccacgcttccttcaggcaatttttttaatgtctgtccggctttgtcaatcgtgcgttcctttaagccggaaggatgggcgaaataatgttttgactgtgccgcgtctagatcatagtagttaacggcaggcgatttgaccttatctaaaaacatttcaatccgttctccgccgacggatttcgtttttgtgccgatctgcttttgcagcggaaactctgtattcattccaaacagcttcacctggcttttcagtccggaggtatcgacgaggacgttcggcatggtggtcgcgaccgtcacggccgcggtttccattaattgattgccggtgctttcctttcctcccagaccgtaatagaggtagcttcccaaagtgcaaagcggcaaaatcatcaaagtggagatgacggcgagaactgaaatccgcaaatacgatttgcgttttccgtatgacaaaatggccttctgtttttccgggctgatgccgacgtcccattcccggtcgtcctgcatttcgctttcaatcaactcctgatagacttccagcttttccagctcttcttcaaaggcggccatttcccggtcgctcatttctccatttttgtattggtaaaaacgctttttaaattcttcattcatcattaacacctctattataaagtgctttcagccgctgtctggcacgaaataaaacacttttaaaattagcctctgaaatattcataatatgggatgcttctttgtaattcagttcttttaaataatacagtgttaaggcctcccgataattgtcgggaagttcggacatataccctgtcagcacttccttgatttcaatctgatgagccgggctttgaacagccgtctgaaaaaggctcccaattaagtcatcggaaatggtcacttcctttttatgttttctgacataatctataaacgcatttctcgccacttgaaaaagccatggctttactttgctgtggtcgtaggagtgaatgtgtatgtatgccctcataaaggtttcctgcagcaaatcttcagcgagatgcttgtcttttgtcatggagagcaggaaccggtaaacatcattcatatacatttggtaaatttcatcgatcgtcactgccttttctcccctctatgttatacacgcataagaaaggtttaaagttgcacgttccatgcaaacggcttaaattcattttcacctcatcaaacaccatttctctatagtacccaaaatccgtcataaaagatagagatcggcggaggaaaaatatatttattagtaccaggtaataaaaaatattgttataatagagagagaacacttttgatcattacaacaaaggaagtgcgttatgtataagttttgtgcaaatgccatcaaattcattctttctctgcgcggaggagtcaaagtatacaataaagagaatcttccgtctgataaaggattcgttatcgcgtgcacgcatgcgggctgggtggacgtcctcacgctcggtgtcgggatattgccccatcagattcattatatggcgaaaaaagagctgtttcagaaaaagtggatcggaagttttttaaagaagattcacgcgtttccggttgatcgtgaaaatccgggtccgagcagcattaaaacgccgattaagctactgaaggaagggaagattgtcgggatttttccgagcggcacgagaacttctgaagacgtcccgctgaaaagaggggccgtgaccatcgcccaaatggggaaagcgccgctcgttccggccgcatataaagggccgtctacgggaaaagcgctgtttaaaaagggaaaaatgcggcttatcatcggcgagccgatttttttggaggacttttccgatcttgcgccgaaggagaggcttgcggccatgacagaagagctgaatgccagaattaaagagcttgagaaaaaacttgaacaactgtaaatgaaaaaaagcttgccgtctgtatcagacgcgcaagcttttttgttatgcttctttttgttcggcggtttccagcagttcatcaaacgccagttttttcacttcgatatatgcgacgtggtggccgtcaatttcattaatgataaattcgcagccttcttcgataatcgagtcgtattgttcgacgtcgtatttctgggtaaggaaccagccgccgatggtgtcgacctcgtcattttctaaatggatgccgaggagttcgttcacttgatcaatcaggaccttgccgtcaagcatgtaatggccgtcgccgagtttgcggatttcattgatttcatcgatatcaaattcatcacggatttctccgacgatttcttcaataatgtcttcaacggtgacaagccccgcggttccgccgtattcatccgacagaatcgccatatgaacccgttccttctgcatttttacaagcagatcatgaatcggtgccgactcaatcacatggatgatcggattgacaaaatccgtaatcggcgagtcgactgatacttcgccgctgatgcaggcggtcagcacttctttaatgttaataacgccgataatattatctttgtcaccctcttcgacagggtaccgggtatatttttcaatctgaatgatatccatcatttcagaaattttaatatcatgcggcagactgacgatttccgtacgcggaatcatgatttcttttgcaagtctgtcgtcaaattcaaagattttgttcacatatttaaattcagactggttgatttcaccgcttttatagctttccgataaaatgatgcgcagctcttcttcagagtgggcaagctcattttcagacaccgtctccagaccgaacatcttcgttaaaagacgggcggagttgttcagaagccagataaacgggaacatgatgcggtaaaaccaaatgagcggtttcgaaaacagcattgaaacggcttccgctttctggatggcgactgttttcggcgccaattctcccacgaccacgtgtaagaatgtaatgatcgcgtaggcgagaataaatgaaataatatgcgataatgagcttggtacgtttatctttgtgaaaagcggatgaagcaagcgttcaatcgttgattcgcctaagacaccaagaccgatggaagtcaatgttatgccgagctggcacgccgataaatactcatctaaatgcgtggtcacttttttgacaccgattgcggctttatttccttctgctataagctggtcaacccgtgagcctctgattctgattatcgcaaactcagatgctacgaaaaatgccgtcagcgcgattaaaaccgcgactaaaatcaaattcacaatgtccaattagaaccttcacttcttttgggaagatgaaggtaacacctcctgttagtaagataatggtttaacttaacagcagcataaatgattgaagcactgcaagcttttcaggagccagcctttttttcagctgggcgcgctcctctggttcaagcttttcaaaccgattcaagatcccggagatgttttgattcatgtgatcaatttccgatgccagatttccaacatcgtcaggcagggctgaagagggaaactggttctccagtcgatcttttatatcagacagggccaatcgctgctttttacaagcgactataaactttaaccgattaagtgcaagtgtatcgtagtaacgatagttcgaacaagacctgtcaggctttaaaagcccgaggtttgtgtagtaatccaccgtgcgtttcgttacaccggcaagctctgctaattcactgatgcgataagtctcagccccatctaaatccctccccaaccatcacgttatagttatgagaatagtttaatatatgaaggggagtttgcacaagtttattgttttccgtctttctcctgaaacggggcggcaggctgtctgaaaaagcgttgactgcgccatgtaaatctttcataatcattgtaaatagaaacggcagaaaaagacagaagggacagatgacagtggccggtttatcaagggaagtgacacagaatctggagaaaggttcatggatacgcaaactatttgatgaaggcgctcggctgaaaaaagagttcggcgccgataaggtgtttgacttttcgataggaaatccggttgcggagccgcctgaaacatttaaaaaggcgctatgcgaagcggctgaaacaggacggcacggatacatacaaaaccaagggcttccggaggcgagagaaaaggttgcccgctttttgtcagagcggtttcagacagaaatttccgccaggcatacagttatgacggtcggagccggcggggcgctgaatgtcgcgctgaagagcattttaaacccggaggaagaagtcatccttctttcgccttattttgcggaatataaagcgtatgttgaaaattaccgcggcagacccgtcatctgcccgctgactgactcatttgagattgatattgaagcggttaaaggtgcgatcaccccccgtacgaaaggactgatcgttaatacgccgcataatccgacggggactgtgctcagccagaaaaaccttaacgaattgggcgccttattaaaagaagccgaagagcggaacggccaaagcatatttattttatttgatgaaccgtacagccagctgatctacggagaagagcaggcgaatccgtttcaggcgtatcaccgcgtgattttagtcagttcgttcagtaaagatctcggcattgcgggggaaaggctcgggtatatcgcggcggacgcccaaatgcctgagggcgatcttctgacggatgcattcgttttctgcaaccggacgctcggctttgtgaacgctccggtcatgatgcagcgcgccgtggcgaaaatggatgatctttcgattgacgctgaaccttacagaaagcggagagaccttatggtggacatcctcacagaagccggcttcgaatttgaaatgccgaaaggaggctttttcgtctttccgaaatcaccgattgaagacgaagtggcgttctgcatgcatgccgcacagaaatacaaactattgatcgtacctggcagcggatttggaaaaagcggctatttccgattatctttcagcgtgccttcggaacagatcagacagtcgcgcgatattttcaaagcactgtatcaagatttttcttcatagcttccaatacataaagatgggagaacggacacatgtcgaggagaaataatggcacgtcagacatcagcattacaggaatcggagtcttaaccgcggtcggacaaggcaaggaggcgtttctcgctgcgctcatggaggggcggcacgcctttgatgtgatgaaacgccccggccggcagaaaggcagttcgtttatcggcgcggagcttagcgaattaacgccgccggacgcgctgtcgaagcgcttgtaccgaagggccgcattatcaggaaagacggcgcttatcgctttatatgaagcgtggcatgacgctcaattagacggcgctgatcacagccgcaccggtctgatcatcggcgggtcgaatatgacgcagcgcgaattgctgcaggcctttgagaaaaacggtgaaacgccgcaatttgtaaatccgacatacgggctttcttttatggatagtgatttgtcggggctttgcacggagcaattcgggataaaagggccggcctttacggtcggcggcgcgtcggcaagcggccaggcagcggttatccaggctgctcaaggaatcataggaggcctgtttgaccggtgcatcgtgatcggggcgctggccgatctgtcgtacatggagtgtcacgctctccgttctttgggagcgatgggcactgatacatacgctgaacggcctgaagccgcctgccgcccgtttgaccggcatacggacgggtttatattcggagaggcgtgcggggcgattgtgctggaacgcgctgaatctgccgaagagaggggcgcacgatcgtgggccggcttaaagggctgggggatggcttccgatgccaaccgcaacccgaatccttcagcagagggcgaaatgacggtgatccgccaggcgctggagcgggccggtctttcagcgaaagagattgattacatcaacccgcacggcactggttcgccgatcggagataagactgaatgccgggcgctttctgaaagcggcctgtcgcacgcgcggattaatgcgacaaaatcgattaccggacacggtctgagtgcggccggaacggtggaaatcattgctgttctcttgcaaatgcgggaaaacaagcttcatccgatccgaaacttaacggagccgattgacgattcatttcagtgggtgaccgacgggccgagcgcccataccgtacaccatgcgttaagcttaagcatgggattcgggggattaatacggcgctttgtttagaaaatcatttccgaagcagataacggcagccttctttttgaaggctgtttttatatgatgaaaaatctgaaaatgatgaaagaatggagttgtgatacaataaactatacaaatgacaatcatgctttgacttaggaggtggcaggatggggccctctgtgtagtcaatcacccatttcgttcctctcgcttaagaaaaaacgatgaaatcaggaggtgacgtccttatccttcaattcgggataaggtgaaatggacgatattgacagtttgattttaatcggtgtgctcattgcgttaacggcgtttttcgtggcgagtgaatttgcgatcgtcagagtgaggagatccagaatcgatcagctcatctcagaagggaacagacgggcggtgctcgcaaagcgtatcattacggatcttgatgagtatttatccgcctcgcagcttggcattacactcacatccatcgggctcggcgtactgggagagcctgcatttgagcggatgcttcatcctgtgtttcagggcatggggctgccggattcagccgagcatgtgattgcttttgctgcggcgtacgggctgattacgtttttacatgtcgtcgtcggtgagcttgcgcctaaaacggttgcgattcaaaaagcggaaaagctgacgttatggattgccggaccgcttcggttattttacgtgttcatgttcccgtttatttgggtgctgaacggctccgcgagaattctgaccggtttggccggattaaagccggcatctgagcatgaaggctcccactctgaagaagagctgcggatcctgctgtcagaaagtttaaaaaacggagaaatcaatccgtctgaatatacatttgtgaataaaatttttgattttgataatcggatcgccaaggaaatcatgatcccgagaaaagaaatcgcggctgtttccactgatatggacgtgccggaaatgcttgatatgatgctgaaagacaaatatacgcgctggcccgtaacggacggggacaaagacagtgtcatcggcatgatcaatacgaagcatctcttttcagatctgctgtttatgacagaagatgaaaaagcggaagtatccatcatgtcttacgtccgcccggtgattgaagtcatcgagacgatcccgatacacgacctgctgataaaaatgcagagagaacggattcatttggcgatattgtctgatgaatacggcggaacgtccggtcttgtgacgaccgaagacatacttgaagaaatcgtcggcgatatcagagacgaatttgatgaggacgaacagccgcagattcaaaagctgtccgaacgccattatgtgctggacggaaaggttcggatcgatcaggtgaatcatcttctcggcgcagagattgaagaggaagtcgatacgatcggcggtcttgtgctgaaacggaatattgacatttgtgcgggtgagtcgatacaaatcgggggatacactgccctcatattagaaatggacggccggtttattaaacagcttgaactcaaagaagaacagggccgcccgggcggtcaggggacaataaaccgcccgctgcccgtgcctgaaacggtcatgcttcataacgcaaccttgagcgaaaaataagctcaaggtttttttaaatggttatcataacaaagccgcaccagaacgccaaaaggcttccggctgctgaaacagcgatgtagagcagactttcctttatgcggttgttcatcatcagctgcacggcttcaatactgaatgtggaaaaggtcgtaaacgcaccgaaaaagcccgtcgcgatgatgatgccggcagaaggattatccagacccaatccggtgaatatgccgaggccgaaggagccgagcaggttgaccgcagccattccaagcggaatcggaaaaccttttgttctttctgaaattgttttacccagcagagaccgtaataccgctccgatacccgccgcgataagcatcaggacaatcgtcatggcgtatcatgcccccttcccgctgcgtgaagggcaatccgccgtccccaaaaaatgccggcgtatgcaagggcaagaccagcgaataaagtcgcggcagcataacaaaaagccgctgcgggagacgattgcagcagaaaaacggtttcttttgcgaaggttgacatcgtcgtgaaacctccgcaaaaaccggttcctaaaaaggcggtaaaaagagggcgtttagcccgaatgatgaaataacccgtaataagaccgagtaaaaggcttcccgccgcgttttcgaggaaagtggcacccgggaaagatccgctgtgaatgtgcgcgctcatttcaaagcggagcaatgcgccaagcgcgcctccgataaaaattgcgatgtattgtttcatatcagccatccttagaaataatatccggaaaatcagttacaatgccgtcaactgccatcatttgcagcttttcggccgtcttgtgatttctgaccgtccaggcaaatactttcaggccgtgtttgtgagcggtggaaatcaagaaccgattcaggcgggtatatttaatattgacataatttgcggctgatttgtaagcggccagctggcttttggaaaacatcccgaagctgggtcttgcgataattgcagtcggaacggacggatacatgtcgtgaaaggtctgaatcgatttgagactgaatgattgaacgatagggtggatggaaaaggtaaacctgcttaacagctggccgactgctttttcaagaccgacttgagaaatgtgccctttcagttcaattaaaaaaccgatttcagaatgataacgcttcagaacctcttcgagcaggggaatccgctcccctttaaactcagccccataccagctgccggcgtccagagattgcagcttcttcagcgtaaaatcttttacaaaaccggagccgtccgtcgtccggtcgactttgtcatcatggatgacgacaatctggccgtcttttgtgagctggacgtcaagctcaatgaaatcagcgttcatttcggcagcgatatcaaatgccgcaaatgtattttcgggcgcgtaaccggatgcgccgcgatgagcgatggtatacaagcttgtcagctcccctcatgggcatttctgttattatatcagattcgtatatgcacagcgattcaaactggtgaatgtgcaaaacagtatttttttggaataaagatagtgcttttttcggtttacaatccgcagtgatgttttataatggcaaaaaggaggcgagatcatgggaaaagggagattgaaagtggaagaaagaattaaggccgaaaccgatgctgaaatccaaaaagcgactctcctgaaacagacacaatcaaagaagaaatagtgcctgaccctgttgtatctggctgaaagatgaacgaatgtgtgaaaaccccggctgtgctctgatgccggggtttttcaggctgcctaaagacattaaaacaggctgatgtccgaatgttttagtataatagattttcgacaagacaaaggagcatatgccatgatgacacaatttcagagcttttttactcttgaccatattttgcagatcagtatcagcatcggaattttagcggcttttctcgttttgagaaaactgtttgtcaaatacttttttcagctcatttacaaattggcgaacaagccgaaaaccgacatattcaaacagattgccgtagcgtttgacaagccggccagatggtttttcgtggcgctgggtctgtttttggcgattgagtattcgccgtttttagacggacagatggatattgtcaaaaaaatgtaccgctctttgatcatagcgctgatcgcctgggggctttgcaacctgacatcggcgtcttcgtttttatttcataaagtcaatcagcgctttgagctggatatggatgacattttggcgccgtttttatccaaggtgctgcgctttgtcattctcgcgctcagcgtcagtgtgatcgcgcaggaattcaattatgatgtaaacgggttcgtggccggactcggacttggcggcttggccttcgcgcttgcggctaaagatacgatcagcaattttttcggcggcattatcatcattacggaaaagccgtttacgatcggcgactgggtcgagacgtcatctgtgacggggggcgttgaagatatcacattccgaagcacaaggttccggacggcgcagggggcgcttgttaccgtacccaattcaacgctgtccatggaagccatcacaaactggacgaggatgacgaagcgccaggtcacgttttccgttcgtgtttcttatgcgacgccgattgatcgtttagagcggtgtatcacaaggctcagagaaatgcttcgtgaacatgaaggcgtgcatgatgatacgattatggttaactttgacgtgtttgcggacagctattacaatctgtttttcaacttttacacaaagaccatcgtctgggcggaaagcctggacgtgcggcaggatatcaaccgccggattattgatatttttgctgaggaaggcgtggagttcgcctatccgggccagaatgtattcgtaaaacagaagagccacgatgatccggttcatgtgaaggatcattccggagaaaaagaacgggcataacaggcgccgttcttttttcatgatatgataaaaagaaaaggcggtggaagagtggaagcgtttataacattgatcaatcaggctgaacgtatcctggtgctgacgggagcgggaatgagcacggaatccggcattcccgattttcgttcggcgggcggtatatggaccgaagacacctccagaatggaagcgatgagcagggaatactttgaacgccgtccgcgtgaattctggcctaaattcaaacagctctttcagatgaaaatgagcggaagctatgagccgaatgccggccatacgtatttggcggatcttgaaaagcggggaaagcaggtagacattttcacgcagaatattgacgggctgcataagaaagcgggaagcagtagtgtctatgagcttcacggttcaattcagaccgccgcatgcccccgctgcggagcgcgctacgggctttctcatctgctgaaggacgaagtgccggaatgtacggccgaaatcggtgatcatgcggtatgcggcaccgtattaaaaacggatgtcgtgctgttcggcgatctcgttcagcattttgaaaccctttatgaaaagcttgataaagccgatcttcttcttgtgatcggcacttcgcttgaagtggcgccggcaaggtttgtccctgaggatgcgggccggattcccggtttgaagcaggtgatcattaaccttgagccgacatattgcgaccatttatttgatcttgtcatccatgagaagatcggtgaatttgcaaaacggatcagcgcttcgacataaaaaaagccggatcatatacagatccggctttttttattcatggacgggaatcatttgatccgtcagaacttcaaaggagtagccctgggctttcagtttttgaatcaggctcggtaaagcgtgcaccgtcgcaggcagatcatgcattaaaatgacatgcggcctgctcgtatgaacgctttccaaatatgcgagctgattcaatacttccggcacgtaccgtgcgtttttgtacttccagtcttcactgtctatcgtccagtcccagtacacgaatccgcctttttcgagattcttaatctgggcatccgtcaatgacggtttactgccgtaaggcgtgcggacaagatccgtttttactccagtgattgcctcgagcgtatcgcgtccctgctgcatttcgttcagcggcgatgtcggtgtttgataaaacaggtgattatcgtgcgtcacgccgtgcaggccgagcgcgattccttcctgcttcgctctttgcacggaatgcttataggctttcatccgcggttcaagcataaaaaaagtggcctttgcgccatttgccttcaatacattcaacagctgttcagtatatggagacggcccgtcgtcgaaggttaaatataccgtttttttccctgggtcacgctctttctgcaaatgtttcattaagacgtcgggagaatcatttttcagccgcaggctttctgcttcatcccgaagctgcccgtttgcggtcacggtgacctgtttgttttttgcggcggaagcggaatatcccattatgacgattaccagaagcagtccgcacaaaactgctaaactcgtaagtttaaaagctaatgaaaacagagaaggggaagcaccttcttttgtgttgcgcataacaatctctccagtagcataagtttctgcataatgccgataacagcggaggcttgcgaagtgccataagttaacagcatatgtatgtcgaatcaagtatacaggaacaaaactggaaaagacatagaaaagatgtcgaataataagattttaagaaaaaaataaactccgcagccggctcgttcagtatgatagaatagttgacaataacagctgagaatgcacatcacggcagataacgattaggagggtttacatgaagacattagtaaacggccagttgattgatcgtgaagaagcggcagttgatattgaggaccgcggatatcaattcggtgacggtgtgtatgaggtcatcagagtgtataacggcgccttattcggtctgcgtgagcatatcgtccgtcttttcagaagcgccgcagaaatcggcatcaccctgccgttctccgcagaggacatagaatgggatctgcaaaagctcgtacaggaaaacaaactcattgacggcggggtctatatacagacgacgagagggaaggcgccgcggaagcaccagtatgacgaaggtttggagccgcagacgacggcatacaccttttcagtgaaaaaaccggaaaatgaacaaaaagccggagcgcaggccatcacggcggaagacaaacgctggctgaggtgtgacattaagagtctgaatttactgtataatgtgatggtaaaacaaaaagcctatgaagcaggcgcttatgaagcggtgctgataagggacggggcggtcacggaaggaacctcatccaatgtatacgccgtcataaacggcaccgtccggacgcatcctgcaaatgagctgattttaaacggcattacgcggatgaaactgttagagctgatgaaagaaaacgggattgaggtgcgggagaaggctcttaccgaagacgaactcagagatgcggatgaaattttcatctcgtcaacgacgtctgaattaatcccgatcgtaacccttgacggaaaaccggtcggaagcggcgcgccgggacctgtagccaaaacgattcaggaggcatttcagtcgcacattcagcaggagctcggcgttcagtcataagctgaaaaaaaggccggaacacatccggcctttttgcttcagtcagataaaaagagattcgatatgctgaacgagcacacgggagatcttctcttttgaaagacgatcaggttcaagcatggcatgcagcgccaatccgtcggcgatagcgtacattttctccgcttcggtttctttatcaagatttggtttcagaagcttattttcatccagccagtcaatcaggccgcggatatatgccaagatcccgtcctgctggggttgaaactcttctcccttatgtctggcataagctgtgaaagcgaaccatacctccatttcagccatcgtttcttcatctgtcgggataatttcaagcatcagacgcaccgctttttctttcggcggcagatctttcatggcaacttcgttaattctggcggccgctttttcttttacgagtgtcatcgcataccctaaaagctcatcctgggtggtgaaatagtgcctcagcgcgcctaaagaaagacccgcttcttgggcgatgtttctcactgtcgctccttccattccccgctccaaaatcgtccgccaagtggcttcggctatttgttttcttcttttttcatgatcgattattttaggcatggttccagtgtaacaggaaatattttttcttgcaattttgtaatacagttgtattaaataaaaagcagtgatacaatgcattttagaaaacgataagggggaaccggattgaacgcgattgcttggttgattgtcatttgtgaggctgctttttgggcggctgtcatcttcggattggcggcgcgctatatattcaggcggcaaaagctcggaatgttttttttcgctctcattcctatattggatgctgtactgtttctggcggccgcagctgatttatacagaggggcggcggcgactatggcgcatgcagtggcggccgtttatatcggagtgtctgtcgccttcggaaaaagcatgattcaatgggcggatgagcggttccgctattatgtggtaaaggaaggggcaaaaccggtcaagcggtacggactggattatgccaaacattatgcaaaaggatggggaagacatgtattagcatttgtcatcggcggcgttcttttagccggaacggtatttctcattcaggacgcttcccgcaccgaagcgctcagcggactgttaaagggctggtctgtcgtattgtgcatcgattttttgatcatggcgagtttttttgtgatgccgaaaaaaagaaaaaacagccgggagctgtaaaaaaaagcagcttttgattaagctgctttacagaaagaattattttacgatcagcacgggaatatcggatttcgatgacagtttttcactgacgcttccgaataaaagttttttcagcctgttctggtcccggctccccatgacgatcaaatccgccgatatacggtcggcatgctcgataatggcatcagcgggatcaccttctaaaatgtcgatatccccgtcaatctggctgtcgttcatcagcattctcgcttccgcaacgatttcttccgtacggtcttcataaatcatcggatcaggggagattctttccgcctggagcgggtcaggaacgcttgcaatcccgccgccgatatacgttgccccggctcccggcctcgggggatcaacaatcgtctgggtatcttttgcattgtgggaatgtacgaccgttaaatctgcgtgaaacgtttttgaaaggtctatggctttttgaagcgcttttttactatcatcacttccgtcaaaagctgctatcaaccggtctgcgtgaaacatcagcctcatcctttcagtaaaaaaggtttgttttacaatacccgtgcagcagaaatgtaaaacctgcattgacagaaaaaggatttgtttatatgatgaaggaacaatatagggaaaaaggaggtatggatcatgtcaaaactaaagcttgtcaactcatcttcagctgaataccggcgtgactcccatacagcttccgttttctgaacatttgcttaaaaacggggcagtcgcgtataaacggcgggtctgtaccttatttataataataagaggcatggagctgaggcttcatgtctttttttatacaaaaaaatgaaagaaagacaggtgtgatgcatgtggcggcattagcgaaaacaatgaaaaacaatccggaaaagcttgagggcggctgattgatgaaaggggatgacggtatttgtttactgtattaaaaaagctcgcgtggttttttaaagcctattggctgcgctatacgacagcgattgttctgttattaattgtgaatgtcattgagatgtttccgcctaaacttctcggtaacgcgatagacgatatgaaggcgggcgtgtttacgaaaagcgggatgctgttttacatatgtgtttttctcgcattaacggcagccgtctatttactgtcttatttttggatgtatcagcttttcggcggggcgaatgtcatggagaagattctccgatcaaaactgatgggaaggcttcttcaaatgtcaccgccgttttacgagaaatacagaacgggcgatttaatggcgcgggggacaaatgacctgcaggccgtcagtatgacgacgggcttcggggtcttaacgctcgttgattcgacgatgtatatgctgacgatatttttgacaatggggcttctcatcagctggaagctgacatttgccgcgattattccgctgccgataatggcggctgcggtcagcctgtacggaaaaaagatccatgagcggtttacggaagcgcaggatgctttcggatcattaaatgacaaggtgctggagtcggtagccggcgtccgggtcatccgggctttcgtacaggaaaaaaatgatgtcagccggttcggtgatatgacggcggatgtatatgagaaaaatatgaaggtggcgtttatcgattcactttttgaaccgactgtgaaacttctcgtcggcctcagctatctcatcggtctcggctacggcgcttatctcgtttttcaaaaccggctgacgctgggagagctggtatcgtttaacgtgtaccttggaatgatgatctggccgatgtttgcgatcggagaattaatcaatatcatgcagcgcggcaatgcctccttggatcgtgtcaatgagacgctttcctatgagcctgacgtgatcgggcccaagcgccccgccggcatcaaggagcccgggcgtcttgtttttgaacaagtgactttcacgtatccgagcggagcgggaccggcggtttccgatgtatctttttccgtagaaaaagggcagacactcggcattgtcgggaagacgggaagcggaaagacgacgatcattaagcagctgttgcgtgaatatccgcccggggcgggagcaatcacgtttacaggcgttccgattcaggagatcccgcttgaggagctccgcgggtggatcggctatgtgccgcaggatcatattttattttctaagactgtaaaggagaatctgctttacggacggcaggatgcaaacgaagaggaaatcggcggcgcgctgaaagatgcgcattttgaaaacgatatcggcatgctttccgacgggcttgagacgcttgtcggcgagaagggcgtagcgctctcgggcggacaaaagcagcgcatttcaattgcgagagcgcttttgaccgatcctgacattctcatattagatgattcgctttctgccgtagacgcgaaaacggaagccgccatcattgacagcatccgtaaaaaacggcggcataaaacaacgattatcaccacccaccggctctcggcagttgaacacgcagatctcattctcgtcatggatgaaggccgggtgtctgaaagaggcacgcaccgggagctattggagcagaacggctggtatcgaaaacaatatgagaggcagcagctgtcctctcttgaagaagggggacgggcgcatgaagaccgggagaagattatggaattacgcgcttcaatataagaagctgctgatatgggcggtcgtcctgctcattattgcggtcggcactgagctgaccggcccgtttatcggaaaaaaaatgattgacgaccacattctcggcattgaaaaaacatgggttaaagcctctgcggacgatccgggcgccgtcaggttccgggggcatgattatgtcagggaggaccggctcaaaccggaggcggataaaaccggagaggcgcacatttatcaagtcggtgcgggctactattttgttgaccgtcccgtcagttttgacggaaaccgttcggtggctgacggccggctgacaatatcaaacggtaaagaaagcaggtcatatcccgccattacgttatcaagacaggagatttttgaattttaccgtccggaaataaaaggattgctgacgttgaccgccatttacgcgggactgctcatgttttccgtatgttttcattacggtcagcattatctgctgcagatgggagcgaaccggatcatacagcgcatgaggcaggatgtattttcacacattcagaaaatgccgatccgctactttgataatctgcctgccggaaaagtcgtggcccgtattacgaatgacacagaagcggtcagggatttatatgtaacggtgctgtcgacatttatcacaagcggcgtttatatgctcggcatttttacggcgctgtttatgcttgacgtcaggctggccgccgtttgtcttctgattattccgattttaatgatctggtcggttgtgtaccgcaaatacgcatccgtcttcaaccaaaaaatccgttccattaacagtgacatcaatgcgaaaatgaacgagtccattcaaggaatgccgattattcaggcgttccgccgcgagaaggaaacgatgaaggaatttgaagaattgaatgaagctcatttccgctacaaaaacaaaatgctgtccttaaattccctcatgtcccacagtcttgtcaatgtgttgcgcaatctggcgtttgtcgggctgatctggtatttcggaggcgcgagtctgagtgcggccggaattgtttcgatcggtgttttatatgcatttgttgattatttaaaccgtttgttccagccggttacgggaattgtcaaccaattttcgaagcttgaattggcccgtgtctctgccgccagagtattcgagcttttacaggaggaggaaacggaagaagaaggcgctcccgcagacagaaaggcggaagggacagtggaattccgcgatgtttcttttggatatcgaaagggagaagaggtgctgaaacacatcagctttacagctgaaaaaggggagacggtcgccctcgtcggccatacggggtccggcaaaagctccatcctgaatcttctgttccgtttttatgatgcccaaaaaggggatatcctgctggacgataaaagcatatacagcatgtcaagacaggagctgagatcccatatggggatcgtgcttcaagatccgtatcttttctctggaacgatcggctccaatgtgaccctcgatgatcagcgtatttctttggagcaggcggaagaagcgcttcgccaagtcggcgccgcaagtcttctgcaatctttgccgaagggcatcagagagcccgtcactgaaaaaggcggcacactgtcctcaggccagcgtcagctgatttcttttgcaagagcgcttgtgttcgatccggccattttaattttggatgaggcgacggcgcacattgacaccgaaacagaagcagtcattcaaaaagcgctgcaagtcgttcaagaagggcgcacgacatttattatcgcccatcggctttccacgatcagacacgcagaccagattctcgtgctggaaaagggccgcatcattgaaaagggaagccatgacgaattaatggcgcaaaaggggcagtaccatcaaatgtatgaattgcagaaaggatcggcgaagtccgcggtgtaatcggaaagggtgaatctaaagagattcgcccttttttcattcagtaagccagtcctacccgttttctgacaaactgcgggctgatcagctcgcggtacagaaaatgcgcagtgtctccgactgtgatttcggcgccgtcttcaggaaggcgatcctgttcgaaccggtaaactccggcagcgtctccgtcaggaaggtaggtagggcagatgatcgtccagtcaagatcctctgccagcagcatctcgtatacgcgggcgtgttcctttgcggctcttgttgattttcgttttgattctgccgattcaaaacggtattgatcaggcataagccgtgattgaaggatacccgcggtgccgatcgtaatcagacgctgaacatgatgccgtttcatgccgtctattatatgggtcatagcggctgaaagggtatcgtcaccgtccgtgccgagacagctcacgactgtgtccgctttggaaatcaatcggcttacatcttcccgccgcctcgcattccctgttatgatctgtttttcaggaatgggaaggactgttccggctgatctgacaagagcgaagatctccatgtgtccatgtttctgcgcttcttttataaaagcctgtccgactcttcccgttgctccgagtaaagcgatgttcatgtaaaaaacctcctcgccgctcattatatcattcaaagcagcggggaaaagaatgcctgtgaataaacgggaaatggtgggcaacatattcattgaccaaagaaacacttacgaactgaaacagctcccaattgactgaggcaatgaatgacatgttttccctccttttttcctagggtatgtgaaataggaaaaaagggtgacggcataaaagaagacgcggtatcccgcgccttctgtaagccatttattgagttattgtacgccttggccgcccatgttctgctgtgcgaaagatactaaacgtttcgtgatttctcctccgacagaaccgtttgcacgagaagttgtttctccgccaaggtttacgccgaactcagaagcaatttcgtatttcatttggtcgattgcttgagcagcgccgggtactaatagttggtttgaagagttgttgtttgccatttgtatgatctcctttattaagtagtatggttgggtttgctggaattgcaccagccgatgattttcggaatgaaaaccattgccagctcggcttcacccaatgctgtttgccgctttgtactacgtattatggtgaatcaaacggcatctcattcggaaaaccgggtggtaaatagcggaagggaaaagaaaagcccagcctgatgcggctgagcttttagctttcagtcatatatgtgataaagcattaattcatgcagctcttttacgagagccggctcttcttttcccggatgtgtgtgtccccattcaatgtcaccggacttatggtaaatcccttcgtaatgcgtaccctgccagtaaaatgaaatccgccatccgggcagtttctcttttttgaataacggtttccagctgaagtgcgaaatcatgacgttcacgctccttgtaggaaatgttgatcttgttcattgtagctcatcattctgtgcctgtcccgggtaaaaccaaaaaaagacagcctcaccgccaaagtttttccggggcggtgatggaccgttctgataaataggacgcgtattcaaaatttctccgttttgtcaggtaatcgaccgatctcagcttcggatgggaaaaaatgctgcgcccggggcgggaattggcttcaaacatccaaactttccctgaatgatcgacgccgaggtcaaaaccgatttcgccgataaaaccttcaatgtgctcatttaacacgcggctgaccgccaaggcggcttttgaaagtttccgcatcatgccgactctctctcgcggatcgccgtataattcagctaacgtcctgacttctccgccggttgccagatgcgtcgtgatgctgttttcaccggaaatttttgccgcgatggccgtcactgtccatttcccctcggcgtttttattcgtgtgcaccctgaaatcgacggggcgtccatccagccggatcaggtcaatgccttgctgaattaaaaatgcggacgggtcattgttttctttaaatgatttcatgaaggatgccgcatctgaatactctgccgtcaccaccgttttttcctcattcgtgtgtttgacagataagccggcatctgttttttccaccctgtaaatccccgttccgagtgcgccgtctgcaggtttgatatagacggtgtcaaatgtgttgcataacgtctctaacgcttctgcattcgggtgcaggacagattttggcagaagtgaagcggtgaggctgtttttttccagaagcttatgaatgtcccatttattaaagaattgcggattaaaccacggaatctgatagtcattcatcagcctctgttttgtctgctgtaaaagcggaactccttccgtttttcggctcgggagcctgtcatatacgacattcggaagcgggacggccgtccgtttccagctgttttctttataaatcagcgcttggacggtgccttcttcccagttgatctgatgagccccgaaaacgaaacaatatccgttcgcctgttcatgaagtgagagcatcttggaaaagaaggctgtacggtctcttaacgggcgggacggcgatgatgtgaacccggctgtgaaaacgccgatcagcggtccgatgtgcaccgtctggccgtgtatgagaaagtcagcccggcttttatacggtatcaacagctcctcaaacaaatcttcagaaaggagcgcgcttttttcaagtgattgagaaaaggctacacggcatttgacaaccttggtcccgaaggcagcggataaaagcccttcccgtttcatggaggaggggagaaacagcgtatttttgctttttttatcgatgccgacaatcatccctttatgattcacgcggtaatactcctttcctgctttcctgtgactgaagttcgcggaagcgtctcagcggacccgtatacaaatcctctttcgcctccggagccacgcttaaaatagctttccgtcccggctttgaattgacatccaaaagccagatgcgtccgtctttggcataacaaatatcgagccccagctcaaacagcggtccgaaccgttcatcaaggaaataagggacggattgggtgatcgaaaagacatcatccaataaaacggcctgctgctttctcggaatttcctcaaaccatgtgtcaaacttaatcggttctgatcctccgggcaaatgagataaaagaccgttctgataaccccttctgaccgcttttccgaccgtttcccaaacgcctgactccgttttgcgcatgaaaatgcggatgtcgcacggatgccgttctttatcctggatatttaagtaggattgaagcaaatagcggtgctgcagcacttttttgcaccaagacttaaaagacacgtgattggaaaatgattttgtttgtttgttttttccgatatagtaagtggccgtaattgattttttgcctgtttcaagcaggatgatgcctctgcctcccgcgccgaaagcgggcttaagtatacatgctttttccttggctaagtatgattgcacctgttcatagcggctgacttcggccgtttcaggaatatagggactgatcaggtgatgcttttggagcgcatccgtgaccgtccatttatcaggaagcccccgcccgataaattccgttttcggatattttttcagccattcgacgatcggtttggctttttgcgcttcagcggattttccgtaaaaacagcggtcgtaaatatattcgggaatatcgatttccgtttcgttccactttctgctttgcgggtgatagacaagcgctttcacgcgcaaagaatccggaaatatatcaaacggtgtaaagcgggctaagcgcacattatattgaggcgctctttcagccaattccccggcgtaatcttcttcgtgccggcgggatacagacataaaaccgagtgttgtcatattattactccccctttattcaaaaagccgctgatggaacggcccttccatccaataaatatgctaagcgcatcataaaagatgatctactgtaaagagtacgaaacagcatcttgccttattcctcacaaacaacaattcaggttcttcatttgcccgcatgcccgccagcctctataatacgaatagatatatcatcaagaaaatagaacataagatggaggcagaagaaaaggaatgggcatagcaggaacgtttctatttatgattgtgatcggagccgcgatcggcgcggtgacgaatcatcttgccattcagatgttatttcgtccgtaccggccgtattacctgttcggaaaacgggttccgtttacgccggggctgatcccgaaaagacgggatgaattggcaaaacaaatggggctcatggtgacgaaccatcttttaaccccggaaggaataaaaaagcggcttttatcagataccgttaaaaaccaggcgcttcttttcgccgaacaattcacgcaaaaaatggccgcttccgagatgacggtgcacgaagctttggccgccgcgggcatccggaatccgcaggaaattacggatgcctggattgatcgttttaccgatgaaaagctttcggacctgtaccggaaatatgagcaccgcgccataaaagactggcttcctgatgagctgcaggaaaagctggatgaaaaaatcccgctggccgcagattatatcctgaagcggagcattgattattttgagagcgaagaagggaaagacaggctcggaaatatgattgacgactttttgaattcccgggggatgctcggcggcatggtgcagatgttcctcggcaattcaagattggcagaccgtgtgctgcctgagctgttaaagtttttgcgcaatgaggaaacgaaaaagcttctggctgatctgctttctcaagaatggggcaagctcaaatcttatacactttatgaggccgatgaaaagtggaatgcgaaagatctgctgttcagcatgaaaaagcgggctttggccgcacttcaaaccgcgccctttttcgaatgccggctcggtgacatcatctcccgttatgaaggggagattacggggacgtacgcgccgaagctgcttgatgcggcactcggcagtattgccgctcatttggaggatgtgctgaaacggctgcgtcttgaggaagtggtcaaagagcaggttgatcagtttcccgttgaacggctggaagaaatggtgctgtcgatttccaagagagaatttaagatgataacgtatttaggcggtctgctcggcgggataatcggagcaattcaggctttgtttgtcattcttttctaaggaaaacatacgccgatgatgaaagtcgctccgcagtctgttatagtggagtggtatgtccgaaaggaagaaaggagcggttactatggcagttcatttttatgatgcagcatatgatcttgaaaaagctttgcgaaacagtgatgaatacagccgtctgagagggctttatgatcaagtaaacgcagatgaatccgcaaaacgcatgtttgataacttccgcaatgtacagctgcagctgcagcagaagcagatgtcaggtgaagaaatcactcaggaagaggtagagcaggcacaaaaaaccgttgctctcgtacagcagcatgaattgatttctcagctgatggaagcggaacagcgcatgagcatgctgatcggcgagttaaacaaaatcattatgaaacctcttgaagagctttacggcagcccgcaataagctccacacccctccatctatgaaatggaggggtttttttattcaacagaaaaatcaagagaactttttaccgttccgttaatgatgacagacagagtgtgaattccccgataatgcttgcgggtggttaaatctttaagggaatgatgtttgctgaaggcttttacgtctccgttatccatggcggactccgacatcttaaacaccttgcggctgcggtgcccccttttctttacaaaatcaatcgcgtattcaaccctgactttttgccgggcggatgagcggatctgaaaagaaaaatgtatgcttgttccgatggcggccgtttccggattcagtgtaaaacgttccaatgaaatccgggaggcgtcttcaaacccgaaaatcgcaagcgcctgtttgtctcctctttttaacagtgtcctgcaggcgtgcttcaaaacccaatccgtgtgcggacagcttccgaaccgctcggctgcgatctgtgccagaacatccggatgtgttttggagatgtcattcaggttattcgccacgctttttctgacatataacgagtcatcctgcatcaagcggtccagaacagggagaatcggagaaggatcttcaagaagagccggaatggagcttccccacggcagtcgcggtcttgagccttcgctggcaagccttctgacatgttcgtccggatgctccgtccaggaaaggaactctttgaacatccgctcccggtcaagcctgatatacgggcggaccgcaaattcggaagtggaaaaacgagtgaaaaactgaagcgccttcattgattcttcccagtgatccgttccgtactgttggacataatcgggaaaaataatcccggcgagccctgtgaaatggggagctgtctcatataagacgtcaagcgcccgtatgtaatccttcggcagtgtttcatataaagagtctgtgatccggcgcatccgctgttttaacgtcagtccgggccaatcttcctgaaatatcagcgcccggcacttgtcccgctcaaaagccgggtacgccgatttgattctgttcagaagtgcttctgcaaattcttcgttataaatatcttttaatagagacatgacagtcaccgctttttttcttttattatatgcgaatatatgttctctttcaactttatcatacattcagcacagatatttcccctgatttttttagttaaaaaaacccttgttttttaacaatattattgagataataactctgaaagcgcctacacttacagatgatctaaggatacggtcgcctatactgcctggtatgttaaggggtagcaacagagagtaagtgaaacgagcgcatcaacggtcaaataaggggttcctgatatatttcgtaaatagaaatgcacattggggagaaggcagcaaatcgatcgtatcccaacaaaacgacagttcaaagtctgcttgaggcaggcttttttgctgcggagaaaaggttgttctaaacaaagagacagggtcatatcctaatgacaagtacagtcatcaaggagggggacttctctgtgtcaaaacaaatgctggcgttaaatatagacggagcgcttcttcgctccaacggcaaacttcatcagacgacaaaggatgccatcgaatacgtcaagaaaaaagggatttacgtcacactggtcacaaaccgccattttcgctccgctcaaaaagtggcgaaaatattaaagctgaatgcaaaattgattacccacagcggcgcatacatttctgaaaaaatagatgagccgttttttgaaaagaaaatatcagaagatcacacgtttaatatcgttcaggtgctggaaagctatcaatgcaatatccggcttcttcacgaaaaatattcgatcggaaacaagaagaaagtgaactccaatctggtcgggaaaacgatgattcatccgtctgatccgattttttatccggtgcagtttgtcgaatcattaagtgacctgctccttgatgagccggtttcagcgcccgtcattgaagtgcacgctgaagatggcctgcaggctgatataacggatacgataatgaaagcattcccggccgtcgatgtgatccgcgtcaacggagaaaaactgaacatcgtgcctaaaggggtttcaaaagaaagcggactttcgatggtcgccgctgatctcgggctttcaatggaagaggttgtagcgatcggccatcaggaagatgatctgccgatgatcgagctggccggtctcggcgtcgcgatggggaatgcctcaaatgaattaaaaagaaaagcggactgggtgacaaggtcaaatgatgaacagggagtcgcctatatgattaaggaatatttccgcatgcagcaccgcaaaggctttctcgataagttccatatgaaacggccgtaatcaagagccgcagacgcgaaacgccggtctgcggctttttcgcggattgattttagcctgttctttctgtacactaaagaaagttttgaatctgaaaaataaggtgatcacattgcaaataaaaatagacggcataacggatgacaggctgcatcgtccgctgcaaaacatcgcgaatttattttttgaagagtgtgttcttgcgtacggcgaaacggaggcatcctctgatctcgtcatctcacttgccatttctcaagatgcagacagcgtgtcggtatccggagaaatcaaaagaaccggcgaaaaggaacatcacacgaaaccgcttcttgccggatggagcgaaaaagaagtatttaaacaggtgaaaaacacgctgtcatatgtctacttaaatcttcttcaatcacatacgggcatgatacaaaaatggggaatcttaaccggcatcaggcctactaaacttcttcataaaaagctgcagagcggcctgacaaaagaagaggcgcatgccgatctgaaaaaagattatctgatccatgatgaaaaaatcaatctgatgcaggagattgtcgaccgccagctcgctgcggttcccgatctgtaccgggtcaaggatgaagtcagcatttatatcggcattccgttctgcccgacgaagtgcgcctactgcacgtttccggcttatgccattcaaggacaggcgggaagagtcggctcctttttatgggggcttcactatgaaatgcagaaaatcggagaatggctgaagcggcatgatatcaaagtgacgaccatttatttcggcggcggcacgccgacaagcattaccgctgaagaaatggatcttttatatgaagaaatggtccgctctttcccggatgtcgcgaatattagggagattaccgttgaagcgggccgtcccgacacgattacggaggaaaagctggccgttttaaataagtataagattgacagaatcagcatcaacccgcaatcttatgaaaacgaaacgctaaaggccatcggcagacaccatacagttgaagaaaccatcgaaaaataccatctttcccgcaaacacggcatgaataatatcaacatggacctgatcatcggcctgccgggagaagggacggctgagttcaggcacagtcttgaagaaacggaaaagctgatgcctgaatctttgaccgttcatacgctttcttttaaacgggcgtcagaaatgacgagaaacaagcataagtataaagttgccgacaggcaggaagtatcccgcatgatggatgacgccgtccgctggacaaaagagcacggctatacgccgtactacttgtaccggcagaaaaacattctcggaaacctagaaaatgtcggctactctttcccgggtcaggagagcatctacaacattatgattatggaagaagtgcagacgattatcggtatcggctgcggcgcggcaagcaaattcattcatccggaaaccggaaaaatcacgcacttcgccaatccgaaagacccgaaatcatataatgaccgattcgagcattatacagaagagaaaatcaaatacttagatgagatgttcgtcaaatctgcattataatatcaaaaacggcacggaatcagcgtgccgtttttttatgtttaaccgtctgtaaaaacgggaaaagatcatcagactgttattcgcaagaggtgcataatatgtatgatgtcataggagcgggaatcgggccgtttaatttagggcttgccgcattgttagaggatatacccggaacagacgctctttttttcgataaaaagaaagaatttgcgtggcatcccgggctattaattaaaggaacggatttacaggtggcgtttctggcagacctggtcacgctcgccgatccgaaaagccgctacacgtttttaaactttctccatgaacatgaccggctgtaccggttttatacgtttaatgaatttgatattccgagacgggaatttaacgactatttaagctgggcggcttcagaaatcaaatcatgccgtttcggctcagaggtaatcggtgtgaaaaatgccggcggacattatgaagtcagcgtcaagaacattgaggacggaagcatcagtgtctatcagacgaagcatttcgtcatggggacggggtctgaaccgcttattcccgcagagattgatgacggagcgcgtcaggacacgatggtcagcacggaatatttgtttcggaaagacgagctcgccggcgccgaatcaattacagtggtcggctccggacagagcgccgcggagatcttttctgacttattgcatgatgaacaataccgccgcagccggctgcaatgggtgacacgctccgccggatttcgagaattggaaaccgccaagctcgggcaggaaatgtttacacctgattatgtggaatattttaaccgcctgccttttaaagaacggctgaacacactccctgagctggacggactgcgccacggcattgattctgacacacttgccgccatttacgatgccctgtatcacagatcgatcagcggaggttcgcctgacgtgtatattcagccgatggcggagcttgaaaaaattgaaaagcaaaacgggcgctgcgtactgagctttcatcaatggcagatggatgaaacttttacggccgattcagaaaaagtgatattggcgaccggctttaaacctcatattccggaatggtttacggcaattgcccccgatatcgaatgggaggatgagaaacggtttaaagtgacggccgattcccgtcttgtctttaaggacgacaggcggcatcactttttcacattaacgaatcttgatcatgctcacggaacgggcgctacgaatttgaagctgtctgtttacagaaaccaaaaaatcatcaataccattctgggaaaagagcatttctccattaataaaaaaacggcttttcagcaatttcttcccgctcaaaaaaactgacctcttatgaagaggtcagttttttttatgatttctgcggcttcttttcaggcgtcttccatttgaacacgctgttcagcaggagatatatccgcttcgattctttcgtgagcaaagggccgaagatggccagtatcaaaacatataaggcggcgaaaggtttaagtgaagcggacaggccgccggcgatgccgagatttgcgacgataatggagaattcgccgcgggacacaatggtcagcccgatattggacgatgctttatgagaaagccccgcccggcgcccggcgatcatgccggcgataaagtttccggcaatcgtcagcagaacggcgccgagggcaagccataccgcatctccgagtgaaaacggatcaatgctgaggccgaagctgaagaaaaacatggcgccgaaaaagtcacggaacggcacgacaagatgctcaatcctgtcagaatgggccgtctccgaaaatacgagtccgagcaagagcgcgccgatcgcttcagcgacatgaatcgtttcggaaaagccggcaatgaaaaagagcgcggcgaaaatgacgatgacaaatacctcgtttgaacggatatcaagcagcttgttcagcagaggcggcaatttccgggcggcaatgaaaaacagcagcatatatccgaaagcgatcacgattgacatcagcgcgcccccgacagacgtcgcgtctcccagaacaagcccggaaacgacggacaagtaaaccgccagaaagatatcctcaaacataatgatgccgagaatcagctccgtttccggattggccgtgcgctttaagtcgacaagcacctttgcgacaatggcgcttgatgatatcgtgatgacgcccgccaatacaagcacttccaaaaaggaaaagcccgtgataaagccgtagatcagccctaaactgaaattaatcagaatataaatcgttcctccggcggcgattgaacgtccggatttgactaattttccgaccgagaattcaagcccgaggtaaaagaggaggaacaggacgcccatccgtccgaaaaactcaatcacttcccggctttcgataaacgtcaggtcaatgatgcccgcttggggcgcgtgcggcccgacaagcattcctaaaatgatcaggaaggggatgatcgagaatttaattttattggcgatgacactcgcaatggccacaagaactaacgccgtaccgacttcaaatacgagatgatccataaacagatcacactccgtctctggagaggaagtcttggatcagttttttcagatgctttctttcacctgagaggacgagtgtatcgtttgcttcaaggagcgaatcagcgcccgggtttaaaaactttttctggtcatgcttaatgatggcgataaccgtcacgtcatagttttggcgcacatccagttcgccgagcgtccgccctgctgcttttgcccctttttcaactttaaaccattcgataatcagatcgctgaacgccatttcaatcgattcaagcgcctgcggtttgtacaccatcccgccgataattgcggcaatctgtcttgcttccgcatcatcaagtgaaatgcttgccagaagctcatcagggtcgcggtcatcaaatctgtaaatttcccgcctgccgtcatcatgaatgatgatcgtcattttttcatgatttctcgtttcgatttcgaattttttcccgatgccgggcagatcgttttctttaatattcataaaaaatccctccggaatatactgtttttacaccgtaaatacagattggcaatgagaaatggtctgatgccggaggtaatttgactggtattgtatcggaatgacgcatgtcctttccattgtggaatcaatgaattgatcaagaggtttgacagataacagggagatcatccgcgataacgcaccgtatccttttgacaggccttgcggagcggttttggtttgaaccggcgtctttgccgattccgtttcctgcgggtaaaccgaaatttgtacatggctgtctgtttctgtcaccaattgggaaggaagagcgacatccgaaggggggaacagcaccataaaaaagctcagtaataagctgagtatcacatatttcattatcggtgtttttccccccttttgttttgtatatcaatttcactatataaaaatgtatgttcagtttcaaatgatatgcatttttcggcatctgttgaccttgaaaaataaaggagtttcgcttcgggggaaggaatatatcatttgaacaaaatatgtaagcggattcaaggagggagtaaacatgcagtatattcgttatgaagaaaaaggaaagatcgcagagattgtgctgaaccggcctgacaattacaacgcgctgaatgaacaaatgcttcgggaattggaaaatgcatgcgttatggcagccgacagtgaagcgcttatcgtcctcttgcggggggaaggcaggggattttccgcgggcggtgatatccagatgatgacgtctgatcatgattcaggagaatatgaacggctcatgaaaatgattgaatccattacgctgacgctctatgatatgaaaaaaattgtgatagccgccatccacggagccgcggcggggctcgggctgagtttcgcgctgtgcgccgatgtggtgctcgccgaagaaaacgcccgactcgcgatgaatttcatcggcatcggattggttcccgacggtggaggccactatttattaatgagacgcgtcggtgagatcgaagcgaaaaaactgatttggagcggtgaaaaattgccggctgaaaaagcggtgcggcttaagcttgccgacgggctgttcagcggcggccctgcggagggggcacaaccgtatatcgaccgattgctgcatgcgccgctgtcagcgatgattgaaacgaaggctatttatcaaagtctccatatcagccggttaaaagacgttttgtctcttgaacgaaaggcccaggaaaatatgagaaaaacggatgatcataaagagggcatccgcgcctttttagaaaaacggacgccgcaatttaaccggtaaaatacagaagccggaaagcttctgttatctgtggaataaaatcagctttccggcttcatttaccaagcggtgagtactgttctcaagctttttttcctttaacaaagcctctccggcggccttcgcctccgcctcattatctgcttcgatccgttcatccagcatcgtttctcccgacgcatggaatgcggtcaatacatattgtcccatcatgtcaccccctttatagaatgatattctgataaagaatttaaaatcctccattaatttttacccattattagtatataatgggtcaaggaaggagttggattcgtgcttacaattgaaaatgtaacgaaaacattcggcagctttaccgctgttgacaatttgaacctgcaaatacctgaaagggaaatgttcgggctgctcggcgcaaacggcgcgggaaaaacgacgacctttcggatgattttaggtcttttaagcctgactgacgggcatatcacctggaaagggaagccggtcaattattccatcagtgaaaaaatcggctatctcccggaagagcgggggctgtatccgaaagtgaaggtgagtgaccagcttgtctatctggcgagattaaaaggaatgagcaaaaaagaggcggaaaaagagctcatgacatggctcgagcggttcggcattacagattacaagaataagaaagtcgaagagctgtcaaaaggaaaccagcagaaaatccagttcatttcggccgtcctgcataagcctgaactgctgattctcgatgaacctttcagcggtcttgatccggtgaatgtcgagctgctgaaagaagcggttatttctttgaaaaacagcggcgtttccatcgttttttcaagccaccgaatggagcatgtggaagaactttgcgagaatttgtgcattctccagaagggaaaacccgtcgttcaaggcaatctgaaagacattaagcggtctttcggcaaaaaaaatgtcaccgttcattcagatgatgacctcagctttttaaaaacgcatgaaggtgtcgtgaaatggaaggaaacaaatgacggaatcagactgcaggttgcgaatgaaccggtttctcaggatattttccgggcgctgcaagggaaaggttttatacggaagttcgaattggaagagccgtcactgcatgatatttttatagaaaaggtgggggccgtatatgaataaattttggattatgctgtttcatacatataaaaacaaaatcgcgacaaagtcattcattatttcgaccgccattaccgttttattagtattagcggtgaccaacctgcaatcgattatttccgtgtttcaatcggatgacggcaagcagcaaatcgcggtgattgatgaaacgggcgggctgtacccggcgtttgcaaaacagcttaaagcggcggatacagacaatgatctgcaggcaatggagacgaaggagtccgaaaaagatgccgtaaagcgtgtcaaagacggtgaatgggacggactgtttatcatcagacaagatcaaaaaggaacgataacaggagcatacaaggcgctgaccatttccgatgaatcagcgtataaactgctcaagcaggctttaacccagacaaaaaccgctgtcgaaaccgccaagctcggcatttcggcagaaaaagtcagcagcctctacactccgccggaagtcagcaaagacgcgctggaaaaaggggcgaaatctgaggaagagctcggtcaggtaatggggcttgtatacatcatgctgtttgtcatctacttctcagttatcatgtacgcaagcatgattgcgatggaagtggcgacggaaaaatcgtcccgcgtcatggaaattttaatttcaagcatgccgccgattcagcagatgtttgccaaactgttcggtatcgcgctcgtggggatcacacagtttgcggtgctgattgcagcgggttatctctcactgaagctgaaccctcataatgatgcgtcgtcgccgatcagtgcatttctcaattttacggatgttcctgtctcgacgatagtctatgccgtcattttctatttgctcggctattttctttacgcgacgcttgccgcgtttctcggcagtgttgtcagccggatagaggacgtacagcagacgattcagccgatggtttttttagtcgcggcaggtttttttatcgccatgttcggacttggcaatcctgacgcgggttttattaccgttacatcttacattccgtttttcacgccgatgattatgtttttacgcgtcgggatgctcgatatcccgttttggcaggctgcggccggaatcgccctgacactggtcactatcgtgatctttgcggcggtcggcgcgaaaatttacaaaggcggcgttttgatttacggaaacgccagcggattcaaagcgatcaaacaagcgctgcgcatctccaaaaaataagtgaaacagcccgggacagccgggctgtttttttattttgcagaacgtgcattcgtataaaaacggtgctaaaataagggtaattcaatctgcagaaaggggagggcgagatggctgatctgacgtttattcatgccgctgacctgcatctggacagcccgttttacggcatttcgaatctgcctgaaccggtatatgcgcgtattaaagaaagcacatttcacagcgtccgccgtctgacggacggggcactccgggagcaggcagatttcgtgctgctttcgggggatctgtttgacgaagccaacagaagtttaaaagcccagctgtttttgagaaaacagtttacgagattacaggaagcgggtatccaagtgttcgtcatattcggcaaccatgatcatttgggcggtaagtggacgccgattgaatggccggaaaatgtacatatattcacctcgggtacaccggaggaaaagtctttctttaaaaacggagagcttgcggcaagcatatacggatgcagctatcaggaaagaagcgtaacggtcaatcaggcggcccgttaccggaaaatgaccggcgcgccttatcatatcggcatgctccacggcatgttatcaggagcggaagggcatgacccgtactgcccgtttacgaaagaagaccttgaaaaaagcggcatggattactgggcgctcggacacattcataaacggcaggttctgtccgcccagcatcccgccgctatttaccccgggaatattcaagcccggcatttaaaagaaaccgggcctaagggatattatctcgtccgggcggcaaacggtgagatgtcttgggaattcaaagaagcgcatgatgtgttatgggaggaaattgatcttgatatctccggagctgaacatatgacttcacttctgaaagccgcatcggatacattctccggcttgcgcgcggcgggccgcccggcatgtgtcaggctggtgcttcgcggcgcggcgccccgcttttggacggaggcgcccgcaggcatcgcagaggagtttctttccgctttacaggaggaagaggccgaagaggaatgtttcgtctggccgctcgcgcttgaggatcggacggatgatacagacagcgtgccgcccgatccgttttttaaagggctgcttcaggacatagaacaatgcgcagacatgagcggtgtatttgaagcccttgagcgtcaccccgtataccggcgtcagatcacttcatttacagatgaagagatactggatattaagcaacaggctcaagccgttttaagacgccagatgaaggagattcagcgatgaaaataacggcgatgcatatttaccaatacggaaaattttccgaccgaagttttcagctgtcagattctcccgtgcaagtgatctacggattaaatgaagcgggcaaaacgacattgatgtcctttatcaaaagcgtgctgttcggttttccgaaatcaaaaaaatacgaaccgaaaaacggcggggtttacggcggcactgtggaattgaagcatggcgatcacggtgccgtcaaaatcgaacggacaaaaggtgctgccgaaaaagtaagagtgtatacggcttcaggcgaaatcaaggacggagaatggctcaaacagcttctttccgatacagatcgggcgctgtacgaagcgatctattcgttcgatgtattcggactgcaggagattcaagcttttaaccgggacaaaatcggcgagtttctcctgtattcgagcttattcgggtcggaagcggcggcaaagcttgacgggcggctggcaaaagaacttgacaggatgtataagccgaacgggcggaacccccgcttaaatcaggagttggatacattaaagcggctcagcgcccagctgaaacaggcggaagctgcagaagcgggctatcacagccttctggaagagaaaaaaagcgccggcggccgtttgcaggatgccgaagcacgattgaaagacataactgaagaaatcaaaacagtaaaatcggcgatagaagcaaagccgatcgcagacaaaaaaacagccttggaaagcgaactttcttcttatccggaagcattgaagcaattcccgaaggacggaatgcatcagcttgaaaaatacgaatcgcatctccatccgaaagcggcccgtcttgaggggcttcgggcaaaagcggctgaactcaggcggcaggctgagctgctcgctccaaatgaggacttgctgcaaacagagcggcagctgcaggagctttccggcgagcagcatatgtacgaatcgcgcggtgaacagcttgccgccatccaatcacagatccggcagacatctgcccgtgtttcgtcaggattgcagcagctcggaagacatgaggaagacggcattctttcgctgaacaccgattatgaatatgaatggcggctgcaggaagccgtgcagagcgccggacaggcaagagaaagaaagacacagcttgatgcgattttcgaacaagcgcggctggagctggaagaagccgaacgaaaacatgccttgacggcggaaaacattttggaccccgctgtcaggaaagaaaaagaagccgctttacaatcatataagcaaacagctgatacagaaggaaacgaatggcaggcacatgtacagcagctggaaaaacagcgcgccaaacaaaaaaagctctttctcggtgcgggcattctgttcattgcgattttcgctatgttaaaggaatggctgcccgccgccctttttaccggcgctctgctgctgtatatgctgtccggcatacaaaagccgctgccgtcagaaagaggagggcccggacacaagaaaaagaagccgacgatctccaaagaagcggctgatcttctgcaggaagagctttggcgtgacggccggcaccggcagcagctgattgcggatcaagccgtgcttgaacagaaagaaacggcatatgaaagagtcatccgccaatatgaagaatgggaggcggaaatggcgccgtctgaaaaacaggcggaactttttatgaaggaactggggttttcaggaagtccttcccatcttcttgacgcatatcatgtgatgaaagatgtcaaaaaagaaatccttaacaagcatgagctgaccattgaagcgggccggctgcaaaagctgcaaagagcatttgaggaccgggtcaaaaagctgagtccttcagacggaagggagctgtccgtaaaagaaagactgcgcgttttgctggtacaggcggaacgagcccgtgaggaagcaaaacgaaagcaggcgctcgaaacggatctgctgcatgcacaagagcaaatgcgtgaattaaacgaagaagtccattactacgaacagcaggtcaaacagcttttcatggcggcaggcgcaaaaaaccgcgaacacttttgtgaactcgccaggctgaatgaaagccgccgggaaacagagcggcagctgcgcgaaatcaaaacgcacttgtccggcataggcggaaaacagcttgagccatttatgagccgcacagtgtccgaacttgaacatacagtcgttcagaaggaaacagagaaaaaaacgcttgaggaaaaaagcgcgcagctccgtgagaaaaccgctttattaacggtgaaacaagagcagctggagtcctcggggcttgtatccgatttaaaacagcagacagaaatgcagaaggagcgtgtgaaaaaaaccgctaaagagtgggccgcattacagacggtcagacacatcatcagggaaaaaatggagcggcataaaaaagtgacgcttccccgtctgttagaaaccgccggtgcattatacggaccgcttacggacggacgctaccacaaattgtatttctccgaggcggatgattccattatggtcatgcggaaagacggaacggtgttttctgcaggcgaactctcacaggcggcatgcgagcagctttatgcggcgatccgtttcgcccttgcgtcagagagggaatctgcggtatcacttccgtttttacttgatgacagttttgtccattttgacaggcagcggctggagcggctgtttgatgtgctgaatcagctttcagaaggcgggcggcagatactttatttcacctgccatgagcatgtcagccggtcttttcacagcggacaagtcatgcggctcctgtcataaaagagtttattttcaaaaaagaggtatgtgctatactggtattatgtaagatatggagggagcttttaatagaatggcaaaaggtattatgctgcacgaggtcggcgagcaggtcgatcaatactttctgattaaatcttcgactaagggaatcgcaagcaacgggaaaccattcctgacgttaatgctgcaggaccaatcgggagatatcgaagcgaagctgtgggatgccaagccgactgatgaagtaacgtacgcggcgcagacgatcgtgaaggtgatcggagatgtccatcactatcgcggacgaaaccagcttaagctgagaaacatccggccggccggcgagaacgaaaatgtcagcattgatgattttctggaaacggcgccgattccgaaaaatgaaatgatggaaaccgtcactcaatacatttttgaaatgaaaaatccaaatatccagcggatcacaagacatctggtcaaaaaatatgcggctgagtttatggattacccggcggcggctaaaaaccaccatgagttcgtctccgggctcgcgtatcatgtagtgtccatgctgaacctggcaaaagcgattgccgatctgtatccgtctcttgaccgggatttactgtatgccggagtcattctgcatgatctcggcaaagtaaaagagctttcaggccccgtctccacgacgtacaccgtggaagggaatctgctcgggcacatttcgatcatggtgacagagctttcaaaagcggccgaagagcttcagattgacgctgaagaagtgctgattctgaagcatttgattttaagccatcacggaaaagcggaatggggaagcccgaaaccgccgatggtgaaagaagcggaaattctgcactacattgacaatctggatgcaaaaatgatcatgatggacagagcgctggaacgggtgaagccgggcgaatacacagagcgtgtatttgcgcttgaaaaccgttctttctacaaaccgacgttccatcaataagataaaaaggccgattctctatgatcggtcttttttacgttcagctctcataacttgtctttatcaagcatagcttagaataaagactctgggtgaaaaagggaggaaaccgacgtgctattttttccttggtgggtatacctttgcattatcggaattattttcagcgcctataagcttttcacaacagctaaagaagaggaaaagcttgaccagtcgtttattgaaaaagaaggaagggtgtatattgaacggatggaacaggaacgcgagcgccgtatggcggcgcccgcaagtgaaaacgcggatgcggaagaaaactccaatcattccatcgcataaaaaaactgtgcggctcgccgagagcccgcacaatttttttatttagattcagaagaagttgaagtgttaaacgtgtcttttaagtctttgtcttccacttttacgtcagcttttttcatgactttttgaattgccgcctgtacagctgagttgtcgtttaatttctgtttaagaacttcttctttcagttcttttttcatgtcatcatatttgccgcgttcttctgtctttttgatgatatgataaccgaattttgttttgaccggatcgctgacttgtccgactttcagaccgaatgcagctttgctgaatgtttcatccattgactttttatcgaaccagccaaggtcgccgccgttgtcttttgagttgtcagttgaatattctttcgcaagcgtttcaaacttctcgccttttttcagctttttctccacttcgtcagctgtctttttgtcagcgacaaggatgtggctcgcacggattttaccttttaagccgtcgtaatattctttcgtatcagcgtcagtcactttgatgttgtctttcgccgctttttgtgcaagcagttcgtacttcacctgatctttcaggtaatcttcgccgtactgctgtttaagggcgctgtactgatcgccgagctgcgttttgtactctttcagcttgttatcgatttctttatccgatactttgtatttttttgctaatactttttcttgtacgagctgtgtcagcacacttgcgcccgcggtttttttcatattcgtgtagagctcgccttttgttacatttccggcatccgtcttggcaatcacgtcgttgtcgccgctgctgcaagcgctgagagccaggacgctcgttgccgtaatagctgctatcgcgattttcttcattcctttaaacactcctaatcatccaaattaaattgcatatgcgtatcataacatattgtggctttctgtaaaaagattttaaataaagggcattcgtctagtcaaactttttcctgatacatacaaatatattgatcatgaaaaggaggtaatgaaccatgggcggaggatattcaaacggtttcgcactgctcgtagtactgttcatattgcttatcatcgtaggtgcagcttacatttgttaagcgaaacggatcgctttttctaaaagcggtccgttttcttacccgggcgcctaatcgtttcagaagtaaattgcatatgatgtaattggaaaaataaaacgttttgtaggaggtgcttttggagatgggtgaagtatttgcaggcggttttgcattattggttgttctgttcatcttattgatcatcatcggcgcttcttggctttattaagaaaaaaatatggctgtcgggggtcagacctccgtcagccatatttttttgcctgtttacacagtaaaggagatctcgacgaatgaagagatcagtaaaattaaaatagatacattaataaaacggaataccttatcctgccggtcttcaggaatctctctgacaaggcataatgtatttgtgagcctgtttatgaaataaagaataaacagggcagccacgataaaatagaataaaatgatgggagattccccctctctctgaactgctcccatattacattaccaaatatttattaaaaaagatagaatgtaacctgaaaaatcagcgggatatcaagactccggcactttttttactaatatatcaaaaccgtcggattcctggtcaatcagacatgatttgggcgctttgaccaggtgcagcgcaaacagaagatcaggcaggcaataacccgcatgaatgctcgaaatcatataaaagtaatgagcgtgtctcggaaatgccagtccggcataaaacaataacggcgtaatgaataaaaacgggctgatcgtagaaatcagcatcgtcgttttcggtatgcctttccaagtcggcatccgcaagaagtacattttcatttccttttttctttttttacagatcatcggcaggacatgtatgactttatgtacaaataaagtaacaacgagcagaacacaaaaagcaaacacgtgcccgtcacttaaactgatattcggacgcagcagcccgaatgccaagaagttgcatataaaaaacaggatcataaaacctacagcagtcaataataaacgaaccgcaccataatctttgatcagattaatggttttccagcaattcatcagagtcatccttccgtacaaagatggaatacaatctcaaaataatttactctcttcaggagaaaaaatcaatccttttttaaagaaaaaaaataaccccggaaagggaagaacagaagagctcggtgaaacatggaaatgtacggtttaacctttcttctctattcattatcagctaaaataagattaaagatagaaagaagtgaaacggatggattcaatggatcagcgtatcgggcgtttagaatattacatacaattgctggtgaaaacggtggatatggataagtaccctttttatgcgatgatgattgaaaaagggctgaccgaagaagaaggagaagaggtcgggcggatctgccgcgaattggaggacgagctgaagtcgcaaaaagcgcaaggctttgtgacgtttgacaagctccttgcgctttttgcgggacagctgaacgaaaaattagatgttcatgaaacgatttttgctctgtatgagcaggggctttatacagcgctgatggaagaatttattgagattatgaagcactttgattaactgttgatcggttccagctcttcagccgttttatggacagccgattcgtccgtttttttcttcagccttccgtcttcactatcaaaatcattgtttatgtttgtcaatgatttctcgaatatctccataaaatcctcgccgtaaatgtggcggatgacacaggttaattcttcaacttccggaaacttcccgaataagtggtagatcggctgtgagcctttaaacaccgcgtttctcgacgggtcaaactcctcaagcaggctttcgaatacattttccccttcttctgttaactgaatgtacgtgttccgtttatcattcagccgcttggaaaatttcagatatccccgttcttcaagcttttttgaaaagttaaatgcagttgatacgtgcataacgccgaatttggcgatttctgaaatagaagctcctttaagctgataggcaatccataatatatgatgctcattaatattaaggtcgtacggcttcagccaattctgccagtctttctcgatagatttccagagcgctttggacagctgcgccattttttgggtatagattaaagcttcttttagatcgtaaggcggttcaacacgattcaatacagatcacctgcttcacattttcttttcctctattatgccaataaaataaagattaataaagatgaaaatttaagaattttataataaattcttcatccgttgctgggaaaggctttaaaccgcaaaaaaaagtgcggaacgcaatatgtccgcactttttttggttgtataggatattagttttgtaaggttttctccagctgtctgattttctcttcaatatcagcgatttccttttggagatcctgctggtgcggcttgatttcctcctgccaccttttaatgctggtctgaagctctccgcctacgtctttaatgacttctgcactttctttcgccgtttggacaagctggtccttaagcgccattccgtctttttttaaccgtttgattgtgtcctcaattgaattgcaatttgctttgattttgccccgcagctcttttccggatgaaggagccgaaagtaacaccgctgcgcctccgatcaatccgcctacgaaaaggcctgttaaaagggaacgtccgtcagccatttgaaatcaccccgttttttttctcataacttttatcatttttgttcagaagaataaacttctatacatagcttgctttattttagcatattttttaagggaaaaggagggagaaggttgtctgtctttatgattgttttatcttgtatggctcttgtctttgcggcgggcgccgtttattacctgaaactgctcggccaggccgcttcttatccgccgaagcgggtcgtccgccaaaaggccatcgtctgctcagcaggaaccgccctcacattgttccttatctttttcacaaaacttctcgtataaaacatgctgaaacacattaaaaaacctcttccggccggaagaggtttcggtatgcggttatttcaccgtttcaatcatattggaccgttttaagatcgtctgcacaatcggatgcataatgataatggcgatcgcattcagcgcagccgccggaaggacgaccgcgagcaccaaggcggtgaatccgcccggcaggccgacaatcagaagggccagcgccaaaaagagcaaaccggagatgaaggtgccggctattgtaatgacggcggcggccgctgttttcacgctctttttcactaaaagcaccagcgcgagaaacagaaacgccgttaccggtttttcaatgatattcggaagctgtccgcccggaaaagatgtcgtgagtgcggaaataattcccgttacaatcccgatcatcagcacgttctgcacacgggggaataacagaatacccataaacatcatcacaagcatcatatcgggcttcattccgaataataccggcggcataatggaatgaagcaccgctccgattgccgcaaacagggccataatgactaattcttttgttttcatactaagctctcctctgctaagctttttcgccatccaataatatgctcgtcatttattgcgatggccggaaaaattgatatgcaaacagtatatcaaaggaaccgttatgttagaagaaatttattcgttttcctgctggaactttttcataaactgagccagtttttcacaatcagccaggctgacggcgttgtagatagacgccctgcatcctccgactgagcggtggcctccgagtccggtcattttagccgctttcgcttcttcaacgaattttttcgtgagactgctgtcgcggagggtgaatgtgacgttcatgtgagaacggctgtcttttgcggcatgccccgcgtaaaacccgccgcttgcgtcgattgtgccgtacaggacgtcggccttttcctgattgcgccgttcagccgcttcgacacctccgttttcagccagccattcaaggacgaggctcagcatataaatcgcaaatgtaggcggcgtattatacagtgaatcggcttttgtatgtgtggagtatttcaaaattttagggacgttggcgttttcgttttcaagccatgattttttcatgatgacgaccgtgacgccggacggaccgaggtttttctgggcgccgccatagatgacatcaaacgttttgacatcaatttttctgctcaggatgtcgcttgacatgtcggctacgagcgggatcggtgaattcgggaactctttccactgcgttccgaaaatcgtgttgttggacgtaatatgcaggtaggcgccgtctttgattcctgtgaggtccgcttccggtatgtggttatggtttgaatctgcgcttgttgccgtgacggatgtgtttccgaacagtttcgcctcggcgagcgctttttcagaccatgcgcccgttacgacgaagtgcgccgtttgctgcgacgttaaaaagttcatcggcagcatggagaattgaaggcttgcgccgccttgaagaaataaaatatcataatcgtcgggaatatccatcagttctttcagaaggctttttgctttttgatgcaccgcatcatattctttgctccggtgggacagctccatgacggacatgccggtgtcattgaagttgacaaattctttctgtgctttttgcagcacatccagtggaagggctgcgggtcctgcattgaaattcgttgtacgttccatgtttacgatctctccctgttttccgctttagtgtaagaaataatacaattatcctatcacaattttttgatttttttgatatgaaaaaatataattttatgttttttgtgtttccggacgcaaaaaaacctcatctttaagatgaggcaagccgttttctgacggttgaagcgatctcctgaagatcgtcaggcgtatagtcttcggcgtgtgtcttccagacagccccgaaaccgtcgccttttccgtaacgcggaatgatatgcatgtgaaaatggaacaccgattggcccgctttttcaccgttgttattgagaatattcagcccgatcggctcgaattcatcgcggatggcgcgtgcaactttcggcaccgcttcgaaatattctttagaaagctcaggcgtaaactcgtacacgttttcaatatgtgttttcgggatcacgagcgtatggccttttgtgacctggctgatatcaagaaacgccacaacatgttcattttcgtatacttttgaagacggaatgtcaccggcaatgattttgcagaaaatacaatcgtccgctttgtgcatagatgggtttcctccctgaaaagaaatatatgtatattctcatcgtaccacaaaaacggccaaaacaaaaaacagggtgaacggctgcgcgttcaccctgatgcagaagtacgagctttatcacagaaaattaaatatgccttttgtaagcacctcatttgtttttaaaatgaagacttatgggtctgcttaatcattcctgggacaaacacctcatttgattatttcatcatgaatgaagaacatcatcaaagcagtgtgtgaagaaattgtaagcacaggacatgttgattttcatccaactgttctaagacgtcttttataaacacctcattttcagttgattaaagctgtttccttctacatacatatgatgtccgccaaaacgataactatgcacgcttttcacgtgagaaaaaaagggaatcgtttcaaatcagactttatttttggtactatgaagaaaaacgaatcagaaggggagaaattatgtctctgctatcggtaaaagacttaaccggcggttatacgagaaacccggtcttaaaaaatgtttcattcacccttgagccgaaccagattgtcggactcatcggattaaacggcgcgggcaaaagcacgacgatccggcatattatcggattaatggacccgcataaaggctcgatcgagctgaacggcaagacgttttcggaggataaggaaagctaccgctcgcaatttacgtacatccccgaaacgccgatgctgtatgaagaactgacgctcaaagagcatctggagctgacggccatggcgtacggcctttccaaagaaacgcttgaaaaaaggcttcctccgcttctgaaagaattcagaatggaaaaaaggctgaaatggtttcccgctcacttttccaaagggatgaagcagaaggtcatgatcatgtgcgcgtttctcgcggagccttcgctttatatcattgacgagccgttcctcggccttgacccgctggcgatcaatgcattgctggagcggatggacgccgcgaaaaaagccggatcaagcgtgctgatgtcaacccatatcctggctacggcagagcgctactgtgatgctttcattattttacataacggcgaagtgcgggcaagcggcacactggaagaactgagagagcagttcggcatgaaagacgcagctcttgatgacttgtatattgaactgacgaaggaagacgccggccatgaataatatgtctactatttggcagtcccggcttgaagagcatataaaggaaaccagaatgtatatgaaatatatgctcaatgatcatctcgtcattgtgctgatcttttttattgccggcgcggcgagctggtacagcaagtgggtcaaagacattcccgttcattttccctcattttgggtgatggcggtgctcttttcatttgtgctgaccggttcatacgtccggacactgttaaaggaagcggacctcgtgtttctgctgccgcttgaaccgaaaatggggacatactttaagcattcatttaagtacagctatctgtcacagctgtttccgcttattgctctgtcgcttgtatgcatgcctctgtttttcgctgtaagtccgggggcgtcgcttgcgtcgtatgccgcagtatttattcagatgctggcggtaaaagcgtggaatcaggccatggagtggcggatgacgtttatgaatgacagaagcatgaaaatgatggatgcggtcatacgctttatctgcaatatgctgcttttatacttcgtcttacagtcgttttatgtgtacgctgccgccgtctacattgtgatggccggcctttatgtgtatttcacatcggccgcaaaacataaatcattaaaatgggaagctcatattgaatatgaattaagaaggaagcagcggttttacagaatcgccaatctgtttaccgatgtgcctcacctgaaaaaacaggcaaaacgccgggcgtatctcgactttttgctcagaatgattccgtttgagcagcggaaaacgttctcctatatgtatgcgcgggcctttctgcgttcaaatgattatctcggcattcaggtcaggctcacgattatttttatcctgattattatgctcgtttccgccaatccgtggatcacggcggcgttaaccgtatttaccgtctttattacgggaatacagcttcttccgctgttcgggcattttcatcatctttctctgcaggagctttacccggtcaatcagaaagcgaagctgcaaagtttcttttcgctgatgaaatcagcattaaccgtgcaggcgctgctgttctgtgcagcgtcagcctatgccgcgggagtcagcggggcgctgtatgcggccgttgcttcagccgttctgatttttgtgatcatgccttcgtatatgggcggaagattgaaaaagtacggcaagctgtaatcaatcgggtttttgaaacctcaatgaaagaaggagacacagatgaccgacgatcagcagctgatacaggaagcactgcaatggaaagcgcgttttttgcgcaaggattctatgcttgaacgcttttctaaaggaatgcaggcgaaaataaatgagcggattcccgataaaattcatgccgtcatcacagaaagcattaaaaaaatgaccgaagcaacaatgacgggttcaaatctggtgaaaagcaagcgggatacaaacggtatgacgcttgctgaaaaagatgccctcgccagacaaaccatcgcatcgtaccaaaaggtcgcggcagccgaaggtatcggtacgggggccggcggaatttttttagggatggctgattttcctttgctgctatccattaaaatgaaatgtctgttcgatcttgcctccatttacggctatgatgtgaaagacagggatgagcgattgttcttgctgtttatttttcagctggctttctcaagcggtgaacagcggaaacgcatatactcaatgattgaacagtgggattcgaaaaagcatgatgtcgattggagagtttttcagcaggaataccgcgattatctggacgtggtgaaattgtttcagcttttgccggtcgtcggagccgccgtgggcggagcggccaattataaactgctgtcacagctcggtgagacggcaaggcacgtttttcatttaagaatcacaacagccggtacgtaatgtaccggctgttttttatgtcagcgggggtagcttaccgcggcgccgataagcaccttggcggccgtcagcatcgctttttcattaaaatcaaatttcgggtggtgatgaggataaatggtttccgcattttctaaagcggcgcccgtaaagaaaaaagcgccttttgtatgctgcagataataggaaaaatcctctcccgccatttgcggctctccttcaacgactttcgtaacgccgtctgtttccgctgcggctgccgccgcgtgcgccgcttcctcaggatgattgacgacggcgggatagccgcgtttgaaacgatattcataggaagcggagtgcatggagcagattccttttacgacggcttctatttctgcttcgagcaggctgcgcacactttcgtcaaatgagcggacggtgcctgatatgactgcctgatcggcaatcgcattaaacggattttcagcggtgaacgagccggctgagatgacggccggctgcaccggatttacccgccggctgacgatatgctgaagagccgtgacgatttgtgagccgattaaaacggcgtctttcgtatcgtgagggatcgcaccgtggccgcctttgccgatgactttaatcgtaaaaccgtcagcggcggccattactgggcccgggcggcataagaccgttccgacgggttcagtcgcccataggtgtgtgccgaaaatggcatcgacatgttcgaggcagccgtcctcaatcattgcttttgctccgccgggagataattcctcagcgtgctggtggatcatcacaaatgaccctttcagtttttcccggttgcggtacagcacttttccggccgcgaggagagccgccgtatggccgtcatgcccgcaggcgtgcatgacgccgggaatttgtgaagcatagggcacatctttttcatcctgtatcggcaaagcgtcaaaatcagctctgagtgccacgaccggtcccggttcactgccttcaatacaggctgtgacaccgttgcccccgacattcgtccggatagggacgccgagcttttcataaaatgaggcgatgaacgccggtgtttttttctccttaaaggatggctcgggattcatgtgaaggtgacgcctgatttcaaccatttcctcatacagcccgtcaagctgagcgtttaagcttttttgaagtgtcgttaacgtcaaaagcgatgccccctcgtctgcttttcccatgattgtatagaaaatatcagaagatttcaatctttttgctacgggagaatgatgatggcggcgatcgtcgtgacgataagtccggccgcaaccgggataaagtttttcctggcaagctcaaacgggtcaactttacaaatagccgcagcgggaatcagtgcccaagggaccaatgttccgcccccgacccagatcgctgaaatctggcccagcgccgttaaaacggccgggtccgtatgaagcgcggcagaaaacagctttgccatcgagcctgcaagagatataccggaaaacccagacccgtcgagcccggtaatcgcacccactgcggccagtgcgatgccggcgaattctccggacatcggaaaagaatgggacagggccagtccaaggtcattgacgatccccgcagaccctttcggcagcggggtgttcaaaatatttttaaaccccgcgtcaccgagataaaagaaggccgcgatcggaatgacggggccgaatactttaaagccgaattgaaaaccgccgataaaatactcggtgatcttttctaaatgccgctctttatatacaatgaaatgaatgatcaggagaatgccgatcgcggttcctccgacgagtgccgtcgcatcgtttccttggaggcggtatacgatcatgcagataatatcggcgagaaaaacaagcggaatgaaaaccgccaggatcaccctgagttttttcggcagatacatacttgtgtccaaagaaccagagctgtccaaggagagggggccttcgttttttttcgatcccgcatgatgaggaagaaagcggtgattgtcgtcgttaaccccatgatcaaaacgagcggaatacttgcctgcatgacatcgctcacgggaatgcccgcggcgtcggccgttaatttcggggccgcctgaatgacgtaatcgcccgataaagcgaatccgtggccgaacaggttcatcgccatagccgcggcgatcggagaaaggcccgcccggatcgctgcgggaagcagcacagcgccgatcagcgccaccccgggtgacggccagaaaaaaagagagatggcaaacatcagacagccgataacccaatacgcgacagccggccctttcatcagctttgcaaacggagaaatcatcgcttcattaataccggtttcggtcaaaaggccgctcatcgccacgataaaacaaatgatgaaaatcgtcggcagcaattctccggcggcatacgtaaagctgtgaaacaggctgctgaccgaagcggagaatgaatgcgtcgtccatagcgcaatcacaaaaatgccggcgagtgaaataaaggttgtatcttttctgagaagcataaaaacgataatggccgcgataaaagcaacataaagcagatgtaccgagtagacgccgatccccaattgaaccactccgtttataaataggattgctacagggtattcataggcgggcggaaggtgcaaagaaggatgcgtaaaatcgggacatcaaaaaagccggagaatctccggcggttttcagtctattgcgtaataagcggttacataagacggacgggaaaaaatagacgtcgtgtcgataccggcagatgttccgcgttttttatgagcttcctgataagagtttgactgctgccaatcctgaaaggctttttcctcttcccacagggtcaaaatgacatacgtatcgccttcgagcggtcttaatacgcggatggctttaaaaccgggttcattttccactttgccggcgcggtttttaaaccggttttcaaacagcggacggccttcctgggtaacggcgatgttgttgaggacggcgtagcccggatttttgatttccccgacgctgtcgatgctttcataggaatggggcgcctgaaaaacggtttctccatttgtttcatgaattaaaaccgcattatcctccccttgcatcagcaccatattctcactcgggtgtttcttggcaatcgtctttaaaaaatcggctgtcccgtatgtaatataaaccttcatatcagccacctcctgcttgctagtatatcaaaagagtggtataagtttctattggcgactcattctgacataattcgaaacaatatttcccatactacaagttaagaaaggcgaggtgacttatgctgaaaaagaaaaaaagattctttattccggctgtaattgcggcggcaaccgcttttctcgcgttaatcggatacattatcattatatttctcggccattatgtcatcgatgaaaagaaattaatactgcatgcatcttcaaaaatcgtcgatcaaaacggtgatgaaatcgcgagcctctatacggaaaatcgcgagccggtatccattcagcaggttccggaagatgtgagagatgcctttatcgccgttgaagataaacggttttacgaacatcacggcattgatgtgaagtctgtcggccgggcggtgttccgggacgttttagcaggcggcaaggtggagggcggaagcacgatcacccagcagctggcgaaaaacatttttctgactcatgataaaacatttttgcgcaagacgaaggaagtcattatcgccatcaatcttgagcgtgattacagcaaggacaagctgcttgaaatgtacctgaaccagctttatttcggccatggcgtttacggcattcaagccgcgtcccactactactttaataaagaagtaaaagatttaaccgttgcagaaggagccgttctggcagcgattccgaaggcgccatctctttattcgccgattcagcatccggataaaaataaagaacgccgcgatacgattcttgcaatgatgaacgatcaaggctatatcagcgccaaggaagccgtcagagcccagggccggacattggggcttaatgtcaagaaaacatcagaaacgccttggtttgacagttatatcgatcttgtcatcaaggaggcggaagaccgttattcgatgtcaggagaacagctgcttcaaggcggctatacgatccggacgtcacttgattccaagctgcagaaaacggcatataccctcatgaaggaaagcggctattttccggggacggatcaggcggcagagggaagcgccgtctttattgataataaaaccggaggcgtgcgcgcggcggtcggcgggcgcgactatgtggcaaaaggatacaacagggttacggcgaagcggcagccgggctcaacgtttaagccgattgccgtatacgggcccgccatgcaggaagacaagttcaaaccgtattcgcttctccaagacaaactgacgtcctacgacgggtatgaaccgaaaaattatgacggacagtacaagggggaagtgacgatgcaggatgcgatcacttacagcataaatgcgcccgctgtctggacattgaagcagatcggcgtggatacgggaaaatcgtatcttgagaaaaacggcatgaacatttctgacaacggactcgcgattgcgctgggcggtctgtctgaaggcgtcactccgcttcagcttgccggagcttatcatacctttgcggcaaacggaatgtatacgaagccattttttatagagaacatcacggacgaagacggagaaacgttatccgggcctaaaaacggcaaaacgcgcgtcttcagcggacagacggcatggaatatgacgagaatgcttcagcaggttgtaaaagaaggaaccgcttcacaaggcagctatcaaggtgacctggcggggaaaaccggcacgaccacatttaccggcatccccggcgcgacaaaggacgcctggtttgcgggatacactcccggactgacgggagccgtctggatgggctatgacaaaacggataaaacccattacctgaaaggcggcagccaatacccggtcagactctttaaagatatcgtcacaaaagcgggtgaaaacggccggacattcaaaaagcctgaaaatgtgaaggaactgggcagcccgattgagctggaggcggtaaaatccctgtcggcccgttatacatttaaggcgatgggactgattacggttcaattaaaatgggatattcaaaaggatgatcgggttgtttaccgaatatatgagaagaaagacggaaaagacaagcttctggattcggtgaaaggaaaaggcagctttgacataccgtacgccaatctgttttcaggggcttcatacaaagtcgttccatataattcacagacgaatcaagaaggagagggaacggaatacgttcagccgaagcttttttcttcttaatcatgaattcggcgattttttgaacattaagcctcaattctataccattcagaaaaaacaaggtatagtgtaatgggcgaagaacacgaacgtatggttgcaggaggaaaggtggaaattcagatgagtaaacgagaagcgtttaatgatacgtttttaaaagcggcacggggagaaaaaacaaatcacgtccctgtctggtacatgagacaggcggggaggtctcagccggaataccgcaagctgaaagaaaaatacggcttagtcgaaattacgcatcagcccgagctgtgcgcgtatgtgacgaggctcccggtcgagcagtacggagtggacgctgccattttatataaagatattatgacgcctcttccttatatcggagtggatgttgaaataaaaaacggaatcggcccggtgatcgatcagccggtgcgctctgctgcggatattgaaaagctcggcgaactgaatcccgaacaggatgttccttacgtgctggaaacgatccgattactcgtaaacgaacagctgaatgttccgctcatcggtttttcgggagcgccttttacgctggccagttatatgattgaaggcgggccttctaaaaattacaacaaaacaaaagcgtttatgcacagtatgccgcaagcgtggcaaatgctgatggacaagctcgcggacatgattatcgtttatgtaaaagcgcagattaatgccggcgcaaaagccattcagatttttgattcatgggtcggcgcgctgaaccgcgaagattaccggcagtttataaaaccggtgatggacagaatattccgggagctttcagcagagcaagttccgctgatcatgttcggcgtaggcgcaagccacctggccggggattggcatgaccttcctcttgatgtcgtcggtcttgattggagactcggcatagatgacgccagaaaacaaggcattacaaaaacggttcagggcaatcttgatccgtcgcttcttcttgcgccttgggaagtcatcgagaaaaaagcgaaagcgatacttgatcaaggcatgaaaacggacgggtttattttcaatttagggcacggcgtattccctgatgtcaatccggcaacgctgaaaaagctgacggcgtttgtacatgaatactccgcggcccaaaaaacggaacaatcttcctgagcagatcgttggttataagaagattttcctgtcaaaatcaagatagacagaccatcaaaagaggtgtttaactaaatgagcagcaaaaagaaaatgggacttctcgtcatggcttacggaacgccttacaaagaagaagacatagaacgttattatacacatatcagacgcggaagaaagcctgagccgcacatgcttcaagacttaaaagacagatatgaagcgatcggaggcatttcgccgctggcaaaaatcacgcaggagcaggcggagaagctcgcacagcgtttaaatgaaatccaggacgacgtaacattcaaagtgtacatcggattaaaacatattgaaccgtttattgaagacgcggtggcggacatgcataaagacggcattacagaagctgtcagccttgtgctcgcccctcatttttcaacattcagcgtccagtcatacaacaaacgcgcgaaagaagaagcggagaagctcggcggcttgaccatcaagtctgttgaaagctggtatgatgaaccgaaattcgttgattattgggtcggccaggtgaagaaaacgtatgagtcaatgccgaaagaagaacgggatgacgcgatgctgatcgtctcagcgcacagccttcctgaaaaaattaaagaatacggcgatccgtatcctgaccagctggaggaatccgcaaaactgattgccgaaggcgccggaattaccgattacgcagtcggctggcaaagcgaagggaacacccctgatccgtggctcgggccggatgtgcaggatctcacgcgcgagctgtatcaaaagcatccttataaagcatttgtatacgtgcccgcaggcttcgttgccgatcatttagaggtgctttacgataatgattatgaatgcaaagctgtgaccgaagaagtcggcgcaagctactatcgtccggccatgccgaacgcacagcctgaatttatcgacgcgcttgcagcggtcgtgctgaaagagctggacaagtagaattaaacggtaaagaaggcgataaaaatgagtggcgataaaaaacatctggtcatcatcggcggcggcataacgggattagccgccgccttctacatggaaaaagaaatcaaggaaaaacagctgccgcttgaggtcacccttatcgaagcgggcccgagagcgggcggcaaaattcagacggcgcataaagacggctacatcattgagcgggggccggattcttttttggaaaggaaaaaaagcgcgccgcagctcgttaaggatttggggcttgagcatctgctcgtcaacaatgcgaccggccagtcttacgtgctcgtcaatgagacgcttcatccgatgccgaagggcgcggtgatgggcattccgaccaaaatcgctccgttcatctccaccggtttattttctgttcccggaaaagcgcgggcggcgcttgactttgtcctgcctgcgagcaaaccgaaggaagatcagtctctcggtgaatttttccgcagacgcgtcggtgacgaagtcgttgagaatttaatagaaccgctattatcagggatttatgccggagatattgataagctgagcctcatgtccacgtttccgcaattctatcagactgagcaaaagcacagaagcctgattctcggtatgaaaaaatcacgtccgcagccttcgggacagcagctgacggccaaaaagcagggccagtttttaacactgacgacagggcttcaaacgttggtggaggagctggaacagcagcttacgctgacaaaggtgatgaaaggaacgaaagtcacccatatcggccgcgaggagaaaggatattccgtgacgcttgataacggcaaagtgctctatgcggaaggatgcatagtgacagccccgcataaagccgcggcgaaaatgctttctgatctgccggcggtttcatgtctcaaagacatgcattctacgtccgttgccaacgtcgccttaggttttcctgagggagccgtcaagatggagcatgaaggtacgggattcgttatctcaagaaacagcgatttctccatcacggcctgcacatggacgaataaaaaatggccgcacgcggcgccggagggcaaaacgcttctcagggcgtacgtcggaaaggccggagatgaatccatcgtagatctttcagataacgagatcattaaaatcgtaatggaagatttgaaaaaagtaatgaaaataaatggcgaaccggaaatgacctgtgtgacccgctggaatgaaagcatgccgcaataccatgtcggccataaggagcgcatcaaagagttcagagatgcgctgaaagcttcctatccgggcgtatacgcgacgggcgcgtctttcgaaggggtgggcatcccagactgtattgaccagggaaaagccgccgtatatgattcactggcttatttatttgaaacgtaccagcctccgttatcgtaaaacggaggttttttgcatgttcccgttctgtaaagggaacaccaataaagagaaaaaacatttgaatcttctttgcgactgtgataagttatcttatgtacaaaatgactaaaacgttcaaacggtcaatttaacgaggtgggaaacatgtccgtcgatcggaaaaagctcattctggaagcggcaacgaagtcttttacacaattcggctacaaagcaacgacaatggatctggtggcaaagcttgcaaatgtggggaagggaaccatctacacgtttttcaaaaacaaagaagaactgtttgatgatattttcaccactattttaagagaaatgaaggaacacgcagacgaagcgatgaaaccggagctttcatttcacgaaaatgttcaccgggcgcttatcgcgattttggaattcagaaaaacacaccagctgactattaaaatttttcaggagaacgctgagattggtacaatagccgttcaggatgtcattgcgaaaatggagcgggccattctgtcatacattaaagaaaagatagaaacagccattgaaaacggaagcattaaaccgtgtgatccggaactgaccgcttttgtgatgctcaagctctacatcgcgctgatatttgactgggaaaaaaaccatccgcctcttgaaaaagagacgatcgccgaattgctggaaatgtatgttggtcaaggattatctaaataatagatgatccttcactttttaggtgccgtgaccgttttgtcaaatgagtcagtttgcggaaggaggcaacagggttgaatacaataaaaagccagtggaaagacattgtaacgaacaagaaactgttaatccccatcattgccatattattcgttccgctgatctacagcggagtgtttttgaaggcgtactgggacccgtacggcacggtggatcagctgccggttgtcgttgtcaaccaggataaaggggcggactacgaagggaaacatcttcagatcggtgacgatcttgtgaaagagttaaagaaaaatgataattttgattggcatttttcaagcgatcttgatcaatcgttaaaggacttattaaatgctaaatattatttattggtcgagattcctgaagatttttctaaaaacgccagcacggtaatggataaaaatccgaagaagctggatctgaaatatcatacgaatgccggatcaaactatgtcggcgcgacaatcggagaaaaggcgatcgacaagctgaaagcctccgtgtcgaaagaagtgacggagcaatacgcaaaagtcatttttgacaattttaaagatattgccaaaggactcggcaaagccagcagcggcgccaagaaaatagacgacggcacgaaaaacgcgaaagacggcagcgccaagctgaaggaaaatttagcgaagcttactgaaagcaccgccaccatcggcgataaaacgcagcagcttgcagacggagcggcgaaagtgacaagcggaattcaaacgcttgacagctctatcgcaaaacttcagagcgcaagcgccgaaattcaagataaatcaggacagattgcttcaggaggaggccaagtggccagcgggctgaaaacgagccttgacgcacaaaagcagctccagcaaaagcttccggatttaacgaatggattaagtgcgttaaacagcaaggcgcaggaagtgtcgcaaaaagcggcggcatttgaagatgcgatcaattcagtcaacctctcagatattgaaaaagcggttggggagcttgagcagactgaaaaggaattgcagcagtttaagaaaaagctttctgatctgaaaaacagcctggatgcccgggatgacgcggtcaaaaaggtgattaaggacagtgatttcttaacggatgagcaaaaagcgaaacttgttcagcttctgaatgagaagcttccgaaggccgaccttccggatttagacaatatcgtcagccagcttccgtccggcggagatatccagcttccggatatgtcagtcataaaaagcgcgctggcagatgtaaaagcgaaggctgatcagctgaaagcactgcctcagtccacatcgaaactgtataacggcgcggcggcggtacaagacgcgattaaccagctgacggctggaactgataaattgtacagcggagcgcagaccgtctttgaaagccaaaacaaattaacggccggtatcggcgaatacaacagcaagttcggacagcttaaatcaggatcagaagcgttagtgtcagggagcggccaggtgtctggcggcttaacgaaactgctggacgcgcaaaacaaaatccatgacggctcgtccaaaattgagcagggtcaagcgtctctcggcaccggtttaagcaagcttttagacggcaccggacaattgtccagccagctgaaagatgcggccgatcaaacaggggacattaagacagatgacaaaacgtacagcatgtttgccgatccggtaaaaacggacgataacgcgattcattccgtgcctaactacggtaccggactgacgccttatattctctctatgggcttgtatgtcggcggattgatgctgacggtcgtattccctctgagtgaagcttcagggcgtccgagaaacggttttgaatggttcctcagcaaattcagcgtcattctgctcgtcggactgattcaatccgtaattgtcgccacggttctgttaaaaggaatcgggcttgatgtggaaagcacttggagattctatctctttacgatgattaccagcatcgcgttcctgtcgatgattcaattattggcgacaacgatgggaaatccgggacgctttatcgctgtcatcattctggtgctccagctcggggcaagcggaggaaccttcccgcttgaactcctgccgggattctatcaagtgattcacggggcactgccgatgacatacagcatcaacgggttccgtgccgtcatttcaaatggcgattacggctatatgtggcagcaggcatccattctgttgggcatcgccgttgtcatgatcgcgctgaccattgtgtattttacggtgcaaagcaaaaaagaacacaaaacggaagaagaaataacagcataagaaaaagaggcgctgagcagatgctcagggcctctttttttagatttcgattaaaatccccatctcaccaacagtccggtatacgtcaatccgccgccgaacccgaacaataccagcgtctggccttccgacagtttttttgctttcacagcttcatccaaagcgagaataatagaaaccgatgaagtgttgccgtaatattcaacgcttgtcaatgtccgttcaagcgggaaaggcagtttttcacagatggattcgatcatccgcatgttggcgctgtgaggaacgaaccaatccagatcgtcttttgaaaagccggctttttctaaaagggcattgcattcctccggcacggttctggccgcccatttatatacttcgcgcccgttttgcaccatatttcctccgcctttaagcggctcgccgtttaattctgcgctcagtcccgtgcgatacagcacgtccgcgcttcctcccgctgttccttgcacggctgccaaaaatcccggcgctgattcgtcgcgttccaccaatagggcgcctgcagcgtctccgaaaagaacgcaggtcgtccggtcagtataatccgttacctttgataatgtttcaccggcaatgacaatcactttttgatgggcaccggcggtaattaatgcgtctgcgagctgaaggccgtaagtgagtccggcgcatgtggcgttaatatcaagcgctcccgtgtgcggccagccgaagtaagcctgaacgcgtgccgcggtgcttggaaacgcatagtccgccgtcgttgtggcgacaaggatcatatcgacatcatcaagagttccgctgtatcgttctgcaaggtttttcaccgcttccacacacaaatccgatgtgaattcatgttcgccggcaatgcgtctttccttcataccggtgcgctggacgatccattcatcagatgtatcgacgatgcgctccaaatccgcgtttgttaatcggcgtgccggagcatatgtaccgattgctgtaattttagattttgacatgaaaaaatcactcctttatatcagattataacacctgatattattacttggtactaattttaataaaaaaacccaagcagcatccgctgtttggggagcatgagaaatttatttgtaaaacgggcttgtgtgaacgattaccaatgacggcagcagcggcggcatgaatgatgatgcttctttttgtctttcttctttttgtctttcttctttttgcaagggtcttcttttttctttttacagtgatctttttcttttttacagcaccagaaggctgcaccagaccaatcatcctcaaaccaatcctcaaaccaatcattatgaaaccttttccgcttgtgcggtttacggctgatcatacatttccctcctatgctcatgctcccttcattctatgaaaaaagagcaggaaaagattggacgggttatggatcaaaagagtatattttaagaagaataaaattgataggaggaatgacctgtggcaaatatgaaacatacgatggaactgattaaagaactggtgtcgattccgagtccgacgggcaatacatacgaggttatcgcctatacagaaagtcttttaaaagaatggggcgtctcctcttacagaaaccgcaaaggcggtctttttgtcacaattcccggccgtgatgacaagaaacacagattgctgacggcgcatgtcgatacgctcggcgcgatggtaaaggaaataaaggcggacggccggctgaagattgacttgatcggcggcttccgatatcactcaattgaaggggaatattgtgagattcaaacttcttccggcaaaacctatacaggcaccatcttaatgcatcagacttcagtgcacgtctacaaggacgccggtaaggcagagcggaatcaggagaatatggaagtccgccttgatgaacctgtccggacgaaggaagagacgtccgatctcggcatcagggtcggcgatttcatctcatttgacccgcgtgtgcagattacgccgagcggctttattaagtcccgtcatcttgatgacaaagcgagcgtggctctgctcttgaatttaatccgccgcatcacggaagagaaaatcgaacttccgtatacgacgcattttctgatttctaataatgaagaaatcggctacggaggcaattccaacattcctcctgagaccgtcgaatacttggctgttgatatgggagcgatcggcgacggccagtctacggatgaatataccgtctccatttgcgtgaaggatgcgagcggcccgtaccattatcagctcagaaagcatctggccgggcttgcggagcgctatggcattgattatcagcttgatatttatccgtattacggttctgatgcctcagcagccatccgttcgggccatgacatcgtccacgggctgatcggaccgggaattgacgcttcacacgcttttgaacgcacgcatgaattatcgcttcttaatacggcgaagcttttacacaggtacgttctatcgccgatggcataaaaaaccctgcgcggaaatcattccgtgcaggggtttcattttaacctgagatggttgtgttttgttctgttttggcgaggctcatgaccttcgcgcctttaacgggatcatattggccttcccattttgacatcacaacggatgccagcgcgtttccggtcagattgacgaccgtacgggccatgtccataatccggtcaacaccggcgatgaatgcaaggccttctgcaggaatgttgaatgcgcctaatgtcgcaagcaggacgacgaaagaagtcccgggcacggcagccattcctttggaagtgaccatcaagacaagcacaagggtaatctgctgccaaatggacaagtcaatgtggtatacctgagcgaggaataaagcggcgatagattggtacagcacagatccgtctaagttaaaggtatatccgatcggcacaacaaaggaaacaatacctttcggacagccgattttctccattttttccataacgcgggggagtacggtttcggagcttgacgtactgaacgccaataaaatttcatccttcatataggcgaggaatttgaaaatgtttactccggcaagctttccgacgattccgaatacaacaatgagaaagaaagccaaagctacatatactaaaccgaccagtttaccgagtgaaagcagggaactgagcccaaatttggaaacggtaacaccaatcaacgcaaaaacaccaaacggcgcaactttcatgacgaggttcacaacatggaacatcgcatgagaaacaccttcaaagaaggccaatacgggctttcctttttcaccgattgccgagatgccgagtgcaaacagcacggtaaagcagatgatggcaagcagatctccttcggccaatgattggaagaagtttgtcggtacgatatgcaggaatgtgtctgcgatagatttgttattttgttctttttctgtttcaacatattgactgatatctgttttttgagcttcatgtatattaacgcctgttcccggatgaaacagattcgccaaagccagcccgagaataatggcaaaagtggtaatgatctcaaaatacaaaatcgttttgaagcctaattttccgacttgttttccgcttcccgcgccggcaacgccgatgattaagctggagacgacaattggaatcactatcattttgattaagcgtaaaaacaaatcgccgataggctgtaaatatgttggaatggcaggattgccgtaccagatgacaccgactacaacccctagtatgagtccgacgaaaatttgcgtcgctagtccaaagcgtaattttttcatagattacctcccgaagaaaaaagtgcaataagtatctaaaaagatagctattagaacaaattataatagaaaagaaaacaatccgtctatagaaaaatatagattgaaaatactgaatcttttaaaacgtacagataattgctaataatggtgaataactccctattcagaaagtatgatgacggccgaaaaaaacgggcgccgcacaacttagaattgtgcggcgccctattgtcacatatccttaattttcaagcagtcattgcacaaattaatgtgacactcatactgctcaacaatctcatttccgcattcttcgcatttcttaccgggtaaatttctgaaaaaatccgacatcttttccaacatacccatccctctttcattgttttgtctctacattgtattataacagttttggaaaatcaacggctgttttggcacaatgtttaaaacatgcaatttgtacgaaaaataggtatattggaggaaaggatctttttatcataaacattcggagggtcatatgaaagttacagttattggatgctgcggcgggtttccggccgcaaacgaagcaacttcaggctatctgtttcagtccggcggctattctctgctcgttgattgcggaagcgccgtattatcaaagctgtttgcctatgttccggcagaagagcttgatgccgtcattttgtcccattatcaccatgatcatatcgctgatatcgggccgcttcaatttgccaaacaggtcggctcctttctcggaaaagggacgcatgcactgccgatttacgggcatgatgctgatatagaacagtttgagcgtcttacatataaaacgcatacaaaaggagtggcctatcagccggaccgcccgctttctgccgggccgttcaccattacttttctgaaaacggtgcatccggtcacttgttatgcgatgcggattactgacggtgcagcttctgttgtgtatacggctgattcaagctaccaggacgcgtttatcccgtttgcggaaaatgccgatctgctgatctgcgagtgcaatttttacgcggaccaggacggcacgtcagccggccatatgaacagtttggaagccggacgtatcgcggaggaggccggagcgggggagctgattctcacacatctgcctcatttcggcgagcaccggaagctgaaagaagaagcggaatccgtgttcgggggcgaagtgacaatcgccgcttccggattgaagtgggagaaataaaggaggagcaccatgttatttatcgacaaccaaaacataaccgacccgaggatcaacctcgcgatcgaggaatattgcgtgaagcatctcgaccctgaacagacatacctgctgttttatgtcaatcagccgtcgattatcatcgggaagaaccaaaacacaatagaagaaatcaatacgaaatacgtagaagataacggaatcatcgtcgtccgcaggctgtcaggaggcggtgcggtttaccatgacctcgggaatctgaatttcagttttatcaccaaggatgacggcgacagctttcacaattttaaaaaattcacagaacccgttattcaggcgctgcgccagctcggtgtggaagctgaattaagcggccgaaacgacatcgtcgcggacggcagaaaaatttccggcaacgctcaattttcgacgaaagggcgtattttcagccacggaacattaatgctggattccgccattgatcatgtcgtgtcagccttaaaagtgaaaaaagacaaaatcgaatcaaaaggcattaagtcaatcagaagccgtgtcgccaacatcagcgagtttcttgatgataaaatgacggcggacgaattcaaaaagcatctgcttcaccatatttttaatacaaatgatctttccgaagtgccggaatataaactgaccgatgaagactggaaagcgatccggaagatttccgaagagcgctatcaaaactgggactggaatttcggaaggtcgcccgcattcaaccttcagcattcgaaacgttatccggtcggatcgattgatctgcgtcttgaagtgaaaaaaggaatcattcaggactgcaaaattttcggtgatttcttcggtgcgaaagatgtgagtgaagtcgaacaggcgctgagcggaaaacagtatgacagaaccgctatcagggaggcgctggccggaatcgatctgaaacagtatttcggcaaaatagagctggaagatttcctcgagctgatttattagaacatttgccgaacgcatgatttgaatcagcacccgtttttgtgaaatgatagaaccataatgaatggggagggatcatgatgaaagtatttctcatcggagcaaacgggcagatcggacagcgtctgaccgggctgtttcaaaaagacggcacgcatacgctgcgggcgatggtccggaaagaagagcagaaagaagcgcttcaagccgcgggaacagaagccgttcttgcagatttggaaggaagcacggaagacatcgcgaaagccgctgaaggctgtgacgcgattgtgtttaccgccggatcaggaggaagcaccggatacgataagacgcttctgattgatcttgacggagcggcgaaagcgatagaagcggcaaagaaagccggcatcaagcggttcattatggtaagcgcccttcaggctcataaccgcgacaattggaatgaagcgctgaagccgtattatgccgcaaagcattatgcggataaaattcttgaagcgagcggtctgacgtatacgattatccggccgggcgcgttattaaatgatcccggcacgggaaatatcaaagccgcggccgatttagaaagaggctccatttcaagagacgatgtcgccaagaccgttatcgcatcccttgatgaaccgaatacgtatgaaaaagcgttcgatctgacagcgggcggcacgccggtcagtgaagcgctgaaacaattatagtttccggttttacggcactcggggctttttgcccttgagtgtttttctatatttttctataataaaagtgaacgtttattccggataaatgaatgactattcattcattatatttttaaaggggtgggaaaatgaatctggtttccaaattggaagaaacggcatcgcagaaaccggaaaaaccagcttgtctgtttcaagatcagtacatgacgtatgaggagctggcaggtaaaatcaaagcatttgcaaacggcttggaggacaggggactgaaaaaaggggatcatctcgcgctgctgctcggaaatacgcctgactttgttattgcgtttttcggcgcgttaaaagcgggaattgtcgtcatacctgttaatccggcatacacaccttcagaaatcgcatacatgctgaaaaacggcgatgtcaaagcgatcgccggcatcgacctattaattcccgtatttgaaagcctgcacggctcgctgccgctgctggagcatatcattatcagccagacagcagagaacgctccatcgacagaagaccctcaattgcgcttaaaaatgacaacgtttacaaaaatgctccgtccggcggagcgcagcagaacttatccgacattgtccaaagacgatactgccgtcattttatacacctcagggacgaccggaaaaccgaaaggcgccatgctcacccatcagaatcttttctccaatgcaaatgatgtcgccggatacttaggaatgaatgagaaagacaaaattgtggcggcattgccgatgtttcacgttttttgtttaaccgtttgtatgaatgcgcctctgatgagcggagcgtgtgtcttaatcgagccgcaattcagtccggcttctgtgtttaaactgattaaaagccgacaggcaaccatttttgccggcgttccgacgatgtataactatctgtatcaatacgagcacggcaaggcggaggattttgcgtccgtcagactgtgcatttcaggcggggcctccatgccggtcgctctgttgcagacgtttgaacaaacctttgacgtcaccattctggaggggtacggactttctgaagcgtctccggttacttgttttaatccgtttgatcgggggagaaagcccggctcgatcgggacgaatattttacatgtcgaaaataaagtcgtcgatacgctcggacgcgaattgcccgaccatcaagtgggagaattgatcgtgaaagggccgaatgtgatgaaaggctattacaagatgcccgaggagacggagcacgcgctgaaagacggctggctgtacacgggtgatttggcgaagcgcgacgaagacggttatttttatatcgtcgacagaaaaaaagatatgattctcgtcggcggatacaacgtctatccgcgcgaagtagaagaagtgctctacagccatgagggcattaaagaagccgtggtcatcggcgttcctgacgccaaaacgggggaagcggtgcatgcttatatagtgcctggggacggtgagctgacagagcaggctgtttttgattactgtgaaacacatttggcaaaatataagcggccggcggaagtggtttttcttgatgagattccgaagaacgcgaccgggaagctgctgagaagggcggtccgggacatgcttccgaaatgacggacgaaaagcgaagccgggggcttcgcttttacatgctgatccggtcagctttgcgattcttccttaatgatgctttgcacaagcttcgtatcatgccgggtcagtttgtaatacgtgtttttatgcttgtacatcatataattgccgctttcgagccacatactgaatgaatcaaaacggtcttcatggtatttgaccgttccgtcgtaatcgggagacacgcttttggtcagtttgacttgttttccttggttcaagatatcgagcatatcttttacattctgcctgtctttaattttgatttctttttttccgtgctctgacagaataatcagatctgcgttgcttgatggaaacacatcgccggtccggctgtatacatagaagaaagcaataaccaaaagggcgattactacaataaacgcgattatttttttcatattcatcactccgtcttttagtctttcccgcttcctgttgttccattcttttctgttgtgaaaagattaacatccgtttcggaggcttggttctatttatttgcatttatgcttacaataggagtaagtcataaggctaaggagggagacttccatgcgcaaatggatagcggcagcgggacttgcctatgtgctgtatggcctttttttctattggtatttctttatgacaggagactccgccgtcccggaggccgtaaagggaacgaaagccgatccgtcctcgtttatggagccgggccgcctggcagccgctgaaaacttttcaaatgtaaaggattttttatttttcatcggagcgccgttagattggtttttattttttctgctgctcattacggggcttgccaaaaaaataaagcattggctggaagcagcggtgcgctttcgggtgctgcaaatcgtaagcttcgtatttgtgatttcactcatcgttacggcggcttcgcttccgcttgagtggatcggatatcgggtttcgcttgcgtatcatatttcgacgcagacagcatcaagctggataagagaccatgtcattgatttctggatcagttttccgctgtttgccgtgtgtgtgcttgtgttttactggctgatcacaaagcatacaaaaaaatggtggttttacgcttggtgtcttactgtgccgtttaccctgtttttgtttttcctgcagccggtcgtgattgatcctttatacaatgatttctatccgctgaaagacaaggagctggaaagcaaaattttgtcgcttgccgacaaggccgacattccggccagccatgtgtatgaagtaaatatgtcggagaaaacgaatgcgctgaatgcgtatgtgacgggcatcggttcgaataagcggatcgttttgtgggatacgacgcttaacaaactgaaggatcgggaaattttgttcattatggggcatgagatggggcactatgtgatgaagcacgtgtacatcggactggccgggtatctgctgctgtcattagccgggttgtatatcattgacaagctttataagcggctgtccaaattcttcggccgaatgcttcatataaaggggcctgaagatctggccgcccttccgctgttattgctgctcatatccgttctcagttttgcttctgatccgattacgaacgccgtctcccggtatcaggaaaacgccgccgaccgttacggcatcgagctgaccggaaaccgggaagcggcgattgagacgtttcaggacttggccgatacgggactgagccgggtcaacccgccgtttctcgtcaaaattttcagagggagccacccatcgatcatggagcggattgaacatgcggaagaagaaaaataataaaaaaaccggcggggccatgcccgacgccggttttttatgttttactgagctgccgcctgtacgttgatcagcccttttccgtagtagaaagcatcaccaagttttgtagtagtgttttctaaactgctgcggacttgagtgtttgtccagttcgggtgcttagaaagaatcaaagcagccgctccggcaacgtgcggagatgccattgacgtaccattgtacgcgccgtatttgtttccaggaagcgtgctttggatagagacgcctggtgccatgacatcaagctcagaacctacgcttgagaaagatgctctttggttgctgctgttaacagcgcctaccgcaatgacagaagggtatttaccagggtagcccactgtgctagagccgccggaagtgccttcgttaccggctgccgcaaccactacgactccggaagcaacggctttgtcaactgccgcttttaacgctgcagaaccagaaggtccgccgaggctcatgttaataacgtccatattgtttgcgatcgcccactcaattccgttaatgatccagctgtactggccggaaccgtcagcgccgagaacttttacagcgtaaagagatgcgcttggcgcaacgcctaatacaccgactgagttattaagagccgcaactgtaccggcaacatgagttccgtgagagttgttgtcttggaaaggatttgtttcagaaggaaccatgctggctccgcctgctacctttaaatcaggatgagaagaatcgataccgctgtcgataaccgctactttaacatttgatccggtgaagccttgagagtgcagagcaggggctttaatctgtgatacgccgtaaggcacggactgcgcgtacgcttgtgcaacgtgatcttcttcaacgtaagcgacgctagggtcttttttcagctcttttacagctttttcatttaatgtagctgaagctgcgtctacatatttgaattgcttttgcactttcccgcctttttcagaaatgacatcttttttcttggcggcgctcatcgtgctcattgtctgcttaaatccgacaatatatttcttttccccgtttgatttccctgcagcctgggcagaagtcgtgctgccgaacgccatcgtaaagattaacgctaaagcaaacagcaaactgatccatacctttttgcctctcactctttatccactccttttttcatttgcagaataaccaatagacagattattctgtggattaattgtatagtatggaataatattttagtagacccaatttttttcagtttgttttatttctatttaggtatatcatctctctttcgtttaataggaacccgaaatatttaaattttaatggaaaaaaccgatggaaggacatgagtatttgtacacagccgcaatcgctctcttgtttactgggtcgaacggtttgattccatttttggaagctgcggcaaaaacaggataaatgtcaccttttgttgaatgcagaagtctgatggaaacgaaagcggaatgaaataaagcggccggcatgaatcagtctttggctttcttgacggagaaagctgtgaaaccattttatgaaaataatgatattgaatatcattgatacttatattgtcaatgatataattgcggaaaaacgaaagagggggaacagatgaaaccaattttcagtatgctgatgatcttatccgttctcttcataacggcatgctcagaacaggaacatgaaaccgccgtcaggcacgatctggggacggcgcatgtggctgcgcacccgcagcgcatcgccgtattgaatgagggctttattgacaccctccatgatctcggcataaagccggcggccgcggcggataaccggaaagagcgaaacgacggcagtccgtccgtcgggccccgtcacatcccgatttgaaaaagatcacttcgttaaaacccgatctcatcattgcagactcaagcctgcacagggggatataccatgagctgacaaagatcgctccgacaatcgctttgaaaaatgaagctgcggattatcaggatgcggttgatgctgcccttaccattgaaaaggcggtcggtaaagagggcatcatagagaaacaattgtcggctcaggaagaaaagctgaatgacatcaaaagaaagctggatgcagaaggcggcacgattttattaattgacgctgcaaatggcagcatttccgtaaaggatgaccggtttttcacatcccggcttatgacgctcgcagggtttacatatgcggtccagacagattccggcgggaaatcaggcgctatcaaaatgacgcccgggcagcttttgcatatcgatcctgattacatcgtactattggacggtgagaaagaactcgaaaaaaatcacctctggaaacagctgactgccgtaaaaaacggccgcgtttaccgcgcggacagggcggtatggacggagcgccggagcattgacggtgcggacgccgtattacatgatctgcagaaaaaaatgctcgccaaaaaggcccaaaactaattcgggcctttttgttatgattctgataggtggctgcttacattgtaatctttgacgcgccacttattttcaattcgttcgatattgctcaggcacgcattgacaagctttgcgttttgtatgtcggtatcaccgtcagaaatggcggacaagagggcgtgaatggctgcgccgtgagcgacgatcagtactttttgctcaggaaaccgctcctgaactttcactaaaccggcaagcattctgtctgtcagctcttctgcggtctccatgttcgggtagtttttatccgggtagcgcttcgaccgttccggtaaagacattccttccgcatcaccgtagctccgttctctgaaatcttccatgacgacaatgggaagattcaaaaaaccgttaataatgtcagccgtttttctggcccgtttcatcgggcttgagacgatgacatcccattcggacccctttaagtactctcctgtttctttcgcctgacgctctcccgtcgcatttaacggaatatccgatttgccttgaagcttcttttgggcattccaatcagtctctccatgtcttactaaacaaacggcagtcataaagtctccactccgatcattttttatcgatatcatctattatactgccgttacgttaacacttcaaagagaagcgccagtccgactccgcctccgctgccgatcgctgctgctgcatagcgggcatcagggcgtctttttgcttcataaaaaagccgggtgacaagcgccgccccggaagccccgtacggatgcccgacggccagagcgccgccccggacatttattttagaatacggcacttgaagctgctgtgaaaaaacgcatattttgacggcaaacgcctcgttgatttcgtatatatcaatatcatccggtgacaggtcccgttccttcaaaagctttttgacggcataaaccggagctgctgacggataatgcggatggacgccgcttaccgcgcttccgataaaacgcaatcccggctttaaaccgagagaccgcgctttttgttcttccatcacacaaactgccgccgccccgtcagaaattccgcagctgttggcggcggtgacagagcctccggactgaaagacgggtttggcgcgggcgatgagaggcgccatgttccgctttttcagcatgttttcgtcagcggcgaatccgtggcaggggagaatttcccggcggtacaagccgtcttcgtgcgctttgacgctccgttcatagctgagaagggcatattcgtcctgcatctttctcgttacgccgtaagcctgtgccgtatactcggccgctatgcccatatcaggatcgccgatgtgttcaggagaaaagcgcgcccgggatgagaaaggggaaaggctgctgctctccgctcctcccgcgatgtatgtgctccccgcgccggctttaacaaagtggcacgcgattctcacggcatccaatccggaaccgcactgcctgtcgatggccgtaccggacacgctcaaaggaagcccggcggccaaggctgacagccgggcgaggttcccgccgcggcccgtcgcgtttccgagcaggacttcatcaatgtcttcgggcatgttccggctcaaatgtcggatcagcagagctgccaaatcttcagggagacagtcttttaacaggccgttttcccgggcgaaaatcgtccgcttcgcatccgtaattacagcttccattccatcatgtcctttgcctgcttttgtacggcggcacgggcgatctttccgccggctgtttccggtatttctgaaaacagccattttttcgggattttatatgccgccagctgctcgcggcactgtttcttcagttcctttacatttgcatgtccgtcgatcaccgcaacggcgatgctgccccaataatcatcaggaatgccgatgacggccgcttttctgacgcccggacagcggttgagcacacgttctatctcttccgggaatacattcaggccgcctgatacgatcatcccgttttcacgtccttcgatataaagatagccttcatgatcgatatatcccatgtcatcaaccgtcatccagccggaatcatcaggctttgcgccgttgatgtatccggaaaatttcatcgggctgttcacaaaaatcttccccgtttcgcccggcatgcagcgttccccgccgggccggcggatttcgattgtaacattttcaaacggacggcccgccgcgtcaggctttcgggcgctgtcttcaggcgataagaacgccacgaaactcagctcagacgttccgtaaaaatcatacagccgcaaatggggatagcgctctgacagcgcttgtttagacgaagcgggccagtctgcaccggaagaaatcaccttgagcggtgtatccggaaacgcctctagtgagagcagggcgtccgtcattgtcggaacggtatatagaacgtcagcttgtctgagccggtctttcattccggccggattgaattttctttgaaggaggacggttccgccgataaacaaagtgctgacagcgccgtataaaaagtgtgatgagcgcagcgtgcccggcaccagcactttgtcatcaggggaaatgccgaattcacgtttcgtacaagaaaagctctccagccacgaacggtgagagcgggtgaaggctttcggcttaccggtcgatcccgaggtgaatccggtataaaagggcaggcaggcgtttttgataaaagcgccttccgctttttccgcctcgatcaaaggcctgcattcatcccacaggatgacaggcgttttgatgccgtccagtctgccgctcagccggcggtcacagatgacgagatcggttttgctgatgtgcagctggtccgcgagttccgccgccgccgagcggggatctaacggaaccgccgtgcagccggcatgcgccgcccctgcgaaaagttgtaaaaatgggatgccgttcggcagtaatattgcaatgttttccggcttacctgaaaggctgccaagccagtttgcggtttggtttactagcctgttccaagtttgatagttgatctgttctgtttctgtctgaatcgcgatctgttccggcgcttgtccggctgtatctgaatatgatgatgtaatcatgatgactaaaatcagcttcctttcgtcggcaaaagccggctagcttgaagagtttttctgattcttacggctgcgaatgaggctgcggccgctttaagcagatctccgggcacatagatgaggctgagctttacggcagtcaagatatcaatgtgcatcataaaagcctgaacgggaatgccgatgacatacaaaaacagcacgccgaacaagaactgtctgataaacaaatgggggacagcagctgagcgaaggccttggatgctgaggctcagcagtaatgccgccagcggatatgcgatgagatatccggcgctcggcccgaaaaaaaccccgaagccgcctcttccgcctgaaaggagaggcgctccgcatgccacaatcagcaaaaaaagcaattggcttaaaaacgccgctttcggtttcaggatgcttcccgataagagcacaccgatcgtctggagcgtaatcggaaccggcgtaaaggataagaaaagcggcgggagcagccccaaaagtcccataatggcggtaaacacggcaatatgcatcatttctgtcaatttcattatgtattcctccagcttatcaaaatatgtttatacaataaagcgagtctttacatatgtcaactctattatattttaagttaacaataaaaagaccggccctttatgaaaaaggccggtcggtttatctttattcttctgtaaggataacaagtgaatcaacggatgatgcaacgtgggaaacggcgcggctgacttcttgaaggccgccgagaaaggcctgcaaatcaacgtcgattttgcctgtctggtctttgctcgttttcatgctttggacgatgtcatcaaacagacggttgatctgcgtcattttttctttcgtttcgcttacaagtccgtttacatctttaatatgtttggacacgatgttgatttgtgtattggtattgttcacaagctctgatacggtggaaacggtttttttcgtatcctctgaaagcttccttacctccgtcgccacaacggcgaaccctttgccgtgctccccggctctcgcggattctattgaagcgttgagtgacaggagattcgtttgctcggcgatccccgtcacgatgccgaagattttttcgatctgttgggcgatgtcattcagcttgtccatttcttcttcaatctgcagaaggctggcgtcgattttattcatctgctgctgctggctttcaagctcttttttcccgccgattgatttttcttcgacatgtacggaagtgacggtgccggcttttgacgcctcggaaatgccctcggatttatcgaccagttcctgcacggctctgctcgtttctgaaaacaaatcagcgagtgatccggatgtttcctggattttctgatgaaggcgggctttcttttcctcttgttcgtcacgctggcagttatattcagtctggaatgcttcaaggacgagctgctgttcaagattcaatattttcgtcgtcgctttgatcgcttttaaaagctcatgcaaatccggaatggttgcttcatatatgttcatcatcgacagaagcagatcctgaaacgctcccatataccatttcggttcaaggccgatccgcaagtggatggaagcgatgcgctgtcttttttcaatgaattcatcatcaatcgtgccggcgaacatctcatggatatgacgccgtaatgtttttttcagtcgctcaaccgtgctgtggtcgttaatgatcgtcattaatgatttttcgtgatccagatttcggtaaaaggaatcgacgattgttgagatatgttctttaattaacggctgcagctcttcaagcacatgaagttcttcgtttccgagcctgaccattttcagctgtttttggacatctgcatattgatttgaaagcgcgatgcgtttttttccatcggcttctgaaaaatatgctgtttcttttttgcggtcttttttaaataacaatataagttcccccagatattctctttttctttttatcggtttggaaggaacttgaatgaaggaatctgataaaaatattttaatgcggaaaaaaataaaaccattcgtacagaatggtttagtcaatcttgggtgagacgtttcagcggcttgatggcgggaccttcggcaaccccgccgtcgggtgtgaaccgggacccgtgacatggacagtcccacgtccgttcgccgtcattccattcaacctcacagcctaaatgggtgcatgtcgtatcgacaagatgcagacagcctttttcatctttataggcgccggcccgtttgccgtttaccgttacgatttttccctccccgggcccaagactctcaggtgaagcgtccggcctctcaagtttgcccgagataaggtgtttggccacgtcggcattataggaaatcagttttttcagtccgggatctgcgtggaagcgtgacggaataaacaggccggaaaacgggttctttttgttttgaatatgatcagccaaaagcttcgcggcgagcgctgagcttgtcatcccccattttttaaaaccggtcgccgccaaaatatgttcttcatcgcctgagatgggaccgatgaacggaattttgtcaatggtgacaaggtcttgtgcagaccaatgatatgggatgctttcaactccgattgtgtcttccgcaaattgtttcagcgcttcgtaatgcccggacatttcttttccttggcctgttttgtggctttcaccgccgacaagcaccagtttttcaccgttcaaatcggtgtatcgcagtgatctggacggcttgtctatgctgagatacatcccgtccggatacgcttgtttcggttttaccgcgagtacgtaggatctgctggcatacattctggcggcataaagcccgcctccgtcataaaaaggaaagtgggaagcgcagacaatgtagctgcacttgatgccgtgtctgtttttcgtgaccacttccggctgcggttctttttttatgtcgatcgcagccgtctgttcaaaaatccgcgccccgtttttaacgatctctttcacgagcgccgcaccatataaaagcggatggaattgcgcctgattcttcatggcaaggccgagcctgcaatcaacggggacgggaagttctttcacaagctcatgttcaataccgagcttggtataagcttcctgctcactgcggatttttttgacgcctgattctgtattcgtgtaaagatatgcgtcttgttcaatcagtctgcagtcaatcgaaaggtccttgatgatctgcttcatgtcttccatggcgcggagatgggcttcgaaatacagccttgcgctggtcaggccgatctgctgaataagatcggcatagatgaaatcatgctgggcggtgatttttgcggtcgtgcccgcggtcgtcccgtttaaaatccggtctgcttcaatgacagcgacacggaaaccttttttcgtcagttcgtatgccgttgtcagacccgtaattcctccgccgataaccgcaacgtcgcattccgtatcttcagtgagggcgggaaaggaaggaatgtcagctgttgcttgccaataggaagccggttcctcgtttgaaaaagtagtcaattcagatttacctcctctgttgtatattcttaatttttccaataagactctgttcatacatgaaattcgtataagatgctcaaattactcataatatagtaattaatgtaaaggagtgatcaaaatggcgaatcagaagaagaaaaccttgccgccgcagcatcaaaaccggcagccgggctttgaatatgtaatggacccgcgccccgtttttgacaaaccgaaagcggcgaaaaaacttgaagggaaaacggcgatcatcacgggcggagacagcgggatcggccgcgccgtatccgttttattcgcgaaggaaggcgctaatgtggtcatcgtttactttgatgagcatcaggatgccgaagagacgaagcaatatgtagaaaaagagggggcgaagtgtctgctgatcgcaggggatgtcggcgacgaagccttttgcaatgatgtcatccgccaggcgggccaagcctttccttccattgacatcctggtcaacaacgcgggtgagcagcacgtgcagccggggattgagaaaatcacgagccaccagctcatcagaacgtttcagacgaatattttttcaatgttttacttaacgaaagccgcgctccctcacctgaaaaaaggaagttcaatcattaatacggcctccattaccgcctataaaggccacaaaacattgattgactattcagcgacaaaaggggcgatcgtcacgtttacaagatctctttcccaatctcttgtcactcagggcatcagggtaaacgcagtggcgccggggccgatctggacgccgctgatcccggcgagcttctcggcgaaggaagtggaagtcttcggctcagacgtgccgatgcagcgcccgggagagcctgttgaagtggcgccgagctatttgtacttagcaagcgatgattcttcctatgtcacgggacagacgattcatgtgaacggcggcaccatcgtaaacggataatgtaaaaaaagccaatccatatggattggcttattcactctgtttgagagcggcatattcttttgaaagcgtgaggaacgcttctttatttttatcatcaagcgccttattaatctgcattgtcagcatggcgatccggcgtttatacaaggattcatcaagcaccatttgaatgtaaatatcggccattgtcacatcgaattcgtttgctttttccgtgttgcgggacttcatgagctcagtgtacgactttttctctttcataaagaatccccccaatgccttttttatagtatatggataacggccggaaaaatcaattaatttttataatctttagacaactaatacttggaaatatatcgacatatcctgcaaattgacgaaaaaacgaaaatgatcgttgtataaatgaggtgaaatgaaaaagaaaaataatatttaaatagtaatttaagactaaattacagctttaaaaggtgatttttagctatattcaaaaaaaacctgtcgttttccaatgacagatgatagattattagtataaattttcaagaaaaggattggaggctgcacatcatgtgccagaaaacacacgcacccttagaaagctacgaagtaaatcgttcaaccatcgctgttttgcctgaggaaatagacggtaaaatggggtcgaaggtcattgaaaaagactgcattctgtatgtcagcatgaagccgattcacatcatcgacagaagctgccgctactttggctccagctatgccgggagaaaagcaggaacatatgaagcgattaaaatttctcacaagccgccgattatggtggacccttcaaatcacatctttttattccctacactttcttctgcaaggcctcaatgcggctggatatctcatgtgcacgttaaagattttcaaccgacggcatttgatgacacagcggtcacgttctcaaacggcaaaacgatggaactggaagtatcctatcattcttttgaaaatcaggtttacagaaccgcctatctcagaaccacttttcaggacaggatgggcagtcatatcccgaagcggcaggaattcatgctgtatccgaaagaagagcggacaagaatgatctacgactttattttgcgggagctgggggagagatattagagaaagctgtgatgtgaagggacgggccctttccttttaggaagggcttttttcgatttacatgcccggatagagttgtatcgtgtccgtctgttggctatgatgatgtaaagagtaatgatatttcattttaggagagatgggcatggatgtgtttgcaaaatatgtatcagaaatcgataatccggatcaccgtctcaaagcagaggaaattttgtcgtggacggctgaccaatttccgaacttagaagcgcagatcaagtggaacaaaccgacatttaccgatcacggcacctatatcattatgtttgccgcggcaaaaaatcatttgagcattttgcctgaaaaagagacgatggagcattttgccgatgacatcgcccaagccgggtacagcgcttcttcacgcctgttcagaattcggtggactgatccggtgcactatgatctgcttaagaagatcatcgaatttaacatcaaggaaaaagctgaaaatccggggttttggcgctagcggacgtgatgtagaaggaggaagacatggacgttttcaaagactatttatcaagtatcgacagccctgatcatcgtctgcgaatggaggaaatcctgtcgtggacggctgagcaattcccgggtttaacaccgcagatcaagtggaacacgccgatgtttaccgatcacggcacgtttattatcggctttgcggcagcaaagcatcatgtaagtgtttcccccgaagaagctggaattgcgcattttgccgacgacattgcccgtgccggctacagcgctacttcccgtttgttcagaattcaatggactgaaccggtgcattatgagctgcttgaaagcatgattcaattcaatatccaggataaggcggactgctcagcgttttggcggaaataatgaaagaaatgttaaaaaacaaccctgaggagggctgtttttttattaaacgtaatccgaaaaataagggatttgcgtatccggcagaccctcacaaacgcacgatgacagaaatcgtgcgttcaaaattctttatttgacgacagacatgctgacgctgcttcctgacactgtcaatttggcaaaatcctgtgtatcaatcacaggtgtgactgctttattgtcgatcgtgatgttcgtaaaggctgttgagaagtttgatttgatgtaagggcgctgatcctctgatgtgaccgcgacggtggcgagcgctttccattttgagacagagcctacatttgtttgggcgagttctgagatgatgcggccggtgtatccgtcattattcgtgccccaatatgtggcgcgggtattgccgttcagatttttgtaaatggtcagctgtacggtgctgccgggccggaagcctttcgtataagtgaattggctttctccttccagataccggacctggccttgtccctttgaaccgactttcatgatcggtttccatacatgataggtgtcactgtactgaagcccgatatcagcctctgtgcctccggtaaatcctgagtaaatataggctgtcccatttgacacctgaatcgagcttggaagctgaattttcgtgacgagaactgagcccgtgctgttcagataggcccttccgccgattcctttactgagctgggacgccgcttccgccgtatttggactgatcacccccggaatatccgccgtacatgcgccgaatagaacggctgtagtgagaacacccgcaacaagcccttttttcatcatcatttctcctcctatcatcatagtcagatagcgctatcaattcatattataaaaggttttgggaaaaattccataaaagatatacgggcggacataaattaaaactattttcctatttatcttgtaaatggagattatttgaactatgatatgttcagccatacaacatgattcaggaaaggggataggatagaaatgaaaaagacggcagctgtgcttttgtctttcggcctggtgttcggttgttcatacggagcggggcagacggcagaagcgaaaacaaaggtaaaaacgtatcaaaactgcaaggcgctgaataaggtgtataaaggcggcgtggccaaatcgtcgaaagtgaaaaacaagggcggcagaacaaagtacaacccgtatgtatcaaaagcgctttacaatgcaaataaaagacttgaccgggataaagactatatcgcatgtgagaaataaaaaaacaagcctctttaaagaggcttgtttttttaaatggattcggcggtgacggcggttccgtatccgattaattcggatgtgttctgtcctgcggtcagttcgaaccgcaggccgacgatggcgttcgctccgagctgctccgcctctctgatcagccgctctttcaccgcttttttggagtcatccagcatttcggtatagcttttcaattcgccgccgacgacagattttaagccttcaagcaaatcttttccgatgtgacgggactggacgatactgcttgtcactaagccttttacttccgtaatctgttttccggcgacggtttcggtcgttgtcatgatcatgcggctttcccccttcatgtgtcttaccgctattttatcattaagccgccttttcggctgcgctgatttgtttttttctgactgcggcgctgactgcaaacatgacggcaatgttcagaaccagcgcgatgatgcctgtattcatatccttaacgatctgcggaagaaacggaaagagggttccgacggttgattcggtcagcgtaatgaaggccaccgttccgaccccggccgttatgccggcaaaagcgccgtggcttgtgatgaaacgccgcttcggcaggctgaataagagggcggggaaaagctgggtgacaaggctgtagcccattaaaagcaaggtgacgatggtatttccgcctttcagcgtaaaatatacggatatcagcgcgatgacgggtacggcgtattttgcgagccgtgagactttttcgtcagtcgtgccgggccgaatggctttgtacacgtttttggcgaacagcgtgcttgaggccattaatatcattgaaccgggcacaagcgccgtcagaatgcccgccgatccgatcagtccgacaaaccagggatcaaaggttttcacagacagctttaataaggcgagatccgtgtccgccccttttaaaccgggcacctgcagaatcgccgcaaatccggtaaagatgacaaacagcaggacgagctgataaagaggcatgatgatcgcgtttttccgaaacacccgcggatgctccgccgaataggaagcggcaaaggtatgaggccacatataaaagccgagggcggtcagcaaaaccgttgagctgaaccaggaaacgctctgtccggtttccggcagcgtgagaaaaccgggttttgcggcgtcaatttgtttgaacatctccgtaaacccgccatagtaatgaatgggcagataaatgcctaaatacaggacgatgcctaaaatcatgatatctttgacgacggatatccacgctgaaccatggattcctgaaatcatcacataaatcgtgatggagacagcgccgatccagacagcggcggagggcggaatctgtccgtatgatgttgctgaaacaattaatccgagccctttcagctgcagaacgagataggggatgagggatgcgatgccgacgagcgatacgagaatgccgaggagcgggctgttgtattttgaaataaaaaaatctgattgcgacatcagtttgtgttgtttggcgtaagtccacacggctggcagaagccaatatgacaaaatgtaggcaaggcagccgtacgcgataatataaaaggccgggcctccttttccgtaagcccatccgcttccgccgaggaatgtaaaggtcgtgtatatttctcccgccattaataaaaagacaaacatcgtgccgaagccgcgtccgcccaccgtccattgttcaaggtccatatgttttccttttcgggcccggattccgagatatacacaaaacaggagcacggcggccattacgggaaatgctgcgttcattccgtctcacccgccttgttttctttgtccaatttgtaaacggcggccatcagaacggaagtcagcaccgcccagatgacgacatatgcgagaatgaaaggcattccgaaaacataaggcgtcacccggttggcaaatggaatgccggcgagaattccgaaaaagggcagggcggcgagaacatgaatcagtttcataacattcctccttttcattgaaaacagcgtgtcccgattataaagaaaatcatgtcgaatgtatagtgtgaatagtctgaaatttatcaactgaaaaggaaaagcagtcccggctgctttttaaatggtcgcaagagacaggtaatattccaataaggcggttacctgttcccgtattctcgggttgaaataacggtgtttttcttcatagccgttaatggtgcatatataaagcgtaaatgcttcgtctctttccgcttcgtatattttaattttacgctttcttaactcttttcgaacatcactcaaatccttttgtgctaattttaaagagcagctgataagctgtttatagggttgttttaatttgaacgggcacgaatcaagcgcttcgaggtcccggttcaggatggcagccgccatgggcagaaacagccctttttcgatgagatcgcgggtgccgctccgaatgtcaggcataaatactccttctttcttaaaaagagaacgtttgttcttattttatgctcgcttacacgatatttcaagtcggaaaatctcgtaaacattttcgttttttggagataatgtgtagaataaggatagacaaactcgttaaggagtataaacgttggagcaatttttatcatatttgactgaggaacagctgacggaatggttccaaagctatagagctttcggcccggctgctgcggctgtactgccttttattgaagcgtttcttccgtttttgccgctcgttgtatttgtggtggcgaatacgaatgcatttggtttgtgggaaggtttttttctgtcatggctcgggtctgcgtcaggatcgatgctgatgttttatgccgtccgccgtttcggacagaaaagagctttcggtttcatccgcaggcatcagaccataaggcggatgatgctctgggttgagcggcacggtttcggtccgctgtttattttactttgcttcccctttacgccgtccgctgcggttcatatcgttgccggtctgtcacgggtgggggcgctgcagtttatatcagcagccgctatggggaaaatggttatgatctttatgatcagctttatcgggtatgatcttcacgcactcatgacacagcctttcaggatggcgggcgccataatggtgatcgcggtgctgtggtatgccggaaagcatatcgaacggcgtttacagacgagaatcagtcagcatgagaaagacggagggagacaggaatcttgaaaaaacgattttggtttatagccggcgtgcttatcgttgttttggccatacaattaaagaatgccatttttattgattataaagtcgaaggaatcagtatgaatccgacctttaaacaaggaaatgagctgatggtcaacaagttttcccatcgttacaaaacgatccgccgtttcgatattgttctgtttaaaggcccgcaccgcaaagtgctgatcaaacgtgtcatcgggctccccggcgagtcaatcgcatacagggaggatcagctgtatgtgaatggaaaacgggtggcggaaccgtttttaaaaccgttaaagtcatcattgtccgccgggagccatgtgaccggtgattatacgctgaaggaaacgaccgggcgcaaaagcataccgaagggacaatactttgttattggcgacaaccgcatatacagcctcgacagccgtcatttcggtccgattaaggataaagacattgtcggagtcatcagtgaatcagacgccaagtgaacggcgtctttttttcggaaatgattgtcaaaaagcggaggaaagactataatgaaaattgttacgcacgaaacaaaaaaggaggcgtttattttttagtggttttgttacgtgtgtaacaaaaaaggaaagagggctgatgagatgaaaacacaggttgccattatcgggggaggtccggtcgggcttatgcttgcatcagaactggcgctggccggagtgaaaacgactgtcattgaacgattgaagaagacggtgccatattccaaagcgcttatcatgcatccgcgcacacttgagctttttgccatgagaggcatattggaacgctttgcggatcaagggacgaaggtgtcttccggccatttttccatgctggatacacggctggatttttctcggctggatacgaagcagaattattcgttaatgctgccacaggcagaaacggagcggatgttggaggagtatgcatcaagtctcggcgcagacatcatccgcggggcggaagcggtggctgtcacccagacggatgacggagtggagacggtgttccgggacgaaagcggaatccgcactcttcacagcttatatgccgcgggtacagacggggcggggagcattgtccggaaacaggcgggcatcgctttttcgggcacagatgccgacttaacaggaaccctttgtgatgccgctttgaaacatccgcccgaatcttcctttttttcaacgtgccgcctggagggatcggttgtgattatccctcttacggacggacttttccgcgtcctcatcgtttctccgcacgtcctgcaaaagcggaaggaagagccggtcaccgaaaatgagctgaaagaagacctgcggcggatatgcggcactgatttcggattgagtgatccggtatggatgtcgcggttcggcaatgccgagcgtcaggctgagcagtaccgctccggccgggtttttgtggccggggatgcggcgcacattcattttcccgcaggcggccaaggcctgaatacggggcttcaggatgccgtcaatctcggctggaagctggcggcgcaaatgaaaggaaaagcggcgcctcatcttctggacagctatcatcaggaaaggcacagcacaggaaaagaagtgctgcacaatatcaaaacgcagatcaagctcatggattttaccgagtcggggatggcattaagagaaacgatgaccgctttgctggattttcaggagtccaaccgtttattggcgggaaaagtatccgcgcttgatctgcattatgaaccggatgcggagctgccgccgcatacgctgaacggaaaacgcctgccggatatcgaactgacccttcatgacgggcggccggcccagctctatgattttctccgcgagggcggctttgtgcttctgtcattaagagggagcattcccgccggtattgatacggaaagcgtggcagcagtcagggcggagcttgctgaaacacgtgccgattggaacgacgtccacaccgttttaatccggccggacggccatgcggcatgggcagccggcggctcgggacgtgaagcggaagaagccgttctggccggtttggagagatggggattattcatctgataacctttttatgcgtctgtgtgattgtttcttgtgtaacaaaacgttatagtaaaagaaacaatcaatacggaggggtgactcagcagttggacagaagacagccagaccatgcaaaacacatgattcttgaagggctgacagatatttttcacgagcaggagaggtgccaggaggatatcagggcgtcgttggccggacggatggatgaactccgtgaagaaaatgggaaaaagttacaattgaccttgacggaaattcacattttgtcgtgtatcggagatcatgaaccgatcaatgtcacgtcaatagcggaaaaaatgaagacgacaaagccgaccgtgtcgagaagctgcgcgaagtttttggaagccggcttcctgcgcagaacccggctgagtgacaataaaaaagaagtctatttccggctgactcctgccgggaaagagctgcattcccttcatcatgaatatcatgaattgataaaaaagcggctcttggcgtttttagaccgctatacagatgaagaactgttatttgctgaacggctgttccgtgatctttcagcaaactggcggtctgtaaatggcggcggagagctgttcaaataaaaaacacgcatatggatgcgtgtttttttattcggatcatgttcctctttctgcccggcctctttcgccgtgtgcccgtttcagctgagaaaggtggtgcagcagccgatagaagggcggaagcatggcgatgacgagaacgatccggatgacctgaaccgcgacgacgaaagtcgagtcttcgtgcagggtaatcgaagtcgccgccatctcggcgatcccgccgggagaaaaggcgagaacagatgtaatcatggagatgcccgttaatttagaaaccgcaaccgcgctcagaatcatggcggcgattaatccgacggaagaaataaacccgacggtcagcactctcgtcacgccggtgaacatgcttttgtacatttttgatccgattgtggcgccgagaaaaatttgtgacagctggttcgcttccggcggccaccaggccagcatgtctttgcccgccaaggcggacacgccgatttccgcagcagcaacgccgatcatgctgccgagcagccaaggggcgggaaatttcagccgttttgcgcctttacttgcaagccaggcagccaaaataaatccggccgttaacaagacgggagtaaggcccggatgtgaagctcctgccgaaacggctccggctgatgtctgagccgcaccgttttgtttggtaaataagaaaatgacgagaaacggtattgtcatgacgaccaaaaggacgcgcgtcagctgaataaggcttacaatcgcggtgtttgcgccgacttcctgggcgataccgggcatggcggataaaccacccggcgccgtgcctacaaagcttgtcatcatgtccgtccggctgaaccgaaagagcacatatccggaaacaagcgccatcacgatagagaaaatcagcatgaagcctaccggaagccaatgctcccgtaaaaccgacagaacggacaggttcagtttctggccgagttcgatgccgaggatcatttgtcccgccgcaagccatctgcggtgaatccctcttctgtcaggcgccatgaacagccagcggggcctcgtcatggagaggatgcagccggcggcaagcgttccgagcatccaggcgatcgacatccctgtgagcgaaagaagaaacccccctgccgcactgatgagaataaaccagatatccgtaaggagatgtttgtctttcttcaatgaaaacccttcttcctgaaacattcatattaaattgttaagctcgttaaccttactattactatagtatagattttgagataaataaataatgaattatttctcataatccattcatttttcttatcgaaaacacaaaaaaagctccggagatgggtgagtgcaccctactccgaaacctcgcccgcttttcctttccacacaagcgtcaatcccagaccgagaaataaaaccacacctgcgaacagaaacgggaagtgaatattcatatcaaataaaataccgcccagagccgggccgaaaatggtgcccaaactcgtgtatgttgagttcataccggcaacaaacccctgctgatttcctgcgatcttcgatagataagtagtcagtgccgggcgcagtaaatcaaacgcaaggaaaatgatgcaggtgacagcgagcacgggcaaaaaccctgacatcagcgtagaaacgaaagccagcacagcgccgatgatcagacaaagctgaatgacttttttctccccgaggaagttgacaagtctgccgaacgcgagcacttgaatgaggactgccacaatggagctgaacgtaataataatggcgatatcctttggcgtgaagccgaatttatggtttgtaaataagctgaataccgtttcgtacgccgacagcccgaatgccaaaacaaagacgatgataaaggcgatcaagtagcttgggtgaatcgactttttcaaatcttttaagaaggttgattctttggcgctttccatctgctttgcacgttcttctttagttaacggctctttcagcataaagacagaggaaatcactgcgataaatgcaattcccgccgcaaagaaaaacggcatacgaacgccgtgatcggcaataaatcctcctatgccgggcccgatgataaaccctgtgctgatggcggcagatacatagcccatcgccttcgatctttcctgcaccgtcgtaatatctgcgacatacgctgtaacagcgggcatgataaaagcggcactgatgccccccagcacccttgcgaaatataaaatggagacatgtgtgcccaatccgaaggtcagttcggataatgcgaataaaaacagtccggcgagaatcatgatttttctgccgaagcggtcaacccatctccccgcaatgggggatgcaattaattgcgcgacggcgaaggcagcgacaaggtatcccattgtgctgcccgtcaagtgcatcacattcataaacagcggcataacgggaatgatcaatccgatgcctaaaaacgcaataaatatgttgcttaataagatgatgagtacagccttttgttctctgatcggtttttgcatgttgtttctcctttgtcagctgtcattctgtttatcagcgttgatcgacccgtgaataaacacggagatggcttctttttgcaattcgattctttgctgaatggtatcgtttttatataacacatctaaaccgtagaagacggatagcaggatttttacttttgattcgacatgaggaatggaccagctgccgtcttgatttccctcttctaagatctctctcatcacatcgtcatattcaatatcaattttgttgagccgctttacgacctcctctgacgtaaacgcactcgcataaaactcttcacttgctctcataagcgggtaattgatgctcatccggctcagcagctccgcaaagcccgtcagcttttcggcagcatctttcagatcggattccatttccctccacgtctcgatcatcacgcggtgatcctcttccatgatatgaagaaacagaaactcttttcctttaaaatggtgatatagattgcctttactgatctcggccgcctctaaaatatcccgaatcgatgtttctgaatatcctttttttgcaaataagtcacgcgaagcggatacgagcctgttcttcgtcttttcgctctttcctgcaccgccttttgtatttgtcacttcacacagatcctttccgcctcattcatatcgttgtcccggcaaagcgggttcgggtcgtttaaaaccgaccagttggtttattttattataaagggtttttgctgactatacaatgaagaagttatccattgtttagtggaagtataaaaacggctcgaaaaataaaccccattctctcctgttgaaagaacggggtttgtcagccgtctgaagactcccggcgggggagcgtgatctgcctgaatcgttattttccggtatttacctcggtgtagcttgtgttcggcgcgtttgataccgttccccctgtatggtggaaaggagagtgggcagagtgggccatatcgtataaaaaccagacggcatgacgctgctcgtcaaatgccgtgcgggcaaataaccgtttcgcttccggatgcaccgctctatcggatgcctgcaaataaaaatcattcgttttctgctcatcataaaacgccgccctcagtccttctctgtatgtgtgcggacaatgctccgtctgtttcggcgtcaactgttttccggtaattgacgtatacagtgaagagaaagcgtgcatgtggcgcacttcttcctctctgatatgttcgattcgtcttctgatttctgcggtcggcgctttttcggctaatattgagtagcaaatcacagcgctgtattcaccgtttatggattttaccagatcctttataagcacagaatcgtcactgcagatggctgtataatgaaaaaaattctcgtgcattggactcacccccggatgtttatagggtattatacggcggcagcccgtgacatgtgcggatgtcatttttattcttgatccagcggcgatgtaatatggtcgtcgtatgtgtcgacaaaaagccggccgttgcttccgcgcacagcgtatacaacgtcttccggtttgaggtttctcttgtccaattcttctctcagccatttttccgatacgtggttttcttccagatttttcatcaccagccggccgtccataatcagctcaacggcaaagttcttttcatgtccggcaaagatgccgagatcctgtcttgtaacgggcgcaaattccggtttgacctccactgacatgctgccgtttgtttcaatgatggcagtctgaacctgagaaatgtcaaatacatcattttcacgaagctgctggttcaagtagtcgagggtataacgcatcgttttcatattatgctcaagtatttttccgttttgaatgataatggtcggtttgcccgcaaagaaacccctggcggttctgtttttcatagaaagatatgcgacgagataaataatgaccacgaaaatcgtgtaagcactgacagtaaaatgaatcggcagttttgtattaaacgacagattggctgtgatggcgccgagggagatggccgcaatgaaatcaaaaagcgtcatctgtgaaatggtttgttttccgagtatccgggcgccgataaacaaaatgctgaacgacagaatcgttcgcacaatcacttcgggatattctgtcatcatatttaatcctttttttctttaatttggtcaaaaacgatatgttttaaaacagtcatcccgtttttaccagcagatgagattggtcattttcgtcaactttcgataaaatgtagaaagataaaaagagaggggtcttctaatttgggtgttgagtttttagtaggcagatcggggagtgggaaaacgaggctgattatcgacagcattcaagatgaactgcgccgggagccgttcgggaaaccgatcatttttctagtcccggatcaaatgacgtttttaatggaatatgagcttgctaaaacgccggatatcggcggcatgatacgcgctcaagtgttcagtttttcgcgtttggcgtggcgcgtgcttcagcataccgggggcatgaaccgtccttttgtgacgacgacgggtgtgcagatgcttttaaggaaactgattgaagaacataagcacgagtttaaagtgtatcaaaaagcgagtgacaaagccggattcactgagcaggtggaacggatgctgacagagtttaagcgatactgtattgagcctgaagacgtccgccgcatggcggaaagcggaacggcgtcagaatatcgcggagagcggatgctgtctgaaaaacttcatgatttagggattttatatcagcagatggaaagaagcctcgccggacactatttgcattcagaggactatttgacgctgctcgctcagcagattcctttggcggacgttgtaaaaggcgcccgtgtttacgtcgacggattctatcaatttacgccgcaggaattaagggtgctggagcagctgatcatgcatgctgaacatgtcacattctcgctgacggcggacagcccttcggcggaacaggcaccggatgagctcgatctgttcagaatgacgggaagcacatactataagctttatcagacggcaaaggaattgaatgccgatatttcctgcaaggaactgcatggcacgaagcggcatcggcatgtgccggagcttgcctgtatagagtcgcagtacgatgtgcgtcccgccgcggcgtataccggcggacaggaagcttttaccgtcatgcaggcgcaaaacagaagagctgagctcgaaggtattgcccgggaaattcaatcgcttgtccgggacggaggataccggtacaaagatatggcgattctcatccgtcagccggaagattataaagatttgctgaaggaagtgtttgccgattacgggcttccttattttattgacggaaaagcttctatgcagcatcacccgcttattgaattcatccgttcaagcctggatgtcgtgaaggggaactggagatatgaagcggtgttccgctgtgcgaaaaccgaactgttattcccgcttgatcagccggagcagaaaataagagagcaggttgatcagcttgaaaattactgtatcgcctacggcattaaaggggagcgctggacgaacggcgagcggtttgtatacaggcgcttcgtatcgctcgatgaggatttcgcgcagacggatcaggaaatcgagatggaacacatgctgaatgagacgagagagtggatagctgcaccccttgtccggctgcagaaccggatgaaaaaagcgaaaacggttcaaagtatggcggaggctctttatctctttttggaagataccgatgttcccctgaagctggaccggaaaaggcagcgggccgaagaggccggaaacatgatcgaagcgcagcagcacggccaggcgtgggatgccgttatccagcttctcgaggagtttgccggcatgatgggtgaagatgaaatatctttagcgctgttccagcaaatgcttgaaacgggaacggaatcgcttcatttttctttaattcctcctgcgcttgaccaagtatttgtagggaatatggatctctcaagaatatacggcacgtcctgcacattcgtcatcggggccaatgacggcgttcttccggcgcgcccggatgaaaacggcgtgctgtctgatgatgaccgggagtggctgaaagcagtcggagtggagctgtcttccgcggggcgtgagcggctgcttgatgagcattttctcatctatatggcgctgtcgagtccgtctgaccgtctctatgtgtcatacccgattgccgatgcggaaggaaaaacgctcctgccgtcaatcgttgtaaacaggcttggcgagctgtttcccgatcatcaggaaaagctgtcagcggctgatcccgagcaggtaagcgaagaagagcagcttcagtatctcgtcaataaacaggtggctcagacgtatacggcaagtcagctcaggctgtggacaagagagtacgagatcagtgacgtatggtggagcgcatacaatgtgctgatgaaagagtctgatcaccggcgtgcgaaaaagctgttttcaagcctgtttttccgcaatgaggcgaagcgtcttgaacggcctgtttcgcgccagctttacggcgagcatattaaaggaagcgtctcccggatggaggcgtttaatgcctgccagttttcccattttgcctctcacgggctgcaattaaaagagcggcagtttttcaagctggaagcgccggatatcggccagctgtttcactccagtctgaagctgatttcagaccggcttcgtgagcagaagctggaatggcgcgatctgacgaaagatcagtgccggaatttctcctatgaagcggtggaacggcttgcgccaaagctgcaaaaagagattctgctcagctcaaacagacacttctatgtgaaggaaaaactgcagaagatcgtcacgcgtgtttctggcatattaagcgagcatgcaaaggcgagcggtttcgtcccggtcggtcttgaactcggctttggcggaagcggaccgctgcctccgctcactttcacgctgaaaaacggctgtacgatggaactcgtcggacggatcgaccgcgtggataaagcggaaagttcaaaaggcctgctgctgagaatcgttgattataaatcaagcgacagggggcttgatctggctgaggtgtattacgggctcgctctgcaaatgctcacatatcttgacttatcgattacacattccgcggattggctcggcatgaaagcgaccccggcaggcgttttgtatttccatatccatgatccgatgattcaggccagtctgccgatggggcttgatgaaatcgagcaggaaatttttaagaaatttaaaatgaaaggccttctcctcggtgaccgggaggcgatcagcctgatggacacgactttggaggaagggcgttcaaatatcgtcaatgccggtttgaaaaaggacgggtctttaagatccgactcagcggcggtcagcgaacaggactttcatctgctgacagaccatgtgcggcggacatttgaacaggcgggcgaagcgataacggacggacttgtgtccattaccccgtataagctgaaagataagacgccttgtacgtactgtgcgtttaaatcggtgtgccagtttgatgagtcgcttaaggaaaatgaataccgcagcctgaaagcggaaaaagacggcaccatactggattggctgaaaaaggaggcggatgatgatgcaaattcctaaaccgaaagacagcatatggacggatgaccaatggagcgccatcgtttcttcgggccgcgatattcttgtcgctgccgcagccggatcaggtaaaacggccgtgctcgtggaacggatgatcagaaagataaccgcggaggaagatccggttgatgttgacaggctccttgtggtgacctttacaaacgcctcagcagcggagatgaagcatcggatcgctgaagcattagaaaaagagctcgccaaaaatccgggatctctgcatatcagacggcagctctctctattaaaccgggcgagcatttcgacgcttcactctttctgtctgcaagtgcttaaaaaatattattatatgattgatcttgacccaggttttcgcatggctgaccagacggaaggcgaattgctcggagacgaagtgcttgatgagctgtttgaagatgaatacgcaaaagggaatcaggcgttttttgagcttgcggacagatatacgacagacaggcatgatctggatcttcaagaccttgtcaaacgggtgtacgagtattcccgatcgcatcctgacccggaagcgtggctgcagagctttgtccgcttgtatgacgtgacggaagaaagcaaaatggaagagcttccgttttaccagtatgtgagagaagatgcggaaatggcgctcttcggggcaaaacaaaagcttgagaaggcgcttgaactgacaaaagcgcccggcgggccggccccgcgcgctggtgattttctggatgaccttcagcagatagaagagctgatcagctgccggcatgacttcgatgcgctgtatgaacgggtccccgcagtctcatttaagcgggcgaagccggtaaagggtgatgaatttgacaaagcgcttttggacgaagcgaccgatttgcgaaacggcgcgaagaaactgatcgaaaagttaaagaccgattactttacaagaagtccgcaagatcacttgaagagtttaacagatatgaagcctgtcatcgaaacgctcgttcagctcgtgatatcgtacggaaaacgatttgaagcggcgaaacaagaaaaatcaattattgatttctcagatttggaacattactgcctggcgattctaactgcggttgatgaagaaggccggcgggtgccgagcgaagcggccgtttattatcaagaccagtttcatgaagttctggttgatgaatatcaagataccaatcttgtgcaggagtctatcctgcagcttgtgaaaagcggggatgaacaggcgggaaatctgtttatggtaggcgacgtcaaacaatcgatctaccgtttcagacttgctgagccgctgctgtttctcgggaaatataaaaggttcacagaaagcggggaaggcgcggggcagaaaattgacctgaaccaaaatttccgcagccgttccgatattttggacagtacgaatttcttgtttaagcagctgatgggcggaaaaatcggcgaagtggactacgatgaacaggcggcattgaagctcggcgcatcgtatccgccgaatgacgcggcaaaaacggaactgctgctgattgacagcgctgatgacgcaagcagctccgaggatgccgaagactttgaaaccgtgcattgggaagcgaaagcgatagccggggagatccgaaagcttgtctcatctccgtttaaggtctatgacgggaaaacaaaaacacaccggaatatccagtaccgggatatcgtgattttgctgcgctccatgccgtgggcgccgcaattaatggaagagctgaaaaaccagggcattccggtgtacgccaatttgacgtcgggttactttgaagccgtggaggtggctgcggcgctttcagtcttgaaggtgattgataatccgtatcaggatattccgcttgcttccgtgctgcgctcgcccatcgtcggctgtgacgaaaatgaacttgcgctgatacgccttgaaaagaaaaaagcgccgttttatgaagcgctgaaagcatatatagcgaacggtgacaggcatgatgaactgtatcaaaaactgagaaccttttatgacagtctgcaaaagtggcggtcattttcgacgaatcattcggtgtctgagctgatttgggaagtataccgcgataccggatattttgactatgcaggcggcatgcccggcggaaagcagcgccaggccaatctgcgcgtcttgtatgaccgggcgcgctcgtacgaagcgacggcgttccgcgggttattccgctttttgcggtttattgaacggatgcaggagcgcggcgatgatctggggaccgcccgtgcgctcagcgagcaggaggatgtcgtgcggctgatgacgatccacagcagcaaaggacttgaatttcccgtcgttttcaccgccggactcggcagaagttttaatatgatggatctcaacaaatcatacctgcttgataaagagctcggtttcggcacgaagtatattcatccggaactcagaatcagctatccgactcttccgcttgtggcgatgaagaaaaagatgcgcagagagctcttatccgaagaattgcgcgtattgtatgtggcgctgaccagagcgaaggaaaagctgtttctcgtcggttcctgcaaaaaccgggaaaaacagctggccaaatggcaggcccaagcagaccgggctgattggcttctttctgaattcgaccgctatcaggcgtcatcttatttggactttatcgggccggcgctcatccgccaccgtgacatggaggcgcacaggacgccgggactttcttcgactgaggatatcttgcgcgacccgtcgcgttttcacatccggatgcttcagcaaagtgaattgctggaagagaatccaaaagaacgtgctgaagaaaagagcaaacgtctcgaggcgatacagcagggcgagccgattcctggttcgttttcatttgatgatcaggcgcgccgtctgcttgaatgggaatatccgtaccgagagctgacggctatcagaacgaagcagtcagtttctgagctgaagagaaagcaagagtacgaggatgaatacagcggccgctctctcatcaaaccgtcaggagacacgcttttatacaggcgtcccggttttatgatgaaaaaagggctgacagccgccgaaaaagggacggcgatgcatacggtgatgcagcacataccgctgacgcacgttccgactgccgaagaagcagagcggacggtccggatgctttacgaaaaagagctgctgacagaagagcagcaggaagccattgatatagaagaaattgtccggtttttcggaactgaaatcggtaaagaccttctcggagcgctgcggattgaccgggaagtgccgttcagtatggcgcttccggccggcgaggtgtacaaggatgccgaaacggccggtgaaccgctgctcgtgcaagggattattgactgcctctacgaaactgcggacggtctctatttgctggactataaaacagatcggatagaggggaaattccggaacggatttgaaggcgcggctccgattctgcaaaaaagatatgaaacacaaatcgaattgtatacaaaagcggttgaacaaattacaaaaacgaaagtgaaagggcgtgcgctctatttcttcgatggaggtcacgttcttacactgtaacgagatccgaagctcctttttggagcggatctttttttctatcaaaaagtgaggtgaatgcggtatgcgcattttacatacagctgactggcacctcggcaaaacgctggaaggcagaagccggctgagcgagcaggccgaagtactggaagagctgaataccattgtcaaggaagaaaacattgatgcggtcattatggcaggagatgtattcgatacggtcaacccgcctgcgctcgctgaacaattgtattacgaaagtctttccgcgctttctgacggcggaaaacgcccggttgtcgtcattgccggaaaccatgacaatcccgacaggctggcggcggcttctccgttaacaaatgagcgcggcattcatttaatcggctatccgcggacagaacccgtccatattgaggtgccgtcggcggacgagctgttagccgtagccgcgctggcatatccgtcagaggcgagattaaacgaagtgctttctgatacgtttgaggaaaagcttcttcgcgatcattacgatgtgaaaatcagagaggcgtttgctcacatgtgcgggctgtgccggaacgatgccgtgaaaatcgcggcgagccacatttatgtcgcggggggaaatcagaccgattcagagcgcccgattgaagtcgggggcgcttacacggtcgccgctgacagcctgccggctgatgcggcttacgtggctctcggccatctccaccgtccgcaaacgatcaagcgcgccaagacggctgcccgttattcaggctctccgctcgcatacagcttttcggaagccggttatgccaaatcggtgacagtggtagaagcgaagcccggcggagaagcgaagtgggaagagattttcctgtcttccggtaaaccgctcgtcaaatggaaagcgcaggggctgagcgaggttcacggctggcttgatgaagggcgtgaccggaatgcctggatcgatcttgatatccatttgacggatcagctttctctcgaggaaattcatcggctgagaaaggcgcatcccggctttatccatatcaggccggtttttgaagaaaaagagaccgaaaatgaccggattgaagtgaaacacacatcaattgaggatcgatttaagaagttttatgaaaaacaaacgggcggcggcgtgccggatgaggagatggtcaagctgtttttagagcttgcgtcagcagatgatgaggaggatgcgacatgaagccgattctgttaacgataaaagggctccacagcttcagggaggaacagaccattgattttgccggactgtcaggagccggggtgttcgggattttcgggccgaccggaagcggaaaatcgtcgatccttgatgccatgacactcgctttatacggaaaagtggagcgcgccgcaaataatacgcacggcattctgaatcatgccgaagatcagcttgccgtctcatttacattcgcgcttcaatccggccaccgggtttcctacaaggtcgagcgcgtttttaagagaacggatgaaacgaaagtaaaaaccgccctctgccggctgattgaaatcaaagacgaacaaacggtgctggccgataaagcgaatgaagtgaacaaaaaggtagaggagcttcttggcctgaccattgacgactttacaagagccgtcgttctgccgcaaggaaagtttgccgagtttctgtcgcttaaaggcgcggaaagaagacatatgctccagcgcctgtttaatctggaacagtacggggacaggcttgtcaaaaaattgcggcggcgggcgcaggaagcggcagcgaaaaaaaatgaaatgctggccgaacaatccggcctcggagacgcaggagaagatgcgctgaagcaggctgaacagcagtttcacgaagcgaacgaacggcttgaagcagctgagaagaaacgggtccgggcaaaagagcgttttgaaaatcaccaggaaatttggaacttgcagacagaaagagatgaatatgagcgccgggagaaaaagctcgaggaaagacgcccgtacatcacggatttgactgagcgtcttaaagaggcggaaacagctctcgcccttgagccgtacgcagaccgctgcaccgaagccgtccgccggaagcagcgcgccgaacaggaacacgaactggccaaacggaaatcagaggcggaaaccgtttcatttacccggcaaaatgaagcctatgaagcatggcgcgcccataaggccgaacaggagccgaaacttgtcaaggaagaagagctgtatcaaagactttcagccattgaacaaaaactgcttgaagcgaaaaaagaagcggaaaaaacaaatgcggagcacagcaaaaaagaggaagaatacgaagccgcctcgaaacagctggccgcagtgaaagaccgcctgacccgcggccaaaacaggcagaatgagctgaaagaagagctgaaagcagttcaagtgaccgccgatgaacggaaaaaatgccagaccgcagcacagctggcggcgggctttcagcagacacaggaacaaatcacgaaagagcgggccaatctgacaacgcagctgaaaaacgtggagaagctcaacggagaaagcgagtcgctcacagcgaaagcgaaaacggaagaggaagacattacgcgcgcttatcaaacgctgcaaaccgtttaccatatggtctgtgaaacggaacgttcactgaaagccgcagccgaacgggctgaaaaaacgcaagccgatctccgcaggcgctcagaggaagcgagaacggctgcattaacaaaagaattatcggaaaaactgatcgtaggaaagccttgtcctgtatgcggctcgacgcagcatgaccgcccgcgttccgctcatgaaacattctcgcctgataccgctgtgcaggaacatttgcagcaggtggaagcactgctttctgaggcggcggctctttctcaggaagtgctgacagccaaggttgcattagaagaacagtcggggcgttttaccgaagaatgtccgtttctgcaaagcgcccgggttccggagctggaagccgcttcttccatcagcggacgcccgcttgatgaagcgttcagcgccgtccgcttggaatggaaacaaatgaaacaggatatgctgtcggtaaaagagaaggtcacaagactgatcagcgcgcatcagcagacggtaaaacaagctgagcagcttgccgaacgaatccgctacgaggaaaaagaagccggccgtctcagacattcattagaagagcttgaatcgctgtcagaaagccgattgaatcagtacaacgaagtctgcggtgatattccgccaaaccggattgacgcctggcaggcttcgatagatgagaaggacaggcaggcagaagaatgtgagaagcgcattgaaacaagcatcgcattcctcaaggaacatgaagaggagaaagaacgcctgcaggagatgaagcatcggcttgaacgggaacggctcgagcttcactatgcgtctgagcgcctgcagcaggtgattgacggatatgaacaagagctcggaacagcagctgaagaaacatcaatttccgcaaagcttgaagcggtgcggcaggaattacagctgttaaaatcaaaagaacagtccctattcgatgcgctgaagcaggcgcagcaatcgctgaatgacgcaaaaggccgggaatcagggagtctcatgtcactcagggatgctgaggcctctcttgagaaagcgcaaaacgactggcgcgtgaggtcaaaagacaccgggtttaccgaaccggaccaagttaaaaaaagtctgcttccgcaagggcgtgcagaggaaatgaaaaaagaaattgatgagtttctggacacctccaaacagctatcggcaaatatcagccgtgttactgataaattagccgagcgccggatatcggaggaagaatggacagcatcggtttctctgctgaagcatgcagaggctgagtcaggcgccgccatggaggaaaaaggagcacaggcaaaagcctacgcggttatgcaaaaacagcataagcgctttaaagaaattgaagccgagctgaaaagctggcagacacagattgacaggcttgataagctccagtctgtatgtaaaggcaatacattcgtcgaatttttagcggaagaacagctggaaagcgtggctcgggacgcctctgcccgtctcggagcgctgacaaggcagcggtatgccatattagtcgattcagaaggcggtttcgtcatgcgtgatgacgcgaacggaggcgtcaaacggcccgtatcaagcctttccggcggggagacgtttctgacatcgctgtcgcttgcgcttgccttgtccgcccagattcagctgcgggggcaatacccgctgcaattctttttcttagatgaaggattcgggactcttgaccaagggctcttagacaccgttgtcacagcgctcgaaaagctgcaatcggacaacttatccgtcggagtgatcagccatgtgcaggagctgagagcgcgtctgccgaaaaaattaatcgttcatccgtccgaaccgggcgggaaaggcacccgggtcacattggagatcatgtagaaaggagaaggaattatggccgattctgccgagggcacatgtgaattatgcggccgccatcatgtgcggctgacggagcaccacttaacgcctaaggaagaaggcgggacattccttccgaccgcaatgctctgcatcccttgtcataaacagattcacgcgctctatacgaatcaggagcttgcggcaaggctcgcgggaatagaagagctgcggcgtgacccgaaactcgcgcggtttgtgaaatggatcagaaaacagccgccggaaaagcttgtaaaaacaaaaaaagcaaatgaacgaaaataacgctgaaccaaaagcagccctcttctgaaagagcggctgctttttaggcgtttccgaccacattttgatcgctgacatcggggtctatatagtttgtcgcattgacaacgttgtttaataacaggaaatctccggtattgcctgctcccgaaccgagcgcagatttagaagagctttttggagaaaggtaaaaggaatcaccaaagtttacgactccgcccgatatggaattgatagctataggtccggtaattgctggcataaacgacaccctttatagaagtctcaccgtcattatatgtcagggctgctgtgattgtgagcttggcgtgaagatctgcctaatatgtttcagccgcgaatctcccagaacgatcgacgtcgatccgatttgaaccacggacgctgacgataccccttgaattttcacattccttacccgaattgaagggttttcatggcagaatgcgctttggactcccgtttccggtaacggcatgacggccggctgccgaaagatctggtattcttttttgttaaatgagccttcatcatctctgtatacagcaagactacgctgatcggccaatactttgatccgcatattgatttcattcgtatcgcctgcttgaaagacactcgcaatcccgactgaattgattttggcgttccggaggcgtgaaatgcgctttaacattattccggcgccagcggcacataaggcccgataataagagattccggaggcgtgtcaaagatggaagacagatagacggaatcggtgtcgccgattaataataaggaagaactggatacaccggtagaccggatgtcgccgacttcaatgttccggttaatcactgtaaaaatcatgacggatcatcacctttcatttcaccaggtatgtgtttaataaagtgctcgacggccctgacaatatcacgcttcacatgttcggcaatctgctcggcatattgcgcgggcgccgtattttcttctttcgggacatgggacagataatactgaatccggctgtccatctgctttctgatatcttcaataatatgatatttgttcgcttcgtccagcctgctctcatactgagtttcgagctgctctaaaagcgcggggatttcttcattcaggtacatatcgacgttttgacggatttgctgcatttgctggcccgcctgttcctgctgcatcattccgacctgcggagatgtctggccgacttcgaagttttgcacggcattcggatcagtcggattcaatccgatattcagcgttccttccagccgttcaattttcagctgatcaaatttatactcgagccgatcaattcttgtagaaggctgctgcttcagcgttgaaatttcattttggaattctttcagctgccgttcgagctcctgaatctgctgcgcctgctgctggacgaaagaatttaaattctgcaggtaggatgaaacggattgatcatacatgacattcacctcgcgtctcgtttccttcattaaaactaccggcttggcggctggagcggtacaaatgatgaggtgccgggacctccccctgttgttacagcctgctgccccgcggtgacaggcggcgccggctcaacataactccctgtgttgtacagattggaaagagatttaattgaaccggcgcttccgatttgcagtatggaggaattgctgacagattctacacgcatgtaattgatatggatcgactgattgacgtaaaaattcatacggcgcctcctttatgcgtttcctgccatcggctgatcgattacatcattatcgtacacattcgttgaattcctgtaattcgtcagtgtgagattgtctccggtattgaagctgcccgctccggcaaatgtcttaacctctgcttttggagaaatggtgatgcagtcgccaatatgaacgactccgctcgtaccgacggcattaattttaaacgctccgacaattgcgggcatacgagcacatccttttcgtgaagattttcatgactgcactccaggagcttatctgggctgcctgcctaaaatagcttatgacaaatgcacatttttgtgagcggaaaaaactttagacgtaaaaaacaccggcgctttacacatgccgggtcttatacataaatgatacagatttatatacatatcacgtttatgagaaagcctcttttctttcgcggccgtgctgaatctgtgcggccgggttcgtcccgctgtctttcgtttgttggatgagcccgccccggcacccgtttaaaaggctgtccagctcctggctgcacctgatggtctccgtcgcattgattccgaatttttgcgctgtctcgaataaagttaatcttttttcttcaattttgttcatcgtgtgatctccaattctcgattattttggaaaacataggatgataatagtataacccattttggccaagaaggttttatttcgtcaatatgactaaaaaagtgacaatttttgatactcttttacacttattttcagcctgtttaaaagagggatttcccgttcggaggaagaatacataaaggaatgccatttaaaaatgatgggggattaacatgaaatttgcgacaggggaactgaacagccgaaaatttgtcggtctgattattgatgatgacaaaatcttagatctgcaaaaggctgaaaaaaaattgtttgaacttgagacgattccgggttcgctgatcgagtgcattcaaaaaggagataagtttgtcgcgcatgccggacagcttgcggaatgggcgaaaaaaccgaatgacgagtcgggttcatttatgtatgcgctgtctgacgtaacgctttgcgcgcctattccgagaccttcaaagaacgtgatctgcatcgggaaaaattatcgtgatcatgccgttgaaatggggagtgaggcggatataccggagcatcccatggttttcacgaaagccccggctgccgttacaggacacggagaaacagtgaagagccacttggacgtaacggagcagcttgattatgaaggggagcttgcggtaatcatatcaaatagcggatcgcacatctccaaagaacatgcgcttgatcatatattcggctatacaattgtaaatgatatcacagcgcgcgatctgcagaaaaaacataaacagttttttatcggcaaaagcctcgatacgacatgcccgatgggcccggtcattgtacataagtcggccgtcagcgatccgcaaagcctgaaagttgaaacgcgggtgaacggtgaactgcgccaatcaggatcaacgggtgacatgatatttccgatagctgaattaatcgagacgctgtcaaaaggaatgacgcttgaagccggtgacattatagcgacggggacgccgtccggtgtcggaaaaggatttaagccgccgaaatttttaaagccgggggaccgtattgacattacaattgaaccgatcggcacgctgtcgaaccaaatcggataattgtgtgtctttcgcacgcttgataatgctccgagaggcttgttgtggtaccataagtgaggcagattgatctgatagggggaattgaacataatgacacattggcatattacttcatgggtcgttgcgcttatcctggtgtttgtcagctacgggctgtacggtgccggaaaagcgaagggcgcaaaaattacgcatatgattctgcgcttattctacattattattattctgaccggagctgagctttttgtccgttttgcgaattggaacggagagtacgccggaaaaatgctgctcggcatcattaccatcggactgatggaaatgctcgtcatccgtaagaaaaaaggcaaatcaaccggcggactgtggatcggttttattatcgtgctcgtcctgacggtgctgctcggccttcacttgccgatcggctttcacgtattttaatcaatcgcttgaaaaacccggatgcatccgggtttttttagttgcgcaactgtgccgctgaatgagaaatgccgtgacagggggatggtgatgaggcgaaggagatgtgcaggatgccaaaagcatcaatcactcttgttgccgtaaaagctacggctgtgaagggtaaaagcaaacgccggccgtcaatcagcgtgaaaaacaaagctgaatacatcaggcggcacctatttaaaaggtgccgcctgtttgttacgcggtgccgtcttgttttgccgcagaatacataatggagcgccgcccgtcagatgccgtccattcaaatctgtcgtgtttacccgagctgccgcggtgatgctgcagggcgcattgtgcgtcatccgccgagaagtgataaaacgaaacgccttcaccggaaaacagcgcctgattgtaggaaaatacgcaatcatatacagacaggccgaacccgtgcagatggctgagaaacagcagaaacgtttcatcgtccagcgaatcgagcaaggttaacagcggccgtttgaccgctttttcataacggatttcttccccgccgagcagggggatggtgtctgcgccgatttcggccgaaccgccgcaaatccgtgccggctgccatcggccgccgtgtttcatcaatacggctgcgtttcctagactgtctgcaagcaggatatcgccttcatcgttttcgacgaggcagatgccgtcctctatcatcagggtgccgcgcccccatttgtttttttctgagaaaagctgttttcgtttcataaccgtgccggtctcctttgtttgtttcttctcttccgttctttccaaatcgggcttgtctcatacaagtcttagtgggacaaatcaactatctgagtttctttgcataaactgggtaaagtgctgatagaaacgaatttgaaaccgacagaaacgggattggagctgatatcacatgtgtggaattgcgggttgggtcgattttcaaaagcagctcgtccaagagaaacatattatgaacaatatgatagacactctttcaaaacgagggcctgatgattcaaacgtctggggagagccccatgttttattcggacataaaagactttcggtcgttgacattgaaggcggccgccagccgatggcctgcacgcatcaagaggaaacgtacaccatcatttataatggcgagctgtataacacggaggaattgcggaaggagcttcaggcgaggggccaccgttttgagaggacctctgatacagaagtgctgctgcacagctatattgagtggcgggaggagtgcgtggaccgcttgaacggtattttcgcttttgccatctgggatgaaaagcgcaagcggctgttcggggcaagagaccggctcggcgtcaaaccgtttttttataaagaacacggctcttcctttctgtttgggtcggaattgaaagccatccttgctcatcctgatgtgaaagcccgcacagacagcggcggacttgcggaagtattcggactcgggccgtccagaactccgggctgcggggtgtttaaaggaattcacgaggtgcgtcccgcccatgcgttcactttctcaaaggacggtttgtccatatggcgttattggaatgtaaagagcgaaaagcatacagacagcttcgatgaaaccgccgctcacattcggtacttatttcaggatgcagtgacacgccagctcgtatctgacgtgccggtttgcacgtttttatcaggggggcttgactcgagcgcgataaccgcgatagccgccgctcattttgagaaacaaggaagagatccccttcatacttattcaattgattatgaggagaacagcaaattttttaaagcgagcgcctttcagccgaatgatgacggcccgtggatcgataaaatgacaaatgcattcggcacacagcatcataaatgcgtgattacgcaggatcagctggttgaacatctggaggaatccgttctcgtcagagacctgccgggcatggctgatgttgattcatcgctattatggttctgccgggaaattaaaaaagattttgtcgtgagtctttccggagaatgcgcggacgaaattttcggcggatatccgtggtttcacaccgcggcagaagaagacggatttccttggatgaggtcgactgaggagagggtcacgctcttggatgaaaagtggcaaaaacggctgaatcttagagaatacgtgaatgcgagatatgaagaaaccattgcggaaacgccgctgttagacggtgagacgggaacagataaagcgagacggcagctgttctacttaaatatgctttggtttatgacaaatctgctcgaccgcaaagaccgcatgagcatgggcgcaagtcttgaagtacgggtgccgttcgccgaccacagacttgtggaatacgtttggaatattccttgggaaatgaaaatgcatggcagccgggaaaaaggcattttgcggaaagcgcttgaaggactgcttcctgaagatattttgtaccgcaaaaaaagcccttatccgaaaacgcatcacccgaaatacacgcagggggttacagaatggctgaaaacgattttgcaacagaaagattccgtgcttcacaccctgcttgacagaaagaagctggaaatgctgctggagacagaaggttcatcttttcaggtgccgtggttcggccagctgatgaaaggcccgcagctgatcgcccatcttgcccagatccatacatggtttgaggcgtaccgtatcgatatagaagaataacagtgccgcgaccggtttccgctgaaggatatcggtctttttattgtgaaacatatggtacactaaaaaacagaggagtgataccatgaccgaatatgaaacatgcgcccagcttgccgaggcgcactttcctttatataaacggactttctcatccctgccgccaaaaaacaggcgggccgcatgggcggtgcttgctttgtttcacgaagctgatcggcttgatgtgcaggaacttggaggatttgaacaggcggcacaagactttctgaacggggcactcgccgacggctttttgtgggaggcgctcactgatgtgcggcagcaatttgcgcttgaagaagagccgttgcgtgagtttatcgccggccacatctctgacagagaaaaagtaacgtatcaagagtttgatgacctgctgatgtacgcgggccgaacaggcggagccatcggcctgcttctgctgccggtttgcgcgcgccggaaccaagagaaactccgccatgcagccgtttcattaggagcagccattcagctgacccgggtgcttctgggggtccatacggatgagcggtcgaaaaagcgtctcccgcgccaggtgatgatgcaattcggctatacggaagaagagctggagagccgtactgtcaacaaagcttttatgaatgtatgggagtacatcgcattcgaggctgaggcgtatttcgaggaggcgtctgaagagctggagctgtttccgttatactcaaggcccgccgttaccagtttgctggcacattaccggtcagagctcggtgacatgagaaaacggctttcgcaagcataaaaaaacgcccggcttcttaacgaagctccgggcgtttatgcaatccctttttgaatccaaatccgcgaccgccatcttctgtacataagaatgcctctgacccattcatccgcgataaatgaaatccagatgcccataagccccaatccgaaatggatgccgaacagataagcgagaggcagtccgataccccacatggaaatcatcgccatgtagacggggaattttgcatctccggcagcccgcagcgagttgatgataatgacattaaatgaacggccgggctcaagaatgatcgtcatggcgatcagcatgctcgccgtcgcaataatgtcaggactgcttgtgaaaattccgatcagctgttttgaaaacaaggtcatgatcacggatgtcaaagcggcaatgccaagcgcccagtacagacttttcatgcagcggtcataagcgtcgtcaaaccgtttggcgccgatatatctgccgatcaaaatctgtgtgccctggctgatcgccgttccgaacagcaggataaacatggtgatgttttgtgtataaacctttgttgtaagcgcctgagcgcccataatggcgataaaataagtgacaaccatttgtgaaatgttgtaagacagctgttcgccggcagacggaatcccgattttcaggagtttccgcaagtgctctttatggacgtgaaaaatcttttgccatgtcagaccgagtccgatgcgttttttgacgatcacaatcatcgcgatcagcccgatgatccgcgcaaaggacgttgacatcgcaacaccggcgacgcctaacaccggaaggccgagcggcccgaaaatgacaagaaagtttccggcaatatttaaaatattcatcccgatcgtaacgaacatcgtatccttcgtatgaccgtagctttttaaaatggcgctgaacgtcataatcaaagcctgaatgaaggacagcccgccgaccacctgcaaaaagactttggcatccggcatcaattcattggaaagacccatcacatgaagcagcggaacggccgcaaaaaatatggcggcgctgatggcgagactgatgacaaagttcgctcctattgatacataagccacttcctgcgcctcttttttctgtttagatcctaaaaactgtgaaatcacaattgtcgtacccgttgcgataaagctgaacatcacgataattaaatttaaaatctgattgctgacacccacggccgccacactgttgtcagagtattggctaagcataagagtgtcggcgtttcccataaacatatataatgaaacctcaataaatatcggccaagtcagcgcgtataatgagagtttgtgatcagaggattgtttgaatgcagcccgttttaaaatcgcttgtttcatttcttttaacccctttcctgaaaaaatcaacgtttaaaagtgtacctccattttcttataataaaaagggagagaaacgaaacttcttgcaaaaatccgacttaaaaaggagggccggaaacatgtcctttctcgagttcacagtccctccgttcccggtctttatcgctgcgggagaaggagtgttcaaaaaaggcgaaacccatgtgagacgggtcttcccggtgtttgatctgctgtatgtgaaagaaggcgtcctctacattacagaagacgaaaacgccttttccgttgaagcgggagaatacattctgctttctcccggtcttgaacattacggaacaaaaggcagtgaagaaacgacatcttattcgtggcttcattttgaaggagcggattatgaggtgacggaaaccaccgggaacaactggtcggagctgaggcgaaaaaaagggagctttgaagagccgtcccgctaccggctgtccctgccgcaaaaagggaaggtgagacgcccgcagtttatggccgggcaattcagtgtgctgacagatgacagcgccgagaactccgacctgccgctcagaaagcagattctgtttgaagagctgctgctccatcttcagaaagaagcgttccaaatcccgtccgcaaaggaaagagtcgcatgggaggccgcccggtacctgcaggagcactatcaggagaaaacaaccatcaaagcgctctcttcggctcttcattacaaccaagactacgtgacccgctgcatgcagcaggtgctcggcgtcacgcccggccagtatacgaacaaagtcagaatgacggaggcgaaacgtcttttgtccgcaaccaatgacaaaatgggggcgatcgcggacgccatcggcatggaggacccaacctatttttccaaactgtttaaacagattgaaggcatttcgccgcttgaataccgcaaattcgtaagccggaaaacggactgacctaataccagagaacagaagagggatcggtaagcatgaaaatgacaatttacgacgtggccgaaaaagcgggcgtctccatctcgaccgtctcgcgggtcatcaacaatacggggaggatcagtgacaaaacccgccggatgatgctccgtgtcatggaggagatggactatcatccgaatgttcacgcatccgctttgacgggcaaaaagacgaatatgatcggcctgatcaccccggacatttcaaacccgtttttcggggaactggcgaaaagcattgaagacagcgccggtgtacttgggtttcatatcattatctgcagcaccgattatcagcctgaaaaagaaacgaagtatttttcgatgctgcgtcagaagcaggcggacggcattatattcgcgacgggacttgatcatgatgacagcgtcacggcgcttgatgatattgtgaaatcgggcatcccgcttgcgatgattacgcaggataaaccgctcgcgccgatggacgtcgtcattatcgatgactttctcggcggctatacggcggctgagcatctcatatctttaggccatgaaagaatcgcctgtatcgtcggaaacggctcgaccacgggtgaaagagacagaatcaaaggttttcaaaaagcgatgcgggaagcggggatgacactagatgaatcgctgatcataccgacggaatattcgctggaaagcggaaaacaggcagcgggcgagctgtttgacagagaccttccgaccgccgttttcgcctttaatgatgtcttgtcatgcgcggcgatacaggcggcgcgctcccggggcattcgggtgccggaagacttgtccgtcatcggctttgacaataccattctcgctgaaatgacggcaccgccgctcacgacgatttctcagcccatccgcgaaatggggcggcgtgtcgttgaacttctcattgatgagattcaagggaagaaaaaaacaaaaagcaaaatcattttatctccggaactcgtcatcaggcattctacggcaccggtaaaaacgcgccctcagcgataagggcgttttttctgtgaaaaacattgtcaaacgagcgaaaagcattgtaaaattaaaacagcttttgggaaagcgcttgcgcaaatactacggattgcaagcaaagaaagccaacagcttgagttataaataaaacgctttcaaaataataatttctgtttaataagggaaaccgcttgctcaattacggcatgcggcctcaagaaaaaaggagcggtgatagatgacagatcaagtcagatgtgcggtgctgggattaggacgattagggtattttcatgcgaagcatttagccggcgaagtgcggggagccgaacttgcggccgtctgtgacccgatgaaggggaaggcggaagcgtgtgcgaaagaattaggaatcgccaaatggacggagagcccgtatgaactgctggaagatcacacgattgacgccgtcatcattgtcacgccgacaagcacacatgcggaaatgatcatgaaggctgctgaaaacggcaagcacatctttgttgaaaagccgctcaccctgagtcttgaggaatcgattaaagtcatgaaaaaaatcgaagaaacggacgtcatctgccaggtcggttttatgaggcggtttgatccggcatacgctgacgcgaaaagaagaatcgacgccggggaaatcggcagacccatttattataaaggatttacaagagatcaaggcgcaccgcccgcggaatttatcaaacatagcggagggcttttcattgactgctcgattcatgattacgacatcgcaagatatctcatgaatgctgaggttacgtccgtgagcgggcacgggagggttttaaagcacccattcatggaggagtgcggcgatgtcgatcaggcaataacgtatcttgagtttgattcaggcgcggccggcgatgtggaggcaagccgaaattctccgtacggccatgacatccgcgccgaaataatcgggacggcgggaagcattttagtcggcacgctgcggaacagccatgtcaccattttaacggagtcaggcagcagctacgaaattattccggattttcaagcccgctttaaagacgcttaccgtctggagcttgagcactttgccgaatgtgtgaaaaaaggggaaacgccgattgtgacagacatcgatgccgcgattaacttagaaatcgggatcgccgcgacggaatcttttaaaaccggaaggcctgtaaagcttaccccgggcgcccccaactatgccggattatgatagattcgaagtgaaaaagcaaaggcacaggaggcctttgcttttttatgattcgtatgagaataaaatgtagtcagtcggcacgcctttatagcccatttggtgaagcatcgcgcttatattgccgcgatggtatgtgccgtgattcacaatatgccggatcacatcggcatatgtcgtccggagcgttcccatgcgcggatgagaaatggagatcggaccttccgtgttctccaagtctcttaaaaattcgctgtattctttgtccagttcagtcattctatgttcaaccgcctcaaaatctccgtcaagcttttcaaattgatcaaattgcgagacgatttgttcgtaagtttctccgtaaagcacgtgaagccaaatgtaatccgcccggtatatatgcacaagcacggcgttcacagtcggaaaaacactatccagtttctgctgtaagcttgccgcgggcagggtcttcagatgctgaataacttgctcatttgcccatctgtggtagtgatacagctttaaaatgtctgacattccaattccccctcttccttccggtacattcaacatgacctggccgaattccttttatcgaaacaaaagcgccgcaaaataaaaagcagcaccccacatcaccaatgccgagcattgattcaggatgccgaggagccggccgcctgtatccgccgtttggacgagccgtcccgcgaatgccagtccggcgaaccatacccaggaaaccatgatacaagcaccggcaaacagccatttatcaattcccggataggcggcggagcttgtgccgatgacactgacagtatccaaaatcgcatgcgggttcaaaagggataccatggcggccgtgaccgcctgtttttttgccgtgaaaactgtttttttcgcctgttcggcctgcggtttgcttctccaagtctgccagcctaaaaaactgagaaacaaaaagccgcctataagcatgacggtctgaaaaacgggaatctctgcaataatcattgacacgcctgcgacggccgcgctgatgagaatcgtatcgcataccgccgcggcaatcactgcgggaaacgcctgccacacatgtttttgccaggctccctgctgaaaaataaacacgttttgcgcgcccaatggcaaaataaggccgaaagcgagcatcactccgtgaagaatggcattcatatcgtaaaaccccccaatcgtcaactacatctcattgcagccgcactgtgtgctgatgtctccggccatttggctggtacttaaaccagccaaatgtataataaataaagaaggagggatgacgtatgaacagctggcgtccggatcgggagtcgcacataccgctttatctccagatcgaacagcatataaaagaaaaaatacttcatggcgaatggaccattggcacgaaaattccctcacaaagaaagctcgccgaggagcttcaggtcaaccgaagcacagtgacggcagcagttgatgagttaatcgcccaaggtcttctggaaggaaaaagagggggaggcacaaaggtcgtcaacaatacgtggagcatcatggcagcggctaagccccttgattggagcacgtacgttacatcggggagtcatcagccgaattcatccttgattcaggccattaatcaaaacgagccgcgtccggatctgatcaggctggggacgggtgagctgagtcaagagctgctgcctgagcaggagatgggcgaactgttccgtgaagcgggaactaacatttttgcgctcggctatgaagaaccgaagggcagcctgcagcttcggcaaagcgtcgcggaacatttgaaaacaaaggggattcacgcgtccccggcatccatcgtaatcgtctcaggcgcgctgcaggcgcttcagctcatttcaatcgggctgctaaaaccaaactccgtcatgctgactgaaaacccgtcgtatctccattccctgcgtgtgtttcaatcagcgggcgtcaagcttaagggagtgccgatggatgggagcggaatcaaaacggatcatcttcccgcttaccgtcggcaatacgaagcggggctgctgtacaccattccgtcattccataatccgaccggaacggtaatgtcactcaagcggcggaaggaactcatcgcgctcgcaagaaatcaccgtctgcctgtcattgaagatgacgcatacggtgatatatggatcgataaagaaccgccgcctccgttaaaatccatggacggtgaggggaatgtactgtatatcggtacgctgtcaaaaaccgtaagcccgggtctgcgcatcggatgggtcgtcgcccctgagccggttgcagacaggctcgccgatattaaaatgcagacggattacggctccagcgctttatctcaatgggcggcatgtcaatggctgtcaagcggccgctatgaagagcgtcttttgcgtctcagaaaggaactcaaaatcaggagagatgcggcattgcgttttcttgaaagatacgcgggagatattgcggagtggcgtgtgccggaggggggcttttatatttgggtcaccttccataaagcattcaccgttcagacgcttttcatccgtgccttggaggccggcgtgctgatcaatccgggagctctctatcttcccgaagaccggcaaagcctgcgtctttcctattcgtacgcatctttaccgggcttggaaaaaggcattcaaacgatagcggacattgcccgccgtttcgtttaataaaagatcacgtcacaatggcgccgagcgcttctgcgaatgtaacggcatgcgccggagagatgcggcatcctttcagcttatcaagcgagacatgcagatgatcaaatgtgcacgtgctgatatccatattaaaaagagacgtgccgatgaagtttgcgccgttcaaatcacagacgtcaagatctgtgtattcaagaacggcatcattccactcactttctgaaaggccgcacgagtcaaaacggacatgcttcatattggaatagctgaaggagctgtaatttgcgaggcagtcttcaaaccgtacatgacgcatggcggaatccgccagattcaagccgagaagttttgaatgctgaaacgccgttctatggatgatgcttccgctgaaatcagcgtttgagacatcgcatttgtcaaacaggacatccgtacattccatatgtctgaaagagatatccgtaaaaacgatgtttctgaaaatgactttttcggcacgcaggccgtccagtttgccgtttacgatgccgttttcaatgatgacttctttgagctcctcatcctgaagcgcttcagtgaaagaaagcaccggcaattctttcgggattttcggtttttggatcgtattcatctcatactcccttttctaaacataatagctgaaatcggcaattggcagatatcgctttctgcctgccaaccttgctgttgcgtaatgtacaaagggtattaaaaaagcgggagggcgtcaatagtgtcgcatataaaagcagacgtgacattcaaggtaatgcccttagagacatgtccccaagggcttttgtctgtttcaggcgagttctttatacatgatcacatgcgggccgatgccgggtatgtcaaaggggctgcccgtgcttttccagccgagcttctcgtaatatcccttcacgtgacatctggcgttgcaccagacaagcgccgcccccatatctgccagttttcgttccgcataggcgattaacgtgcttcccgctttttgcgtccggtattcttcaagcgtcgccatgccgcgcagctggtaggcgggcgccgcctgtaaagcctgctggttctgcgggtagaaagaagcgatgctgatcaatgtcccgtcgtaaaaacctccgagatgaaatgctcctttgacgctgtcctgatcatatttacaatcctcaatcgtctgatgggggcgcagcacgctgtgtctgatcgcgtatgtgtcttctgcggtgatgggttttacttcaaccataaaaaaatcctcctttgcttgattctttttctgtatcgtaccatgaaaaagccgcctgtcatatcaggcggcctcttccgcgtcaatgcaaatatacatcagcccgcttttcatccttttgcttaatataagctgcaagctctgatgtcaaatcagaacggagaaacggggtgattaaataaattccgttaaacagttcgcacgccgtgtcgagaagcgacttggcgatggcgaggccttcggttttctgcttttgcttgtcttcgccggcgagcgccattttttcccggatgctgtctgacagcttaatgcccgggatttcatgatgaatgaactctgcattgcggctgctcgttaacggcataattccgatatacaccggtgttttgaggtgtttcgtttcatgatgaatgtcaatgagctgctgctccgagtagacaggctgggacacgaagtagtcagctccgcactcgatttttttctccagccgttttactgctttatcaagatggcggacattcggattaaatgctccggctacggaaaagttcgttttcttgccgagcggtttccctgataaagaaatgccctcgttgaattgcttaatcagcctgatcaagtcaaaggacgttaaatcatagacggaggtagctcccggaaagtcgccgatttttgaaggatcacccgtgatggctaaaatgtcggtgagcccgagcgtatccagccccattaaatgtgactgaaggccgatgatgttgcggtctctgcatgtaatgtgaacgagagaacggatatcaaggcgttctttcagcaatgaaccgcaggcggcattgctgatccgcggtgtcgccaatgaattgtcggcgagcgtcagcgcttctatgccggtttcttttaattcagccgccgcttgcagaaatttgtcaaaattcaattttttcggcgggtcaagctctacgataattgaccgtttttgagcggcgatttcgtttaaaccaggctcggtccgttcattccggacggagatgatttcttcttcccgtctgattttcacttctttatcagtgacgggagaaagtccgcggaccgcttcagccatggctctgatatggtttggcgtcgtaccgcagcagccgccgataatgcgcgcgccctgagtgcggaactgtacggcgctctcccggaaataggcatcgtccgtatcataaacaagcctgccttcttctaaagacggaaggctgctgttcggatagaccgataaataagcgtcacggaaaatcggcacttcggtgagcgcttcaatcatgtggtacgggccgagccggcaattgattcccgttatgtcagcgccgagatcggcaattgacctgagggcttcccgaagcggtgttccgtcctgcagcacgccctgttcgtgcatggatacgttcagcataatcggaagttccgtttcttttctcgctatcttcagcacttcgcgcgcctcttctaaatcatagtatgtttccaagagcagaccgtccggctcttcgtgaagcaataaataaagctgctcccgaaagctgcgtttaatctcctccaggctgtaggcgtttttgttaaaggtgcggatgccgcccatcgttcccaatacataagcgccgtctgaggaagcgcgcgcgattctgaccgcctcctgattgattttttttgtttcatcctcaagtccgtatcttgagagcttaataaaatttgcgccgtacgtatttgtctggatgatgtctgccccggcttcgacgtaagccttatgtatccgcttgatttcctcgggctttgatacgttcagttcctcaaaacatctgtcaatgccgtaggaatagaggagagtgcccatcgcgccgtctccgattaaaatccgttcttttaagtcttgtaatagtcccattgtttgcctccttcgtcacattcagcaaggaaaaaagagaaataaaaaaagtcttcttaagaagaagactttgtaatcatttgtctctcttcttatcttccaagctgtttttagcttgctggatttagcaccttggtcatggtttgggttaaaccattacaccggttgctgaagcgtcgtcgggccagtccctcggcttctcttgataagaacgttcatataattgtcatgggtttccaaaacttaactgtgaaaatccctttctccaaatttaccgaaaatagagacaataatcaataggaatcacataatttatctaaaattaataaattgaacgtcaatcggcaggtctgccccgcggacggctgcaataatctgctgcagatcatctttattttttccggtgacgcgcacttggtcgtcctgaatctgagacttgaccttcaagccggagtttttaatcaccgcgttgatttttttggcgctgtctttatcaatgccctgtacaagcttcgcgcgctggcgcaccgtgccccctgaggcattttcgattttgccgtattcaatgtttttcgtcggcacgtcccgtttgatcagcttgccgctcagcacatctttgagctgattcagtttaaactcgtcatcagaaatcaggacaagttcttccttttctaaagttacatcgcttttcgatcctttaaagtcatagcgcgtgccgatttctttcagcgtcatctgaatcgcattctgcacttcgggaaattcaactttggatacaatatcaaaagaactttcttttgccatgagaaaacctcctataacatttcacttatgagttgattatagtagaataaagagaaatgtccaactgcataaagcatgaatttatgcatattggaaaaaatgagaaaaacatcagccccatacgggcgaatcaggaaggacgataacatgagaccagggcagcagctcacgcttagtatagatcaccaaaccgatttcggttattttttaactgacggcgaggatacggttcttttacataacagtgaaattacagaggatattgaagacagagatgaagtggacgtatttatttacgtcgatcatcaggaaagactcgcggcgacgatgaaaaagccgcttatcagcttttatgactacggatgggtggaagtgacggacgctgtggaggatatgggcgtattcgtcgacgtcggtctgtcaaaagacgcgctcgtcgcaacggagcacctgcctccgtacaaatccgtctggccgcaaaaaggcgacagactgtattgcatgctgaaggtgacaagccgcggacgcatgtttgccaagccggcgcctgaggatatcatcagtgaattatttacggatgcagaggaagacgtcatgaataaagacctgacaggcacggtgtacagactgatcgcatcaggctcttttctgattaccgatgaaggcatccgcgcgtttattcacccttcagaaagaaaagaagagccgagactcggcagccgcgtgacggggcgtgttatcgaggtgaaggaagacggctccgtcaacatgtccctgctgccgagaaagcaggatgcgctttcggttgacgcggaggagattctgacctatctgagatcaagaaacggcgcgatgccttacggagacaaaagcgatcctgacgatatccgcgaacggtttcatttaagcaaagccgcctttaagcgggcgctcgggcacctgatgaaaaacggcaaagtgtatcagaaagacggctggacatacgaaaaacaataaattttctgcaaaaacatcggtgaaccaaaaccggtgttttttattttctcaaaagctcctatatccctcatttgtttatcaacctgccgaacatacatattttattgaaataaaatattctgacatccgaaccgatatataactatagaaaaaaacaaaaggagagtttcaatgagaaaaatggcgatatttgcggctgtactgctgcttgcgctcagcacggcgggatgtgccggcaaatccgaggagacggcggccgaaaaaacgaaaacaatcggcatcatgctgacagacaacggcctcggcgaccaatcatttaatgattcaggctttcaaggtttgatgaaagcaagagacgagctcggcatcacatttgattacagagaaataaaagacaccggtacgtacgaaaaaggactgacccagcttgtccgggaaggcaatgatcttgttgtggggctcggttacagcatgcaggcggatttagaaaaggtcgccaaaaaatatccgaagcagcggtttgtgctgattgattctgtatcaggactggataatgtcacctccgtcacgtttaaagaggatgaaggaagcttcttagccggagcgctggcggctatgacgagcaaaaccggcacgatcggatttatcggcggttcagatgccgacgtcattaaacggtttaagaaaggctatctgaaaggcgcggaatcagtcaaaccgaacatccgcgtgctgtcggaaatcagcggtacgtttgatgatgataagctcgggaagcgcatcgcccaaaacatgatccgaaaaaaagccgatgtcctgtttacggcggccggcttcacgggtgtcggcgcactgaaagaagcggaggcgcgaaaagtatacgccatcggtgttgacagcgatcaatattacaccgccgagcacgccgttatctcttctttagtgaaaaacgtcgaccatgtcatctatgaattggcgaaagatttaaaagacaacaaggagatcaaaagcggtgagatcgtttacggactgaaggaaaacggcatggacttagccaagatcagagttgtcaaaaacgcaggcgggctgacgaaaaagatcacggatatgaaaaacagtctgattgaaaaaggaggcgatctgaagtgacattacggacaaggctgctcgttaacgcagccgttacgatgatttgcttcgccgccgtcatcggctttaccatcgtaaacatgatgaagattcaggcttcaaatgaagatgaagtggacacgctgttaaacgtccaggaagcaaaagctgaccttaatacgttaaaagaaagtatcaccggctattcctatacgctcgcagacgcccagaaagaagatgtacgaagctatatgaaaagcagctcagacaaactggcggcgctcaaaaaaacgatgagggacgatgcggacaaagccgcttttgacaaactcgccaaaaaatacgaatcatggcaggcggaggcggacgctgcccttgattcgaaaagcccggctgaagcgacaaggacggcggcccgcatcaacggtctcctgaatgatatttatatgctgaatctgaaaagccgggatcactatgaagacatgcagaagcagacggctgaccagattcagtttatcgtttacagcgcagccgtgctgaccatcgtgatacttgccgtcaccgtcatatcttccatcaggctgacgaagagaattgcagggccgatccgccgcatggctgaaaatgcccgtcgtattgcaggaggaaaccttgctgttgaaatgcttgattataaagggaaggacgaactgaaagagctgaatgactcattcggaatgatggctgaacagctccgcaccttaattcaggcgatcggagaggtcggccgtgaagtcgagacttttgcggaaggtttgacgaaggaaaaccagacgctgaaggacatgaccgagcaggtgtccgtatcgacggaagaaatggcgcaaggctcccaaaccatttcagaagatctgcagcatgcggtgcaattcattgaacaaatggatgaacattcaaaggcgaacgccgaacgttcaaaacaaacgacgagaagcagcgaagagacgattgctgcggtggctgcggggcgaggtgctttagccgagaccaagcaagccattgataaaagcaatgagacatcaaaagagatttccgaagccgccgatctcttcatagagcatgcggcaggcatcagtatgatggcgcagaccgtttccgacattgcgggccagaccaatctgctgtcattaaacgccgcaatcgaggcggccagagcaggcgaggccggaaaaggatttgccgtcgttgccgaggagatacggaagctcgcagacggatcagccaaagcgaccgcgcagattttcgatatggtaaagcaaattgaagacggcatcacatctattaccggagctgtcacgaccggcgtcgctttagcggacagacagcaggagctgatggagaaaacgtcagaatcattcgcccatattgaacaaaaagccgcccatattaaggcggagcttactcaattggacggacggatcatcgaatcgaaacagcttggtgagcaagtgctgcatcatgcagaaagcatcagcgccgtcgttcaggaaacggctgcaggaagcgaagagatttctgcctccgcgcttgagcagctgtcttcttttcataaaatggcggaaagcgtcaataatctggtgagcctgacagagcggttaaatgatcaggtccgccggtttactttgtaacagacatccgtgcgcaaaaaacagccctctttcttctaagacaagagggctgttttgcttttacagatggtccggttttttggaattctggttttttcccgcctgccggtttttttcggcaagccggttctttttctgatttacggcgttattgtccaacggttttttgtcatcatctttcatgcggcaaagcctcccttctgtccgttaggatgcccgcccgcattgaaattatggcttcaggaaaaaaatcgcgagcgtgcccggcccggagtgggcgccgatcgcagagccgattgaatgaagaatgatctctttcggatggaacgcttcttcaatcatttccttcatcccaatcgccgtctcttcattatctgcatagctgattcccacggtttgatccgcccaatcgccgccttcttccttcatcatttctataatccgtttaaacagtttcttctgtccgcgcaatttttcgagcggcacgagcctgccgtcatccacatgcagaatcggtttgatgttcaaaagccccccgacaaaagcggacgtttttgaaattctgccgccccgcgcgagataagcgacgtcatcgaccgtaaatatatgtttcatccgtgcgcaaaagttctttacagacgtttcgatttcttgtattgtattcccgttaacacagagtgtttgcgcgtgcatcaccgcgaggccgcagcccagtgaagcgcatttggaatctacaatccgtaaatcaaaatcgggaaattcctcttttacttcattggcgatcattacggccgtctgataggtgccggaaagacctgaggaaaaggcgatgtatatcgccggttctcccagttccgcgtattgtaaaaatactttttttatcgtatccggtgatgcctgggatgttttcggaactttcccgtcccgcatcgcttgaaagatatgatccgcctgaatggtgactgcgtcctcatattcgtttccgtcaagtgttacgtgcagcggaatgaacccgatccggttttcttcaatataagatttcggcaggtcagaggcgctgtcagcaataaggtgaactgtcatcataattcccttctttccggttggtgagagtatgccaactatatcatataaatttggcaaaatagtgttcaaaactttattttaagggaaaagctaataatgaaaatgagcggaggagcaagccatggtactagaacaagtaaaaaaattagcaatcgtcgtcatcggcgcgtttctgtatgcggcgggactgaatttattcctgataccggcgaatgtatatgccagcggttttaccggtgtcgcccagctgctgtcaagcgtcgttgatcaatacgcccccttttatatttcgacaggagttctcatgttcctcttaaacattcccatcggtgtgttaggatggctgaaagtcggcagatcattcaccgtgtacagcatattaagcgtagcgctgacgtccgtctttatggggattctcccggaaatgagactgtcacacgatattcttctgaataccgtattcggaggagtcatctcagctatcggcatcggtttaacgctgaaattcggcgcttcgacaggcggtcttgatatcgtgtcgatggtgctggccaaatggaaggataaaccggtcggcacatatttcttcattttgaacgggattatcattttgacggcaggattattgcaaggatgggagaaagcattatatacccttgtcgctctgtatgtcacaacaagggtgattgacgccattcacacgcgccacatgaaactgaccgccatgatcgttacaaaaaaagctgatgaaatcaaagaagcgatttacgggaaaatggtccgaggcattacgacggtgccggcaaaaggcgcttacacaaacgaacagaaagaaatgatgatcatcgtcatcacgcggtacgaattgtatgaccttgagaaaatcgtgaaagaagtcgacccgaaagccttcacaaacatcgtgcaaacgacggggatctttggtttcttcagaaaagactgataggagcggatagaatgaagtggctgtttggcctgttattaccggtcattttattgatcggatgcagcagtcaatccgggcagaaggagcccgctgaggaggtatccggagagatgaatgaacagcaagcggaattagccgtaaatcctgtgcagacagatcagcagatcgaatttcaaatgtctttaaaaaacaaaagcgaaagcccgatcgatttcacattcagctcagggcagaaattcgaactgaccgtacatgaccaacatcacaaagaactgtaccgctattcaaaagacaaaatgtttacccaggcgtttcagaccgtgaccttaatgccgaatgaaacgtatgacttttcagatgtgtggaagaacgtgcccggtccgggaacatacacggtgacggtgacgtttttagggaagtccgatcagatcggaaaaagactgaaaacggtaaaaacatttgaagtaaaataaaaaagtggcgccctcatctcaaacggggcgcctttttttattgcaatttctccagctgatcctgaaattggtgcagctgctgacgttctgcatccgtcgaattggcgtacgcggaagacacggcatttttggcgcgtgagacagctttttcctggtcgccgtcctcgaaaccgttagcaatcatgacggcctgctggacaaatgacttggcttgagaaaacagttcgtttctcattaaaagtcaacctgcctttcagccgaatcttttgctgcatcatgctgtgcttcctctaatgtagaccgatatggaaatcttgcgtcatgaagactgacagagtccttgccttgctgaataaaccgttttgatttgtttcgtttacccattgcaatgtcccccttccatatttagacgagatgagtcgtctgttttagtatgggcggaaggctttgtgttatgagcgggaaaacctcacagggagaaataggattttaaaaattcggcgattccgtccgcttcatttgaacccgtgacgcgatcggcggcctgtttgacttcatccgtgccgtttcccatcgctacgccgcacccggcaaatcggagcatttcaagatcgttgtcttcgtcgccgaacgcgatgatccgttctctcggcacttggtaatagtcgctgattttcttcaggccgaccgctttattcatcccgtgtttaataatttcaatcacatgccaaggagccgcccatcttctgtggtcaatgacctcggcgtgcacatcagataaatgcgcgcgtatgtccgcgacgtcctcttccttcgcgtgaatcaatacggacgtcacatcctcttggaccgtttcgcgcagatcgccgaatgtgacattcgccgtattcatatgaaacgcctcaattaaatgctcatcatgatagtggaagtacacatcatcaatgatctcagcgagcacattatgtatttgataggtctctgtaagttcggcaagctgtctgaccacatcgacagatagagacgtgtggtagcgtccccatgactcgtctttcgggtggtggacaaacgctccgttaaaattgacaatcggcgttgtcagcccaagctcgtcataatacatcgaactggaacggaaagggcggccggttgagatgcagacatgatggcccgcttctttcagcgtctgaatcgtccgtgccgtttcaggggaaatggttttatcatcttttaataaggttccatccagatctaaggcgatgaggtaaggttttgtctccataaataactccttttgtcatataatttgctgtttttctcttatgtacagtgtagctttttaccatctttattgtctacatgttacacttatgattatggttatcctaaggagggagtcaacgtgattcttattgatcatcaaactgtatcaggcattccgtttttacatattgtaaaagaagaaaatcgggaccatcccgctccccttgttttctttattcacggttttacaagcgcgaaggagcataatcttcatttcgcttacctgcttgctgaaaagggtttcagagccgtgctgccggaagctctttaccacggtgaacgcgctgaacagctgtcagcagaagagctcgccgtccatttttgggacattgtcttaaatgaaatcgaggagcttgacgtgctgaaaaaggattttgaagcgcgcggtctgattgaagacgggcggatcggtcttgcggggacgtcaatgggcggaattacgacattcggcgcgatggccgcgtatgattgggtcaaagccggcgtcagtctgatgggaagcccgaactatacggcattttttcagcagcagattgaccacattcaaaagcaggacatcgacattgacgtcacaaaagaacaggtcgacgaactgtttgcgcggctcaaaccgttcgatctcagtctggaaccggaaaaactccgcagccgcccgctgctgttctggcacggcgttcaagacaaagtcgttccgtatgcaccgacccgcggcttttatgaaacgattaaacctcattacagcagccggcctgaccatcttcagtttctgaaagacgaacgggctgatcataaagtcccgagatacgccgttttagaaaccgtcgcctggttcgataagcatttataaagcacaaaggtgttaacaatacccgcttttacgttatactgaggaaaaaggagtgatggaacgtggaagaagcattaaaagaaaacatcatgggcgccttggagcaggttgttgaccctgagctcggcgtcgatatcgtcaatctcggtcttgtatacgacgttgatatggatgacaacggcctgacgcacgttacgatgacactgacatcaatggggtgcccgctcgctccgatcatcgtcgacgaggtgaaaaaagcgctcgccgacattccggatgtaaaagagacggaagtccacatcgtctggaatccgccgtggacaagagacaaaatgtcacgctacgcaaaaatcgcattagggattcagtaataagaaaatgcacctcggattttaggtacatcctaaagtttggaggtgcttttcttttgtctgcatataagcgacggtgagggcttgttttggatcgcaaacaaaatcctcatatataaaatttcatatgaggtttatcttttttgtaataggacagtctgtcctggagtgtacctgtgtggaattcaaatttatgtccatcgggatcagtaaaataaattgacttttgatcttgcttatccctaggacgcccatttaatatatttacatttagattttttaacctttgatgtattgcatcaaaatcttttgggtcaattgtaaaggctgtatgcgtataggatttatgtatttcatttcttggtatatccgcctctaagttaagtgcaagccaaagcccgttcagatcaaaatatgctgtcttttgtcctttaaccagaagttgtgcatgaaatactttctcataaaattctattgatttttccaaatctgaaacagaaaaaagaagatgattgatcccttttatgttcattttccccacctcatttaacatctttgttttaaacaatccctttggtaatacatctgcatatatatcgattatatactgactaaaaatcatttttagggatttctgtgtattttttatgcccggtgttttccggatgaccgttttgaactgtactaaacatgattctgccggggcccgttttgtctgctttgtcgctgcagaccggcgtgcggaaagaagggcaagtcactaaaaaaaccaagtttcccgccattcgggggtttttgcggtatcgggttaaaaaggaaaaaaacggacggaggcatgatataatagaccggctgcatgcgagggaggaacccatgaagaaaaaattacttctcattatccttagcattcttgtttatacggcgctgttcgctgtttccgcctttcacaaagagccggagcggcaggcagggacaatgacggatgtcagccgtctcatgcccgtgaaaattaagcagacggtcaaaggaaaagagaaagaaacattggtcgaaacgattaaggaagcaaagagaaagcatctgaagatctcaatcgcaggcgcccagcactcaatgggcggccagacgtattatgaagacggtatcgttctcgacatgacgggctacaacaaaatactcggtctcgaccgaaagaaaaaaatcatcagagtgcaggcgggagcgacgtggaatgatattcagcgctatgtcaatccgtacgggctcgcggtaaaagtcatgcaatcgcaaaacatttttacgatcgggggctcactgagcgccaacgcccacggccgggatatccggtacggttcgctgattgatacggtcaaatcgtttcatcttttaaaggcggacggcaaagtcatcaccgttactccgaaagatgacctgttttcagccgtcatcggcggctacggcctgttcggggtcatccttgacgcggatattgagctgacggatgatgagctttatgaaatgaaaacgaaacgcatgaacgctgatacatacagtcaatattttacgcagcatgttcagcgcaaccccgccgtgcgcatgcatctcgcgcggatcgcaacaggggataaaggctttttacacgatatgtatgtgactgattacacactctcagacaaccagaaagaattaaagcggcacaatgaactgaaagaagatgagcatctggcgctgacgaaattcgcgctcggcctctcccgccggtatgactggggaagaaattggttctggtccacccagcagtcttattttctcagccaaaacggtgtgaaagtctccaggaacaatgtcatgcggtcagaatcgaagtttttggaatatgaaaacacggacaacaccgacgtgcttcaagaatacttcgtgcccgtcggcgaatttgcgccgtacattcatgatttacgcaagacgctgtcacatgaagagctcaatctcgtaaatattacgatccgctacgtgcaaaaaaatgaaaaagccgatctgtcatacgcaaaggaagacatgttttcactcgttcttttaatcaatgaagggttttcaaaagacagccaggcgagtacagcgcggattgtcagaaaaatgacggatacggcattgtgccaccgcggcagttattatctgccgtatatgctgtatcaaacgaaagagcagatgcgcgaggcatatccgaaaagcgatacgttctttcggaaaaaacacaaatatgatcccgatgacttgtttatgaattatttttatcagaggtacaaatcatgaaacacaaccatttaaaatggctgatcctgtctcagagcagtgtcttttttgccggcagcctgatctttccgttttatattttatttattaaaaacatcggttccagctacacgcaattcggtctctcatacggcttgttcggcctgagcggcgcattgattcatccgctgctcggccggctgtcggcaagactggatccccgctggttcctgatggcgaattcgtgggggatggcggtgcttcttctgacgctcccgcatattaccggcgtgcaccaggtttatgttgtgcaggtgcttttgggcctcttcggcgccatgcaaaaacacggcgagaaaatcatgatcgccgattacaccgacggcggggagcgggggaaaaaagtcggcagctatcatttctggacggccgtattttccgctgccgccattattctcggcgggtttctcgctgatttctttacggtttatattattttttacgccagctccgtgcagttttttataagcgggctgatgatgctgaaaaaaacagactgatccgatcagcctgtttttcttatgaaaccccctcgatcgagagggggttttttgtcagcgaaaaccgatggaaaatgaatgaaaaaatattaaatatacaattgaattaatttttattcatgttataatgttaaataatttcacaaaaaccaagaaggtgaacccgttgaaaataggtattataggcgcgactggttatggaggcgccgaacttgtcaggattcttaaccatcacccttatacagaagattgtatattatattcatcgagcgacgaagggaaagaatatgccgcttcatatccgcatttgaggaatatagcgtcacaatcacttcagccgcttcatatagaaacgattcgaaacgaaattgatgtcatgtttatagccgcgccgcccggcgtttccggagagtggtcgcccaagctggcggaggcgggcatcccggtcattgatctatccggtgatctgcggattcaaaacccggccgtgtatgaaaagtggtataagcggaaggccgcgccgaaaggaacgcttcaaagcgcggtttacggtttagccgaactgcaaaaagaagagattcagactgctaagctgattgccaatccgggatgttttccgacggctgtgctgctcgggctcgccccgctggcgaaaaataagtttttacaagattcatttctgattgttgatgcgaaaacaggcgtatccggtgccggccgaaaagcatccatgggcactcattattctgagctgaatgataatttcaaaatttataaggttaatgagcatcagcatactccggaaattgaacagcaattggcggcatggcagcccggcacaggcccgatcacgttttccgctcatttggcgccgatgacaaggggcattatggcgacgatgtataccgacgcccctccgggtatgtctgctgcacaggtaagagaattgtattccgaattctacaaagattcatattttgtcagaatcaggccggaaggtgaatttccggcgacgaaagaggtatacggcagcaatttttgtgatatcagtgtcaccgtggatgagagaacaaaccgtgccaccatcgtttctgtcatagataatctgatgaaaggcgccgcagggcaggcggttcaaaatttaaatatcatgaatggctggcaggaagaaacgggacttacgatgacgccagtctatccatagaacgaaagagggattcgaaaatatgattcagctgagtgaggaaatcacgaaaataaaaggcggcgtatcctcgccgaaagggtttgaggcaaagggcgtgcactgcggcctgcgctattcaaaaaaagatctcggagcgattatcagcgaagcgcctgcagtcagtgcggcggtatatacgcagagccattttcaggcagcgcccttgaaagtgacgcaagagagcttaaaaaaagaggccgtgcttcaggcggttattgtcaacagcgcgattgccaacgcctgtacgggagaccaaggattaaaggacgcctatgaaatgcgggacggcttcgcgagccagctcggcattgagccggagcttgttgcggtttcgtcaaccggggtgatcggcgagcttttagatatgaaaaaaattcaggcgggcattgaacagctcggtcaagcgccgtcagtgtccggagcatttgaagaagccattttgacgacggatacagtgacgaaacagacgtgttatgaactggtgatcggcggagacatcatcacgatcggcggagcggcgaaaggctccggcatgatccaccccaacatggcgacaatgctcggctttgtcacaacggacgcggccgtggaagaacaggcgctcaaaaacgcgctcagagagattacggatgtttcatttaaccaaatcaccgttgacggtgaaacatcgacgaatgacatggtgcttgtgatggcgaacggctgcgcggggaatgattgcctggcggaggatcaccctgactggccggcttttaaaaagggattaaagcttgtatgcgaagaccttgccaaagatattgccagagacggtgaaggagcgacgaaattaattgaagccagagtcgaaggcgcgaaaaataaccttgaggcgaatattatcgccaaaaaaatcgtcggctcaagccttgtgaagaccgccgtttacggcacagacgccaattgggggcgcatcatcggcgcaatcgggcacagtgcggcaagcgtaacggccgaacaagtggaagttttcctcggcggtcagtgtctgtttaaaaacaacgaacctcagccattttcggaaactgatgccaaggagtacttatcaggtgatgaaattacgattgcagtccgcctgcaggaaggctccggcagcggccgggcatggggctgtgacttaacctatgattatatcaaaatcaatgcgagctatcgcacataacaaaggggagcggcatgaagaaaaccatcgtttttaagtgcggcggaagcgtaatccgcgagttatccgccgatttttttcaaaatgtaaaagagcttatgcaatcgagctggaacattgccgtcgtgcatggaggcggcccggacatttcaagaatgctgaaaacattgcagattgaaacggaatttgtcgatggacagcggaaaacgaccaaaccggtgctggaaacagcggaaatggtcttgtcagggacgatcaataaatttttcgtaaccgaactcgcgaaaaacgggctgaaagccgcgggaatatcaggaaaggacggcggtctccttcaagcatcttaccttaatcaagacaaatacggagaagtcggcgaaatacaaaaaaccgatccgtcaatcattcacgcattaatgaaagaaggcatcattcccgttatcgctccgctttccatgacaagtgatttcgaaacgctgaacgtcaatgcagacgccgcggcatcggccgtcgcttcagccttacacgccgataaacttttatttgtcacggatgtcgaaggaattatggacggagagagcaggctggatactttgacgccgcaagaaattcaggcccttatcgatgacggcgtaatttcaggggggatgattccgaaggtaaactcggcattatcggcactgagtgaagatgtcgcggaagtgatgatcgtaaacggaaaaggagcgtttttcaccaatcaagccttccgaggaacaaaaatcgtcaaagaaaaggagagcgtgtcatgagcagcctatttcaaacctacagccgctggcctatcgatattaaaaaagcgaaagggacaatcgcagaggatgaaaacggaaaaacgtatctcgattttattcagggcatcgccgtttccaatctcggccattgtcatgatgcggtgacagaagcggtgaaagaacagcttgacagcgtatggcacgtttccaatctgtttgaaaatgatcttcaggaaaaagccgcggcaaagcttgccggacatagcgagggggatctcgttttcttctgcaacagcggagccgaagcgaatgaaggcgccattaaacttgcccgtaaagcaacgggaaagacaaaaatcgtaacattccatcaatcctttcacggacggacctatgcggggatggccgccaccggacaagacaaaatcaagaccggtttcggaccgatgcttcaaggctttcactatcttccgttcaatgatccgtcggcattcagcacgctttcaaaagaggatgatatcgccgccgtcatgcttgagacggtgcagggagaagggggagtcaatcccgccgatccggaattcatcgaagccttacagacattttgcaaagacaaacaggcgctgcttatcgcagacgagattcaaactggaatcggccggacgggcaaggcattcggctatgagcacttcggcatctctccggacattatcactgctgcgaaagggcttggaaacggttttcccgtcggagccgtgatcggcaaaaagaagcttggcgacgcctttacgccgggtacgcatggtacgactttcggcggcaataagctcgccatggcagctgtgaaagcaactttggacattgtgtttcagccggactttctccaggcggcggcagacaaaggctcttttttaaaagcgcagctgaaccgtgaactgacagggccttttgtaaaagaaatccgcggaaaagggttattaatcggcattgaatgcgcaggtcccgtgtccggcatcatcggagatctgcaggaacgcgggcttctcgtgcttccggccggaccgaatgtcatcaggctgctcccgccgcttacggtttctgaagaagaaatgctgtcggccgtcagtatgctgaaagcagcgatcgaagcgcattcggcagtgaaacggtaatttttttcaatataaaagtataaaaattcatttttttaattaattattcatcaagaggtgggctttagatgaaaggctatttagtattggaagacggaacatcattcggcggtgaacttgaaaaagaggcccgctgtgttggagaagctgtttttttcaccggaatgacgggctatcaggaagtgcttacagacccgtcatataaggggcagattatcgtctttacgtatccgctgatcggaaactacggaattaatgaaaaagaccttgaaagtaaaattcctcaagtcaaggctgttgccgtctatgaagcgtgtgaacatttttctcaccatgaagcagtctcaagcttgagagagtatttaaataaatggaacgtcccgctcttaaccgaagtggatacacgggccgtcgtcaaaaccatccgctccggcggcacgatgaacgctgccgtgtcaacaacaggagaaattcccgcagcatccggaacacaaaacccggcggagctggcgcagtctgaagacatcacttcaatggggaacggagaccggcatattgcgctgattgatttcggttataaaaaatcaatcgcctcgtcacttgtaaagcgcggctgtaaagtaacggtcattccgtatcagcagatggatgccgtttatgacattcagcctgacggaatcgtgctctcaaacggcccgggcgacccgaaagcgattgcgccgtacatgaaccggattacatctttactcagtgatttccccgcactcggcatttgcctcgggcatcagctgattgccctggctttcggaggaaatacgtataagctgccgttcggccacaggggtgccaaccatcccgtcattgaccggaaaacgaaacgggtgtttatgacaagccagaaccacagctatgtcgtcgatgaagcgtcaattgacgaaaacgaactatcgatcagatttcatcatgtcaatgatacatcagtggaagggctcattcataagcgccttcccgtattaagcgtccagttccaccctgaagctcaccccggaccggctgagagcgagtggatatttgatgaatttctagagaaagtgataccagcaaggagagaaatcgctcatgcctaaagatacaaccatttccagcatattagtcatcggctccggccccatcatcatcggccaggcggcagaatttgattattcaggaacgcagggctgcatggctctgaaagaagaaggataccgcgttattctagtcaataacaacccggcaacgattatgacggatgaggcgtttgccgatgaaatatattttgaaccgctcacaaccgacagcatcgaggccattattgaaaaagaaaaacccgacggtctgcttgccaatttgggcggccagacggcattgaatttagccgttaagcttgaagaagcaggcgtgctgaagaagcatcacgtcaagctcttaggaacatcggtggaaaccattcaaaaaggcgaagaccgggagcagttccgcgctctgatgaaagagctcgaccagcccgttccggaaagcgaaatcgtcgataacgaagaagacgccctccgcttcgctgagtctatcggatttccggttattctgagaccggcgtacacgttaggcggaaagggaggcggaatcgcgaaaacgaaagaagcgtttcagacgcttattaaacaggcgctgttagcaagcccgatcagccaatgcctcgtcgaaaaaagcattgccggatttaaagaaatcgaatatgaggtcatgcgcgacagcaatcatacatgcatcaccgtctgcaatatggaaaacatcgatcccgtcggcgtgcatacaggagactctatcgtcgtcgcaccgtcccagacgttaacggatgaagaatatcagatgctgcgttccgcaagcctggcgataatttcggcgctggatgtggtcggcggctgcaacattcaatttgcgctggatccgttcagcaaacagtactatgtcattgaagtgaacccgcgtgtcagccgttcatcggccctcgcgtcaaaagcaaccggctacccgattgccaaaatggcggcgaaacttgccgtcggctatacgctcgacgaactgaaaaatccgctgacgggctctacttatgcaagctttgaaccggcgcttgattatgtcatcgtcaaattcccgcgctggccgtttgataaatttaaacatgccgaccgcacgctcggaacgaagatgaaagcgacgggagaggtcatggcgatcgaaagaaatatggaagcggccattcaaaaagcggcggcctcccttgaactgaaaacgatcggcacccgcctgcctgaactcggcggctgtacgatcaatcagctgtgggaattagcggtaacgccggatgaccggagatttttcgtcgtcatggaactgttaagccgcggtgaaacgatagaagatatccatgccaaaacgaaaattgacccgttttttctccatgtattccgaaatatcatcacattggaaaacaagctgatggaagaaggggatcatctgtctgtcccgcttttaaagcaggcgaaggtaaaaggcttcacggatgtcatgatcgcatctctcacgggaaaaacggaagaagacatccgtgctctcagaaagaaatcaggcatcgtcccgtcgtttaaaatcgtagatacatgcgccgctgaatttgatgccaagacgaattatttctactccacctaccttggggaaagcgacggagatgtcagccgaaaagagaaaaaacgcgctctcatcatcggctcaggcccgatccgcatcggtcagggagtggaatttgattacagcgccgtccacggcgtcctgaccctgcaaaagctgggatatgaaacgattatgatcaataacaatccggaaacagtaagcacggattatgaaatcgccgaccggctttactttgaaccgctgacgacagaacatattttaaacgtggcggaacatgaaaacattgattttgccatcgtccagtttgggggacagaccgcgatcaatgccgctgaaccgctggaaaaagcgggcattccgctgctcggaacatcctttgaaacccttgatgcgctggaggatcgggatctgttttatcagctgcttgatgatcttgacctcaaacatgccaaaggcgaaacggcttattcaaaagaagaagcaacggaaaaagcaagccgaatcggctaccccgtgctgatccgtccgtcttatgtcatcgggggcatgggcatgatcatcgttcattcagaagcgcaaatgtcagagctcctggaaaaagaagcgggcatgccgtacccgattttgatcgatcagtacattacaggaaaagaattggagatcgatctgatttccgacggacatgaagtattcgtgccgacttacacagagcacattgaacgggccggcgtccattcgggcgacagttttgcgattcttccgggtccgtctgtcacacctgatatgcagcggaatataaaagaggccgccgaaaaaatcgcggtaaaactggcttttaaaggcattatgaacattcagtttgtcattgatgacaaaggggatattctcgttcttgaagtgaatccgcgggcaagccgcacggttcctgtcgtgtctaaggtgatgggggtgccgatgatcccgcttgccgccagattgctggccggcgcttcccttaaagacatcaagcccgaggttcaaaatcagcacggaactgcagtgaaattcccggttttttcttctcacgccattcaggatgtggacgtaaagcccgggccggaaatgaagtcgaccggagaaggcatgtgtgtcgcgtttgacgcagaaagcgcactgaaaaaaatctacgcgcacgtctgggagaaaaaaggcagcatctatctggaaggctgtgatgcggaattggaacgtcaggctcaagaggcgggatttaccgtatgcaaagatgcgttcccggcatgggcagagcgaaaggataaagcggtccatattaatttcaatcactctgaagaagcgcgtaaacaacggatcgaagccatgacgcacggtgtgacggtctttactgaaccggaaaccgtaaaggcatttttagcaagcggctccggcaaacctcagcctgtatcgctcaaagatctttatcaaaaggaagtggcatcatgcacacaataaaagcggaacacacattaacccatttgtacggcaaagattttctttcattaaaagatgtcagcccgtcagacatcaatgcgcttctgacagaagcttcattattaaaacaacatccgatacagccgattttccaagggaaaacattggcgatgatttttgaaaaatcttcaacccgcacacgtgtgtcttttgaagcgggaatggcccagctcggaggaacaggactatttctttcaagcagcgacctgcagcttgggcggggggagacggtcgcggatacggcgaaggtactgtccggcttcgttgatgccattatgatccgcacctttgagcatgaaaaagtcgaagagcttgccgagcatgcagacattcccgtcataaacgggctgaccgaccggtatcacccgtgtcaggcactcgcggatctgttaacgatacaagaaataaaaggaaaattaaaaggagtaaaagtcgcctatatcggtgacggaaataatgtcgcgcattcacttatgatcggctgcgcaaaaatgggctgtgacattgcggttgcttcgccgaaaggctatgaagcagaggaagaggcagtgaatgccgcgagagaagcggcggctgtttccggagcgaaaatcacccttaccgaaaatccgcaggaagcggtgcgggatgcagacgtgatttactccgacgtcttcacgagcatggggcaggaggaagagacgcagcagcggctgaatgtgtttgcaccgtatcaagtcaacgcctcactcgtcagtctcgccaaacccgactatacatttttgcattgcctgccggcgcatcgggaagaagaggtcacgtccgagattatagacggtccgaactcggcggtattccagcaggcggaaaaccggcttcacgcgcaaaaagcgctcctgaaagctcttctttacaaacaggatgaacaaaaaaaccgctgaatctcattcagcggtttttgatatttctccgcatacaagcgcatactacataaaaaagaaaaaggaggaaatgacgtgggacagcagcatcaattccgaccgggacaaaaagcgccgaataacggtgtgtacgttgaaatcggcgaaacgggaagcatggtcaaaaacccgcaaaaaatcaagcttacggtgggagaaatgttccctgaaacttcaaaccacaacagattgtggacgtaccaacgaaaaccgtgaacacaaaaaaacctgctgaatagcaggtttttttatttaatgctggtttgcatcctgtttgacaggcatgatctccgcaagaacaaagactagcaccgcaataaccacggcaataacggatgattgcttgaaattgtacgccgcgctgttcatggaggcgatcaaataacaggccatatgtgttaaaaggaacgtccaaataaaaccgataactaaccgcacgtttccacctcgtccttcattttattctacgttgtatcataccatacataaagcgcgggcggaaggtcattttctcatcaaaaagcgcgcctgaaactgacatatgcccgcctgtccggccgtctgacggaaaattcggttcctgtgcttgggataatagccaaaacatagcagcaaataggagtttatccgatccgttttcattcttcttacatatgatagccaatagagagattaggagtaaaaggaggcgggcaggcatggggataacggaaagatttttccaattcggatctgagctgaacgtcatccatctgccgtatcggccgaacggcttctgtatctttattctgggggacagaacccactttgtcagccgggactcgagcttttggctcgaacatgaagggagaaaccggctgttaaatacgctgcttgacagagggtacaccattttcaacagcaatttatacggacggcattggggttcggaaaaagccgccctttacgccagacagctgattcattatgtgctgaaacaagaaaccctcaatccgaaaatacatttgctcgcagaaggcatgggcgccctcatcgccgatcaattgctgcagtcttcaccggagcatatccgttcagccgcaatgttagatccttgtcttgatcttcaagcccattttgaatcagagaaagaaaataagtttttttataagcagtttctgagggaaacggcacaaagcttcggtgtttctgaaaaagaggcaagctcactgagctatcagaccattaccggctgccgcacccgcgcgccggtacatatatggcaaagaacgaccggagcgccgtacccgtacaccctgcatgcgaacgcgtataaagaagcccgggaaaagaccggaagcaagactgatatcacgtatcacctgcttgagaaccctgctcgtatttacagagccatctgccggtttttccgcagtcatgaaaaagacctgtaatgaatagaatacaacagccatctcttttcagagggctgtttggcttgtgtgtgaatgaaaaaccggaaaggcggcagatgtgatgaaaacagcgctgatcattggagcagatgaatttctcggcctttcattgtgcgaacggttgatggatgagggtgtgcacgttgatgtcattttggcagaaccggaggacaaaacgaggcagctgtatttagaagaacgtttaatgtggctcgcgaggaacgggctttttcaaataataggtgaaatcagtgaaaaggaatacgatcgtatctgcgttcaatacgggagcgggtgtctgcccgaagaaagggctgagcctttatattggattgtttacagtgaggatcaaggagactgggaaaaaaacggtcagcgggatacggcaaaagcgattatccttcctcccctttacggtccgtggacggaagaaaaagaagatggcgaaagcaggatctttttagaagacgcggtctgcgggctgatgaataagctggaggctgacggcacagaagacgaaaatcagattattaccctggaaataaaagaaaaaacgcaaaaaacagaagcggaagaaaaaattaaagaatggaaaagacaattttcatcaatattcgacattttttaagaaataccttccatgttatgtgcattaccgctacaataaacgtatatcaattatatatgttatgagtttgaaaaggggttgaacatggcttgatcaccaggcttgtcatgatcttttctgtcctccttttattgagcggatgcgcacaaactccgtttaaaggaaaaattgagaaggtcggaatgctttttcccgataccatcagtgacttggtatggggcacaaaaggttacaaaggtttattagcgatacaatctgaatttaacgttgacgtttattataaagaaaatatcagatccgatgaagatattttaaaagcgatagatgattttcataaaaaaggagtcaatcttttatacgggcacggaaatgaatacgaggaaatcttcaatatgatcagcaaggattatcccgacatggaattcgtcgtcgcaaacggaacggcgaaaagcgataatgtcacaagcgttcaccttatgggagaagcaatgggctttttcgggggaatgacggccgcccatatgtcaaaaaccaatgaggtaggtgtcatcgcctcctttctgtggcagcctgaagtagacggctttatcaaaggggcgaaatatgaaaagcctgatatcaccgtcaatacggaatttacggaccactgggataacggcaatgaagcgctgcatctttacgagaagttaaaagcggaaggcacggatgttgtatatccggccggagacgggtataatgttcctgtcattcagcaaatcaaaaaagacgggctttacgccatcggctatgtcgccgagcaatcgaatctcggcaaaaacacggtgctgacaagcacggtgcaaaacgtagataaagcctatacattaattgccgagcaatataataaaggtacgctcaagagcggagatcacgactttgatttcagggaaggagtcgttgaaatggggacgttcagcccgctggtggacaaagcgtttcaagacaaaatctcagaccttgtaaaaacgtataaccaaacaaatgaactgccgtcaaatgaatagaggtggatacacatgcagcatgaaaagtctcttgaatttatgcagatcgcgatgaaatacctgccggaagcaaaggcggagcttgagaaatccggcatagatctgtctatggaaatgattcagccgtttatggacctgtttacatcggtcatggcggaagcgtatgagcttggcagatctgatgccggggagctgaataaataaagagagccactttttcatgaagtggcttttcacatgatttttttctttatggcggacaccatcggcgcaaagtctttaaatacgggctttaattgatccagggagttcatgatggaccccagctgattcaacacgtggttgtaatcgatctcttcttcgttttcagcctgaggctgctccgggttttcttccggctctttatcccggtctctggaatcgccgaacatcattttggagaaaatatccatagtgaagcctcctttcgtcttccttttattctatgaggagcagcgtccgatagtttagacgaatatattgccaacagaaaaaaaatagggtagaattagtacctgatactaataattgatcataactaattagttttaaattcattataaaaaaggagtcttttccaatgaaagctggaattcttggcgtcggccgttacatcccggaaaaagtgctgacaaatcatgatcttgaacaaatggtagatacatcggacgagtggattcgtacgagaacaggtatagaagaaagaagaatcgccgcggaagatatgtattcatccggcatggccgccgaggctgctcaaaaagcgcttgatcaggccggcatttccgcagaagagcttgatatgatcctcgtggcgacggttactcctgaccagtctttcccgaccgtttcctgtatgatacaagagaagctcggggccaaaaaagcgtgcgcgatggatatcagcgccgcatgtgcgggttttatgtacggtatcgtaaccgccaaacaattcattgaatcgcaaacatacaaacatgtcctcgtggtcggcgtggaaaagctctcaagcattaccgactgggacgaccgtaatacggctgtgctgttcggagacggagccggagcggcggtcatcggaccggtcagcgacgacagaggcatactgtcatttgagctcggagcagacggtacaggcggtcagcacttgtacttagatgaaaaagggcatacaatcatgcatggaagagaagtattcaaattcgccgtccggcaaatgggtgaatcgagtgtaaatgttattgaaaaagccggcctctccaaagaggacgtagactttttgattccgcatcaggcaaacatccgcatcatggaagcggcacgggaacgtttggagcttccggttgaaaagatgtctaaaacagtccataaatatggaaacacatccgcagcatccattccgatttcattagtagaggaactggaagcaggcaaaattaaagacggcgatgtcatcgtcatggtcggtttcggcggaggattgacatggggcgccatagcaatacgctggggacgataaaaaaaggtgaggtgcacacaagatgagtaaaaaaagagtagtcgttacagggcttggagccttgtctccgcttggaaacgacgccgaaacaagctggaaaaatgcaatcggcggcgtatccggaatcggaccgatcacacgtgtggaatcggacgagtatccggcgaaagtagctgctgaactgaaagatttcaatattgaaaatcacatggataaaaaagaagcgcgaaaaatggaccgcttcacgcaatatgcagtcgtagccgcgaaaatggccgttcaagatgccggtctgaacatcacagacgagatcgcgccgagagtcggcgtttgggtcggatccggaatcggcggtcttgaaacgcttgaatcccaattcgaaatcttcctgacaaaagggccgagaagggtcagcccgttctttgttccgatgatgattccggatatggcgacaggccaaatctcaatcgctctcggagcaaaaggagtcaactcctgtacggtgacggcatgtgcgacgggaacgaactctatcggtgacgcgtttaaagtcattcagcgcggcgatgccgatgcgatgattacgggcggaacggaagcgccgctgacaagaatgtcatttgcgggcttcagcgcaaacaaagccctttctacaaatcctgatccgaaaacggcaagccgcccgtttgataaaaaccgtgacggctttgtcatgggagaaggcgcggggatcgtcgtgcttgaagagcttgagcatgcccttgcccgcggtgcgaaaatttacggggaaattgtcggctacggctcaacgggtgacgcctaccacattaccgcgcctgcccaagacggggaaggcggtgcaagagcgatgcaggaagcaatcaaagatgcgggcatcaagcctgaagaaattgattacatcaacgctcacggcacaagcacgtactacaatgataaatacgagacaaaagccattaagaccgttttcggtgatcatgcgtacaagcttgccgtcagttcgacaaaatcaatgacgggtcatttgttaggcgctgccggaggaattgaagcaatcttctccgtcatggcaattaaagacggcattatcccgccgacgattaacatcgaaacacctgatgaagagtgtgatttagattatgtaccggacaaagcgcgcgagcaggatgtcaacatcgttctcagcaactcgctcggcttcggcggacataatgccactttgatctttaaaaaatatcaataatacagtttttgaccggctgcctgaaaaaggtggccggtttttttgtgcgtgcatatgataacaacaagaggaggcgaacaggtatgagcgtcaagcagacatatcaatggatggaaaaggcggcatccgtaaatgacctggccccgcatcttttgccgcttttttcaggggccgataagaaagagtggaagccgatactcgggatgctgcaaaaccacggcatgttccgccatctgaaggacggcgttaggaccagtaaacggctgaaagaaaaaggatgctacagccatatacaaaaggaggaagcctatttaaaggagaagtggaacgggccggacgtgccgatcgtagttttgcccgttgatgaacgaaaccggaaaatccgtcaggaattcggatcaaaatccggtctggcctttcgggacaaaatgttcctctttctatcgtcggatagttccaattcagctgtatccgcccttatgacacatgaatataatcacgtctgccggttagaacatgtgacaaaggacgaaaaagatgagacatttcttgatacaatcatgatggaggggctggcagaatatgctgtatatgagcggttcggctcaagtcttacggcggaatggacgtcctactatacgcctgagcagcttgactttttgtttgaaaaaagagtcaagccgaacctccgcttaacgagagacagcagaatgttttcccagctgttatacggaaaaggatacttcccctcaatgcttggctatgccgtcggattcaatatagtaaaaaaatatttaaccgaccatcaaaaaacagtaaaagaagcattggccatcccttcaaaaacctttctggaagcaacgctttaatagattaaaagaatggaaattatttaaggatattacatttatcctaaaaaattcttgcttttgtaataatgatgtaataatatacaactataaaatttttcgactattctatattttgtgatagcgaaacgtatgtttccctctgcttcagcggaatgagaaaggggcgtatcatgagcacactattagaagtgaataatttaaagacctattttttcagaaagaaacagccgatacccgcagtcgacggggttgattttcacattaacaaaggcgaaaccgtcgctcttgtaggagaatctggctcgggcaaaagcatcacctcgctttctattatgggacttgtccaaggctcgggcggaaaaattatggacggctcgattaagctagaaggcagggacctggcctccttcaccgaaaacgaatattgcaaaatccgcggaaatgacgtctctatgatctttcaggagcccatgacttccctgaatccggtgctgaccatcggcgaacaaattaccgaagtgctcgaataccataaaaaaatgaataaaagagaagcggctaaaaaagccgtcgagcttctggaactcgttggattctccagagcggaacaagtaatgaaagaatatccgcaccgtctttccggagggatgagacagagggtgatgatcgccattgcgctcagctgcaatccgaagcttctgatcgctgatgagccgacgacggcgcttgatgtgacgatacaagcccaagtattggagctgatgaaagacctctgcaaaaaattcgatacttccattctgctgatcactcatgatttaggtgtggtttccgaagccgccgacagggtgatcgttatgtattgcggacaagtcgtagagagtgcgagtgtggaggacttatttttaaaccctcttcatccgtataccgaagggctgttaaactccataccggtgatagatggagagattgatacattaaaagcgatcaaaggcagtgtcccgacaccggataatcttccggaaggctgccgatttgccccgaggtgttcaaaagcgatggacaaatgcaaaacagggcagccggagctgataacgcatgaaagcggccgttctgtaagatgttttttatatgaggaagagggtgcccaatcaaaatgacagctgcagaccaagaaacgattttagagctgaaagacgtaaaaaaatatttcccgatccgctccggtttttttcaaaggaaagtcggtgatataaaggctgttgacggcgtttctttttcactgaagcgcggggagacgctcggcatcgtcggtgaatcaggatgcggcaaatcaacggcgggaaggacgatgatccgtttatacaagccgacagacggccggattctttttaagggtcaggatatctccggcttatctgaagaaaagctgagaaaaagcgtccgcaaaaacatccagatggtcttccaagatcccttcgcatcccttaacccgaggaaaacgctgcgttccattattaaagagccgttccagactcaccatatgtacagcatgagcgagcggaacgagcgagtggaggagctgctggcgaaagtcggccttcacccgagctttgcaaaccgctatccgcacgaattttccggaggccagcgccagcggatcgggattgcgcgggctctgacgttgaatcccgagctgattattgcggatgaacccgtttccgcactcgatgtctccattcaggcccaagtcatcaatttgatggaagaactgcaggatgaattcaacctgacctatttgtttatttctcatgatttgagtgttgtccgccatatcagcgacagagtcggcgtcatgtatctgggaaaaatgatggagctgaccgataaacacgagctgtacggcaatccgcttcacccttatacgcaagcgcttttgtcttcagtgcccgtcacgagaaaaaaagacgccgtcaagcgggaacgaatcatcctgaaaggagaactgccaagcccggcaaacccgccgaaaggctgcgtgttccacacgcggtgcccgatggccaaaccgatctgcaaggaacaaatcccggcatttgaagaagccgctcccggccattatgtcgcctgccatttatatgcctgaaatgacaagcatcgagagggggtatgccggattacataaccagtttgctgcatatatatcacaaagggggaattgatatgaaattacgtaaaagcgcactgatgatgctaagtgtttttatggcgctcgccatcttcctgtcagcctgctccggctcaaaatccacaagcaccgaatccaaaccggcaggaaaaccgcaaaaaggcggagatttggttgtcgggtcaaccggggaacccacactttttaatccactttattctaccgatgttgcaagttctgatattgaaggcatgctttacagcacattattggaaacggatgagaaattaaacgtcaagccgtcgctggctgaaaaagtaacagaagctgacgggggattaacgtatgatgtaaaactgaaaaaaggcgttaaattccatgatggaaaagagctgacggccgatgatgttgttttcacctacagcatccctcttaacaaggattacaacggtgagcgtggctcgggttttgagtcccttaaatccgtgacgaaaaaaggaaaatatgaaattcagtttaaaatgaagaaaaaagatgcctatttctataatgtcgttctcgacagttacggcattttgccaaaacatatattgggtaaggtgccggttgcagatctgggagagaatgaatttaaccgtaaaaatccaatcggctccggtccgtttaagtttgttgagtggaaaaaaggtgagtatgtcaaactggaagcaaatgatgattactttggcggcagaccttaccttgatacagtgacagtcaaaacaattcctgattctaacgcggccgtggcccagttaaaagcgggagatattgatttcttcgttgtgccgggcacagattttgatacggttaaaacgtttggaaacgtgaaggtcaaatctgatcttggcttaaactacagctatatcggctggaatgagaaaaaagagctttttaaggacaaaaaagtgcgtcaggcattgacttacgctcttgacaggcaggcaatggtggatcaagtgctgaacggagacggtaaggtagcggatgttcctgagagtccgctgtcatggaattatccgaagtctaaagtgccgacatttgattataatccgaaaaaagcaaagcagctgctaaaagaagccggatgggaagaccatgacggtgacggctaccttgataaagacggaaaaaaattctcatttgaaattaaaacgaatcaaggcaataaaattcgtgaagatttagctgttgtcgttcagcagcaattaaaagaagtgggaatcgaggctaaaccgcgaattgttgaattcagtgcgttaatcgaacagacaagtgcccctaattgggattatgacgctcttcttctcggatggagtcttgcaacgttcccggatcaattctctatcttccattcaagccaatcgaaaaacgggctgaataatatctggtataaaaacccgaaagtcgataagctgcttgaagaagcgaagacaattacagacagaaaagaataccaaaagaagtatgaagagatatacaaattgatagctgaagatcagccgtacagcttcttattctattacaattaccacagagcgatgccgaataatttacaaggctatgtattccaccctaaaaatgacttgtacaatattgaaaaatggtggctggatcaaaaatagcaaaagccctggagagggaaggaggttcctttcctctcttatcctatttaaaaaggggacaagaatatggttacatatattttacggcgaacattaatgtccttgccgattctcttaggcattacaattttgtcgtttgccatcatgaaagcagcgccgggagacccgatgtcacttatgatggaccctacaatcagtcaggcggacagggcgaaattcattgaaaaatacgggttgaatgatccggaacctgttcaatatgtgaaatggctggggaatatgctgcaaggggattttgggacttctatcgtcaagaaaggcactccggtttctgaacttatcttatcccgcttaccgaatacgattgtgcttatgcttttctcaacccttgtcgctcttcttatttctattccatttggtgttctgtcagcaaaacgtccttattcaaaattggattacgggataactgttacttcatttttagggcttgccattccgaatttttggttcggtttgattttaatcatggttttatctgtaaatctggggtggtttcccactggcggagtaagcactttgaatgctgactttaacatatttgaccgattgcatcacttgattttgcctgcttttgtgctcgccacggcagacatggcagggataacgagatacacaagatccagtatgcttgatgtgttaaaacaggattatatacgaacggcgcgtgcgaaaggattccgagataataaagtgatttttaaacacggtttgagaaacggacttcttcctgtcatcactatttttggtttgatgataccgtcatttatcgggggagcggtagtggtagaacagatttttacttggccgggtctcggcaaattgtttattgattcagccttttcgcgggattatccggttatcatggccatgacggtcatttcagctgttttggttgtagtggggaatttaattgcggacatcttatatgcgctggttgatccccgcattgaatattaacaaggagaggtgagaggtcaaatgttacagccaaataccggcacaccccccagcgatgtgaaattaaaggaaaatattcaatccaaaccggaaacaatgacgaagatttttttcgaaaagttctttcaaaataaactagctgtaatcggagccgttatattaaccatcattatcttgtcagctttattcgcttcggtaatcgctccttactctccggagagtcaatctctcatcaatcgtttgaagccgccgagcttaaaacatctaatgggaactgataaattcggaagagacatctttacgagggttctgtacggggcgcgcgtttccttgcttgtcggattcgcttctgtgatcggcgcgattacaatcgggacagttgtcggagccgttgccggatattttaaagggattgtcgatgccgttctcatgagaaccgttgatatcgtattatccatacctgatatatttttgcttattacacttgttacgatttttcagcccggaatggataaattaattttaattttctcccttacaggctggacaacaacggcacgccttgtccgaggggagtttttatcgcttcgttccagagagtttgtattagctgcaaagacgatcggtacaaaaaatcatcacatcatcttttctcatatactgccgaatgcgctcggaccgattattgtctcagccacattaaaggtgggaacggttattttggcggaatctacattaagttatctcggtttcgggattcagccgccgatcgcaagctggggcaatatgcttcaggatgcacagaactttacgcttatgattcaggcttggtggtacccgttattcccgggtttgttgatccttcttaccgtattgtgctttaactttgtcggagacgggctgcgtgatgcgcttgatccgaaaaatgtgaaatgatctcccggacggaacgggagatttttttgttgcaatgcagtcggaaatccagctccgtaatacggaaatctcatattgaaatggaataatttatctatcccttgcctatactgtggacaacagtttttataaagtgaggggtcgaatatgttatttcttcatgatgtatgggtcaattggtttgaaggggaagaaaacggctacaatgtatgccattttcacgaatggcggaaggaagacacggttgagcttttggatcagacgccgctgctcagagtgccgtcggtattatttcattacatagaaaacgacttatcagagcttccgaaagagctgcttgaccaagtccaccagaagtcatacgtgcgaaaaaatcatgagcggacaaaactggagtactgttttgtcgtgacagacgggatcggcatcattgccgtagatacgatcgggtataccattccggtcagaaagagccgcctgattccgagacaggagcagcttgtttatgaaatggtaaaggatgtagaaccggaatcgtttcaatttgacccgtcgcaattggagtcttcaaaggaatatcacattttgtcattggcgccggagcatgtcagaggtctgacgagaaaagagcggcagatcaagcagctgatgtttatggcgctcgaccagctgaaagggctgaaaaaccgtgcggaaattgtgtattggtacacggaatggaatccgcatatgtatgagcagatcaaacggatgagttttgaagagatctgggacatgctttacaatgaaacaattgaaggctggtcggataaacatcttgcgttctgtgaaaatttgattaaagggcagccgtttttcgaaaagctttgggaaatggaacaggaatcaaaagtgaactaaaaaaagaggcggagattctcccgcctcttttctttatcttcttttccgtccgagacccatggcgttttccattttcttcaccattttgccggccgttttgtttgcgcgcgccgccccttcgtcgagaatgcggtcaagctcgtcgctctcaattaattcacggtagcgctcttggatcggtgtcaatgcgccgataacgacttcggctaaatcgcttttgaattcaccgtaccctttgccttcatatttagcttctaattcttcaattgatgtgtttcctaaaatagaatagatcgtcaaaagattagaaatgcccggtttgttttctttatcatactttacaatgccttcagaatcagtcacggcgctcttgattttcttctcgagctgcttcggctcatcaagcagcgtgatgaatgccttttggttcggatctgatttgctcatttttttgagcggatcagccagtgacatgatgcgcgcgcctgattcaggaattttcacctcaggaatcgtgaagatgtcattgtattttttattaaagcgttccgccaggttgcgggtcagttcaagatgctgtttttggtcttctccgaccggaacaagatccgttccgtacagtaaaatatcgccggccatcagcggcggataggttaacagtccggacacgacggcttctttgccctttgacttatccttaaattgcgtcatccgctcaagctcgccgatatatgcgacgcattggagcatccaccccgcctgggcatgagcgggaacctccgactggataaagagggtcgctttctcgggatcaagtccgacggccaggtaaagagccgcgagattgcggatgttcttccgcagttcaagccgatcctgcggaaccgtaatcgcatgctgatcgacaatacagaagtagccgttgtagtcatgctgcaaatcaacaaattgcttcattgcgccgatgtagttgccgagggtaacggaaccgctcggctgaatgcctgaaaaaatcgttttcttcatagttcttacctcatttcttaaaacataataaaaaaagcccattcttcccgtagaaaaaagggacgaatgaaccgtggtgccaccctgattattccattacaatggaatcgctcgagacgttggtaacggaggctgctccggctgggcctactaacgttcggtcagctgctcagaagtccattccacatcgcccgttacctgctcccagcaccgcagactctcttcaaacggatgaaaatgtgtactactcttcatcatcgcaatcacaacaaatgtatttgattgatctattataaatcaattatagccaaatgtcatcagaggaatacaagcttatttccagtttgctttaggggtggaaatcctcaaaaagaactgaaaatgcttaaatgataacgtatatcaacatttcgtataacgaatattatatgtaaaaagcaatatgaactggaaattacatttaaaaaatttagttaggtcatgctttaaactatagaagtgcatcacctttttgacagaaaaactgaccaaatttaaatattttaaattgagaaaatagtattgcaataaattattcatttcattataatgaacttgttcactctattgttacagcttctttacataaaataatcagaaaagacggaacacaattaaagtttagaaaaatattaagttattttgtctgatatttctgagtatttagtagtaaaggctgaaaaatttgattagggggttagtgcatgaaaaagcgttggtctattgtaggtttgatgcttatcttctcgcttgtattaagtgcgtgcggcggattcagcggcggatcaggcggcggtaaaaaagacaccaaaggacagacttcacttaatatcaatattaaaaccgagccgttctcactgcatccgggtttagcgaatgattccgtgtcaggaggcgtaatccgacagacttttgaaggattgacacgcgtaaactccaaaggtgagcctgaagaaggaatggcatctaaaattgaaacaagcaaagacggaaagacctatacatttacgattcgtgacggtgcgaaatggtctaacggcgaccctgtgacggcgcaggattttgaatatgcatggaaatgggcgcttgacccgaacaacgaatcacaatacgcttatcagctctactacatcaaaggcgctgaagctgccaatacaggaaaaggcaagattgatgatgtaggcgtaaaagccgtaaatgacaaaacattaaaggttgaactgaataacccgacaccttatttcacgcaattaacttcattctatacgtatatgccgatcaacaagaaaatcgcggaaaaacataaaaactggaatacaaatgcgggcgaaaattatgtgtcaaacggcccgttcaaaatgacggcctggaaacacagcggttccatcacgctcgaaaagaacgatcaatattgggataaagacgctgtgaaattgaagaaaatcaatatggtgatgattaacaataacaacaccgaactgaaaaaattccaggccggtgagcttgactgggcaggaatgccgctcggccagcttccgactgaatctctgccgacattgaaaaaagacggatctcttcacgttgaaccgatcgcaggcgtgtattggtacaaattcaacacagaagagaaaccgctgaacaatgtcaacatccgtaaagcccttgcttatgcgatcgaccgctcgtccatcgtgaaaaatgtaacgcagggcgaacaaatcccggccatggctgcggtgccgccgtcaatgaagggattcaaggataacacaaaaggttatttcaaagacaatgacgtcaaatcagctaaagaattcttaaataaaggactgaaggaattaggcgtcaagaatgcctctgaccttccggcgatcaaactgtcctacaatacggatgacgcgcatgcgaaaatcgcgcaggccgtacaggaaatgtggaaaaagaacttgggcgtcaaagttgagcttgataactccgaatggaatgtttacatcgacaagctgcacagccagaactaccaaatcgcgcgtatgggctggctcggcgatttcaacgatccgatcaacttccttgaattgttccgtgataaagaaggcggaaacaatgataccgggtgggaagatcctgagtttaaaaagctgctgaaccaatctcagcttgaaacggatccggataaacgtatcgaagagctgaaaaaagcagaaaagatctttattgacgcaatgccggtcgcgccagtttatttctatacggatccttgggtgcaggataaaaacctcaaaaatgtgatcttgacaggaacaggcgaagtttacttcagaaacgcttcttttgaataaaagccggttctgaaaacaaaagacccaaggtatatggggaggatgtccccatatacctttcttactgattacgtataaaattgtaaaaaacatggaggtgttcaccttgctgaaatatatcggtaaacgattcatttacatgatcatcacattgtttgtgattgtgaccgccacgttcttcttaatgcaggcagcgccgggcggaccattttccggcgaaagaaagctgccgcctgaaattgaggcaaacttaaacgaacactatggtttggacaagcctcttttcgttcaatatgtcagctacctaaaatctgtggcgatgtgggacttcgggccttcttttaaatataaaggccaaagtgttaatgatttaatcaattcaggcttccccgtctcattcactctcggtgcagaagctattctcctcgctttagcgttcggtatgcttttcggggtgcttgctgccctgtaccataataaatggcaggattataccattgcgattttaacgatctttgggatctcagttccgagctttatattggcgacgattttgcaatatattttctcaattaaattagaactgttcccggtcgcagggtgggaatcctgggcatacacctttctgccctccattgcgctcgcttccatgccgatggcgttcattgccagactctcccgttcaagcatgattgaagtgttaaacagcgattacatacggactgcaaaagctaaaggactttcccgtccgtcagtcaccgtgcgccatgcgctgcgaaatgcgcttttgccggtcgtgacatatatggggccgatggcggcatccattttaacgggaagtttcatcattgaatccattttcggaattcccggtttaggcgcgcattttgtaaacagcattacaaaccgtgattatacggtcattatgggagttaccgtgttcttcagcgtgctcctgcttctatgcgtattaattgtagacgtgctgtacggattaatcgatccgagaatcaagctttccaaagcaaagaaaggagcctagaccatgcagaacattcctaaaaatatgtttgaaccagcttcagctaatgccggcgatgccgaaaaaataaataaaaaaagcctttccctctggaaagacgccatgctccgcttccgcagcaataagcttgcgatggtcgggttcgtactgatcgttcttattattctgatggcgatttttgcgcctatcttttcaaggtatgattatgccactaccaatctattaaatgcggataaagcgccgtcgaaagatcattggttcggcacggatgaccttggaagggatatattcgtccggacatgggtgggcgcgcggatttccatctttatcggtgtcgcagctgccgtgcttgatttattgatcggcgtaatctggggcagcatttccggattccgcggcggacgcacagatgaagtgatgatgcgcatcgccgacattctgtgggctgttccttcattattaatggttattttgctgatggttgtcctgccgaaaggattgctcaccattatcgtcgccatgacgatcacgggctggatcaatatggcgaggatcgtccgcggacaggtgctgcaattaaagaatcaggagtatgtgcttgcttcacagacactcggtgccaaaaccggccggcttttgtttaagcatatcgtcccgaacgcgatgggctctatcctcgtaacgatgacactgacggttccgaccgcgatttttacagaagcgtttttaagttatttgggcctcggcgtacctgcgccgcttgcgagctggggaacgatggcctcagacggattgcctgcattaacctattacccttggcgtctgttcttccctgccggctttatctgcctggcgatgttcggctttaacgttgtcggcgacgggttaagagacgcgctggatcctaagttacgcaaataaggagtgatatgagtgacacgtttgctagaagtaaaagacttagccatttcatttaaaacatacggcggagaggtacaggcaatccgcggcgtcaatttccatttgaataaaggagagacgctggcgatcgtgggggagtcgggttccggaaaaagtgtgacctcccaagcgattatgaagctgattccgatgccgccgggctactttaaaagaggacagattctttttgacggacgtgatatcgtgccgatgtccgaaaaagaaatgcagactataagaggaaaggacatcggaatgattttccaagatccgatgacctctctgaacccgacgatgagagtcggcaaacaaattacggaagtgcttttcaaacatgaaaaaatctcaagtgaagcggcgaaaaagcgcgccatagagctgcttgatctcgtcggaattccgatgcccgaaaaacggatcggccaattcccccatgaattttcaggcgggatgagacagcgtgtcgtcatcgcgatggcgcttgcggcaaatccgaaactgttaattgccgatgaaccgaccacagcgcttgatgtgacgattcaggcacagatccttgagctgatgaaagatctgcaaaagaaaattgatacgtctatcatttttatcacgcatgatctcggcgttgtcgccaatgtcgccgaccgggtcgccgtcatgtacgcgggtcaggtcgtcgaatcgggcacggtggatgaaatcttttatgatccgcgccatccgtatacgtgggggctgcttgcctcaatgccgagtctggacagcaccgatcaggaaaaactgacggccatcccgggcacgccgcctgatctgacgaatcctccgaaaggggatgcatttgcgctccgcagctcatatgcgatgaaaattgactttgaacaggaaccgccgatgtataaagtgtctgatacgcattttgtgaaatcgtggcttctgcatcctgatgcgcctaaggtcgagccgcctgaagcggtgaaggctaaaatccgtcagcttccgaatacgtatcagcatcctgttttaatgaaggaaggtgaaaaaaatgactgagaaacttctcgaaatcaaacacttaaaacagcattttttcacgcagaaaggaacggtaaaagccgtagatgatttgtcatttgatatttataaaggtgaaacgctcggccttgtcggagaatcgggctgcggtaaatcaacgacgggccgcagtattatccggctgtatgaggcaaccggcggggaagttctctttaacggggaaaatgtccatgggaaaaaatcccgcaagaagctgctggagtttaaccggaaaatgcagatgattttccaggatccgtacgcatctttaaatccgagaatgacagtcgccgacattattgccgagggaatagatattcaccgcctggcaaaaacgaaaaaagagcggatgcagcgggttcacgaactgctggaaacggtcggtttaaataaagagcacgccaaccgctacccgcatgaattttcgggcggacagcgccagcgtatcggaatcgccagagcgctggcggttgatccggagtttatcatcgcggacgaaccgatttcggcgcttgacgtctccattcaggcgcaagtcgtcaatttaatgaaagaattgcagaaagaaaaagggctcacttacctgtttatcgcccatgatttatcaatggtcaaatacatcagcgaccgcatcggcgtcatgtatttcggaaaattggtggagcttgcgccggcggatgagctttacgaaaacccgcttcacccatatacgaaatcattgctgtccgctatcccgctccctgatccggactatgaaagaaatcgcatgcgaaagaaatacgatccggcagttcatcagctccaagaaggagaaaaaatggaattcagagaagtgaaaccgggacattttgtcatgtgcacagaagctgaatttaaaacctatctataaaagtatcatcctccaagactcagtcttggaggatttttttgcgcacattcaagtttattaagcctgctcccgtttttctataatggaaaaaaagggggagatcagtatgaaaaccattttgtgcgccatttgtgcgggactgtttatcagtgcagccgcttatccggcccgcgccgctgtgaaagaggagcagccgcttgtaaaaatagcgctggctgaaaaagaactgccgaaatcaaatgcacggttcgcttatccgtcagggctgcattttacacatcctgataaggtgcggggcatttacgtcacaggacattcagcgggaggaagcaaattcggggagctgacagactttgtggacaaaacggagctcaatacaatggtgattgatgtcaaggacgacaacggaaacctcacctttaagccggacagccattctgagtatgccaaaatcgccaagccgtacatcaaagacccaaaaaagatgatgaaaaagctggaggaaaaaaagatttatccgatcgcgcgtattgtcgtatttaaagacagcgaactcgcgaacaaaaagcccgagtggtcctttaaagaaaaaaacggaagtgtctggaaaaacggccgcggagaatcgttcgtcaatccgtttatgaaagaagtatgggattacaatgtaaagattgcaaaacaagccgtaaagatggggtttcaagaaattcagtttgattatgtccgttttcctgaagggtttgaaaaacgtgatgacgaactgacatacggtcacggcgattacggaaaaacagcagacagcaatgtgcaaaaacgcgttcacgccgtcaccgattttgtcggttatgcgaagaaaaaactcaagccgtacggcgcggatgtgtcggttgatattttcggctattcagccacgctgccggaagcgcctggtatcggccagaatttcagcaaaatttcagaccaggtcgatgtcatttcatccatgatttatccgagccattggacaagctatttcggcattgataaaccggatcttgagccttacaatgtcgtcaaagaatatgcgaaggtggaaaataaaaagctgtctaagctgaaacacccgcctgtatcgcgtccgtggcttcaggatttcacggcatcatatctcggcagcggaaattatcaaaagtacgggaaacgccaggtggaagaccaggttaaagcgctgcatgatgaaggaattgacgaatttttattgtgggacgcggcaaaccgttataccaaaaacgtcgattacacaccattttaaaaaaattgaaaccatgttaagggatcacacgtcttaatagatgtaagattgtttaaacaatcggaaatggggtatatctaaaagtgtgaagacaacgaacccataaggagcaaatgaatgaactggtacgaaaagctgagtgaatattttccgattgaagaaatgaaatcaaaagcgcatatggaagctctgttaaaggagcaaagcgatgtttatcataaagaagaggggcagtaccacgtgctgatgtatgcggaatttgactctttcatctttattgattacctgtttgtgtcaaagaaatccagaggacaaggcctcggaagcaagctgatcggcagactgaaaaagaagaacaagccgattctgcttgaggtggagcctgttgacgaggatgacacggatacacagaaacgcttgcgtttttatcaaagagagcatttcaagcacgcgcagtcaatcgggtatcggcgccggtcattggctacgaatgaagtgaacaaaatggagattctgtactggtcacctaagacggaatcagaagaagaaatatttgaagcgatgaaacagacatatgaaaacattcacacttataaagatgaaaaatggtacggagaatcatacgaaaaaacggatgaagttctcaaagtcattgatgagaaaaaacaaaaaaacattttcgatcagctgagctaattgagaatggggaaaaatccgccagccgtaaatttgccggattgacacatttttttctcaggagactgttcacacttacttttttatagtataatacctataaagattccttttttaaagtcatttcaatttgagaatacaaacatgttcatcctactaattagaggagtgaagattaatggttacattatacacatcacctagctgtacgtcatgcagaaaagcaagagcttggcttgaagagcacgagattccgtttgtagaaagaaacattttctccgagccgttatcaattgatgagatcaagcagattctgcgtatgactgaagacggtacggatgaaattatctctacccgttctaaagtattccagaaactgaacgtaaatgttgaatctatgccgcttcaagacttatatactttgatcaatgagcatccgggactgctccgccgtccgatcatcattgatgaaaaacgtctgcaagtcggctataacgaagatgaaatcagacgattcctgccaagaaaagtgcgttctttccaattaagagaagcacagcgtcttgctaactgatataagcttacgataagcatggaaaaagcccaaaaccatcgcggtttgggctttttgttatttttcagtctgctggtaaatcatactggcgaggataacaaaaacgacggtcaaaatcggcagcatcatctgtagcatgccgtgttctgccatgaaaaatgacagcttgctgtctccggcaatcatttcaccgccggtaaatgcgagaaggccgctcccggcatacatcaataaaggcattttttccatggcggcatgaacgagcttgctgccccaaataataatcggcaccgagatgaagagaccgatcactactagtgtcagctcaccgtgagaagcgccggctactgcgatgacattgtcaagcgacataaagatatcagccagaacgattgtgcggatggctttccaaagagaagaactgctttttacatgctgtgcatctttcttctcaatcagaagctgatagccgagatacaataaaaataccccgcctgcgcattgtaaaaaaggaacattcaataaatagaccgcagcgctcgtcagaacgattctcaagacgactgcaataaatgttccgaagatgatcgcttgctgtctttgtttatgggccagattccggctggccatcgcgatgacgacggcattgtcaccgccgagaataaggtcaatcccgataataagcagaagggacagcaggtaatcgtgcggcatggtaacacctcgcttatagatcgattgcttgtacagctaatatatgaagcagtgcgctatttatgatgggaaccgggagaaagcctgtttttcagtgtgaaaatgcttttttatttcttttataactgttttatcataaaatagaaatataaagaatttgcgctgtcttctataaggttaagatgtggacggaatgggtaaagtgtagtaaagtactattcatcgggagcttagatgtcccttcaacatcttataaagaagggaaggttggcaaaatggaaatagaaagaattaatgagcatactgtaaaattttatatgtcttatggtgatattgaagatcgcggttttgacagagaagaaatctggtacaatcgcgagcgcagtgaagaactgttctgggaagtcatggatgaagtgcatgatgaagaggaattcgctgtcgagggtcctctttggattcaggttcaggcattggacaaaggactggaaataatcgtaacaaaagcccagctttccaaggacggacaaaaactcgaactgccgatcccggaagataaaaaacaagagccggcagatgaaaatctcgatgctttacttgatgatttccagaaagaagagcaggccgagagccgggaagataaggagcaaaagcttcagttcactttgcggttcgatgattttgaggatctcatctcgctatcaaaattgaatcttaacggaatcaaaacgaccttgtattcgtttgaagaccgatattatttatatgcagatttttatgagcaaactgatgaagaggttgaaaatcagctaagcatcctgttggagtacgcgcacgaatcatcagtcagcattcaccgtcttgaagaatacggcaaattggtgatcgctgatcatgcgttatatacaataaaaaaacactttgcatcataacaaaccgatttctctcagcagaaatcggttttttttgttctgaatgacaggatgaacggctgaaaaccgtataacggctctcatccgcaaacaggattatgccttcttcctgctgaatacaacaagattcaggaaaggagaagatgcaacatgttcagtgctgtgactgccgacggacggctcattcagctggccggaagctattcaaaggaaaaagcggcggagctgagaaagaaacgctggttctgccccgtctgcaaaagtgagcttgatatcaaactgggacgggagaaactgccgcacttcgctcataaaaaaagcaggctgtgtcccggggaatccgaacctgaaagcgaataccatctggaaggaaaaagacagctttttctctggctgaagacacaagggtgcagtgtcagcctggaaccgtatctgacttccgctggacagcggcctgacttgacggcagaaagcggagaagagaggctggcttttgaatttcaatgtgcgaacctttcggcggactctttaaagagccggacggcaggcctgaaaagtgccgggtaccggccggtctggatcatcggggcaaaacggttaaaacggatggctgcgcaatttttccggctttctgcttttcactggcagttctttgaagtcaattcattttcctccttaatgttttactgccccgacgtccgctccttttacaggctgcattccatcactccgttttacaccggctattcttatgccggcttaaccacaatccctcttcacaaagcaaacctgaaagacatttgtcatccggaagggcggcacagcgtcagacttccctcgtgggggcgtgccgttgccggcttccgcagcaaaagcgggcggtttttatctgaagatgccggtcttatccggcgtcttttttacgaaagacatcaggttgcatttccatttctcccctctgaagtgtttattcccgtttcagcaggctttgtgtttgcaagtcccgtttttgtgtggcagggccatttatacatgcggcttgcggaactttctaaaaaaggcgctccgatccgattatccggcatggttcatgatttacggcaaaaaatcaggcataaggagatccggatgcggtatggttcacaagacagccttatcggaatggcggtaaaacaatatgctgatttcttatgcttgcaggattttttaagggaaattgagaatgaagtatatatgccctcatctcagcagaagcgccctcaaacggcagaagagctgcgccggcgggacctgctcttttttggggaatgagaatgcttcatttcgttcaccctaacgtcaaggtggtggcgaatgtgaggggcgtacaagcattttgttttcgttttttcactgtattattggtatgctcggtcttatatgccgcatatgatttgacaaaaggcagtgaaaagccggaagataatcacaacacaagtttttggagaaacaatcgttttttcaattggcttgaagtaaagaaaacgagggggatcaccatgactgaggaaaataaagcagcacagctgcctgacagaagtgaagtaaaggcagagcatacatggagactagaggatatttttcctagtgatgaggcctggaataaagaatttcaagcagttaaagaattaattccgaatttatcttcttttaaaggcacgcttgctcattcggctgataatttatacgcggcgcttacggcacaggatgaagtgacgaaccgccttgggaaactttatgcatacgcacatatgcgctcagaccaggatacgggaaattctttctaccaagggctgaacgacaaagccgcaagcctgtattctcaggctgccagcgcgactgcttacattgaaccggaaattctggcgattcaggaggacaagctgcaccagtttattctggaaaaagaggagcttaagctttactcccatgcaattgaagaaattacaaaacagcgtccgcacgtgctgagcgaacaagaagaggccctgcttgcggaagcctcagaagcgctatcgtcaccttccaatacattcagcgttttaaataacgccgatattacgtttccgtcgattaaggatgaaaacggcaaggaaactcaaatcacacacggcaactttattaatttcctggaaagcagcaatcgtgaagtccgcaaaaacgcatttgaagccgtatataaaacatacggacagtataaaaacacgatggcgactacactcagcggcactgtaaaaaaagataatttttacgcccgtgtgaaaaagtataaatcagcacgggaagcggctttatccaataacagcattcctgaagaagtttacgataaccttatcaaaacgatcaataaacatcttccgttattacaccgttacattgacctgcggaaaaaggtgctcggccttgatgaagtccatatttatgacctgtacacaccgcttgtaaaagattcgggaatgaaggtcacatatgaggaagcgaaagattatatgctcaaaggacttgctccgctgggcgaggaatacgcgtctattttaaaagaaggacttgaaaaccgctgggtcgatgtatacgaaaacaaaggaaaacgcagcggtgcttattcgtccggtacatacggcacgaatccgtacatcttaatgaactggcatgataatgtcaataatctgtttacgctcgttcacgagttcggccattccgtgcacagctactatacgagaaaatatcagccgtatccgtacggtaactacagcatttttgtcgctgaagtcgcttcaacgactaatgaagcgctgctcggtgaatatatgctgaacagcttaaaggatgaaaaacagcgtctgtacctgctcaaccacatgcttgaagggttcagaggcacagtgttcagacagacgatgttcgctgaatttgagcatctgattcatacgaaagcgcaggaaggcgagccgctaacgcctgaactgctgaacgaactttattatgatctgaataaaaagtatttcggtgacaacatggtgattgataaagaaatcagtctggaatggtcaagaattccgcatttctattacaattattatgtgtatcaatatgcgacaggctacagtgcggcccaagcgctgagcagccagatcttaaaagaaggcaagcctgcggtggagcgctataccgaattcttaaaagcgggaagctcggaatatccgatcgacatactgaaaaaagcgggagtcgatatgacatcgcctgaaccgatcgaggcggcctgcaaaatgtttgaagagaaactgaacgaaatggaagagcttctttcgaaagtgaacccttcgtaattcaaaaaagcctgtgcattagatgcgcaggctttttctaaaaccccttaaacgtttttcggtgattcagccggtacaaggcaaacaatatggacagaaacagcaggggagatgtaatgtaaatcggcagcatgtgcatcatggccagcaggtttaaaaagaagaaaaacataatcattccgatgatcaatacggtgcggagcattgatttccctccttgtttatgattgatatattctatgaaaacaagcagtcagttatgttttgtgacaaaaatatgaacattaatcttatggcttgtcaaaactcgacaagatttgatatgataaggatgtgaaattgatcacaaacaaacattacccctttgtttgaccgtgaaaaatttctcccatcccctttgttgtcgttaagacatatgaaaccgcgcttatcccggcgcggtttctttatttgcacaaaaaaagccggctccgtaaggaatcagctttttttaatggtcacaacaggtgacatcctcctgggtgccggccagagatttccaaaacagaccgtgctttgcttccactctggcgacctttttggcgaatgccagttttttcatttctttttcaacttcttctagactcaaatcataaacgagtgcgatttctttcgatgcgacaaaccggaaatattcaatgaaacattccaaaggcggcgtttcagaaggcttcggttcatccccgagcatttcgaataggatctcttcgtatacgtcataagaatagttgccgggaaccttcagcccttcatcatcatgcagactgttaaagaacgtcaatgtcgggttgacggtgacgtccatttccgccgcgattttcatatcgcactgaagcgcttttaccgcgctttgcgaatggaggtcgcgcttgaattcttcaacatccaatttcgtcttttcggcaatttctaaaagaacgtcttcatccgtaatattctgcttggagacaaacaggctttcctgcatgctgcggagaaacagaatgcccgcttttcttccctgcagttcggccgcttttaaagcgagtgcggcaaggtagggcgatgaaagaggctgatcctgctcaagccaaaggcttccgtcacagggcatcccggaacggttcgcaattttttcccaagcttcggcaagaaggtgttttttccgcttttgcttattcagcgatgtaatgctcgcggaaacaatgatccgcagggtgaaaaaacgtccgtatttgatttttaatttttttatggcgggctccagcgaccagcattcaggacataaagggtcgacaaacatgtaaatttcgagcggtttttttggatgtccgtggcaatgggcgaagtattgctcatgctgataattcgtcaatatgatcgatcctccgcttctgactggtttaccatatgcctggccgtcagttccagacgcccgtacagaaattcacgaatatcgccctccagcccgacctgatccatcgctttgctcatacagcttagccacgcatcagccctctcgtccgtaatcggaaaggggagatgccttgccctgagcatgggatgtccgtgctcttcagtataaagaggaggtccgcccaaatactgggttaaaaattgcttttgttttctggccgtttcagtcaaatcacttggaaatatcggcttcagcaagggatgagacgagacacgctcataaaaagtatcaacaagttgcgatagaagttcctctccaatcgcttcatatggtgcgttaaacgattgtcccatgttgactactcctttatatggctaataggaatcataattcccattgcgaatttatctttcagttttactatcttcagttactgtatattttagcaataacattttatttctacaaacaaagtgcctttctgtcaggcgcttgtatttcatatcatatcacatcgccttcattcatgtgtaagatttcactccgcaaaaaaaccagagggcgaaggaagcctctctggtttacgcgtaatactgccgggttatgtttttgacatattgctgtgtttccttaaacggcggaatgcctccgtaccgatctacgttgccggggcctgcgttgtaggcggctaacgcgagagatacatttccgtcgtatttcgtgagcatctgctttaagtactttgtgccgccctcagcgttctggacgggatcgagcgggtttgacaccccgagtgattctgccgtggaaggcatgagctgcatcagtcccattgcccccgcaccgctgacagctttcggattaaagcctgattcctgtttaataaccgcgcggatcagtttttcgtccactccgtatttttcggctgctttctgaatggcgctgtctattgaaaagtttccggtgctgatgtcagaagccgcatccggagactttatgcccgcggaagctgccgcggaaccggatgaaacgggaattctcggtgaatatgaagcgtgagcggtccgcacaccgtttaaaattcccgattccggctgctgccggacggctgtgtccgtatactggctgagcagcgcgctgaaattggcaagcgggctttctgaagattgtccgcctgaagccgtgtttgtatgagagattgattgcagcgccattgactgcagctggagaagggccgcccaattcgttatattcactgtgtcattccacctttttttgtttctgttcataaaaacgctggattttatttttcgtgatccgctctgggatgccgaattgcttgagcaattgttcaaacgcccgttttccttcatcccagtcagcagcctcgaattccaattcaaagtcttctttctctaaatatcggctgtgatctaaaatgattaagcctttttctgattctttttccgcgcgtgcggtcgacagcgttccgaagcagcaaatgtgttctgaacggattcctagaccgtccagctgccgtttgacggggccatccggaatcttgaagacgtcaagatccggtgccgccgcaagctgttggtgcgtttccagcagaccgaccgcggcaggttcttttaaagtcagaacgaacgagccgtctttttctcggatgcggagtgctgattttttttgtttcagggaaaaatctttcgtgtcgaaataatgattgacctgctgtttaaaatcatgttctttcatgcagagtgcttcacccagcttcagaaattctgattttgtcagcaggtttttgaattcaatttctatttcttgggtcatgacagtcttcctttcaggacgaaaaaaattgtataattcccattatctctttagaggttacgtttatcaatatcgaccttgatatgataaaataaatgctgtactttgttaaaaaaggagaacattatgcaaaagagaattgaaatccagaatgcatcattaacagaagacgcgctccgcttgaagtgcggagaagacttaagcggagcggaacgcaaagcctcaggtcaaatgcttgttgattccgatcactttgcttttgtatacatacttgaatcagctgactcttttgaatatgtcattataaaagaacatgtctggccggatctgaaagaagccttagaccaaggaaaaccggcggtccttgaggccggcggaaaaacggttgaactttcagggctgcatgaagaactcgattatcttcttgaaaatattaaagataatgcaaactacggagatatggaagaaaaagtgaaaaacgtatttctttagaacaggttcggaattgggggatgtacgatggatgacaaacaatgggagcaatttctagcgccataccgccaggctgttgaagaattaaaggtgaagctgaaaggcgtcagaaccctttatgagtatgaagatgaccactcaccgattgagtttgtgacaggccgcgtgaagccggtggcgagcatacttgaaaaagcgagacgaaaaagcataccgcttcatcagattgaaacgatgcaggatatcgcggggctgcgtattatgtgccaatttgtcgatgatatccagatcgtcaaaaatatgctgtttgccagaaaagattttaccgttgtcgataagcgggattacatagcagagcataaggaaagcggatatcggtcttaccaccttgtcgttttatatcctttacaaacaacgtccggtgaaaagcacgttcttgtggagatacagattcggacgcttgccatgaacttttgggcaaccattgagcattcactgaattacaaatacagcgggaacattcccgaaaaagtgaagctgaggctgcagcgggcctcagaagccgcatcccggctcgatgaagaaatgtcagaaatccgcggagaaatccaggaagcccaagccgcgttctcgcgaaagaaaaaagcgggagaccgccagtaggaaaggaggggaatggcatgaaatttgccgtttcttcaaaaggagacgaggtttcagatacactgaaaagcaaaatacaggcgtatttactcgattttgatatgaccttggatgaaaaagagccggaaatcgttatttccgtcggcggtgacggaacgcttctttacgcatttcacaggtacagcgaccgtcttgataaaacggcgtttgtcggagttcacacggggcatttgggtttttatgccgattgggttccgcaggagatagaaaagctcgttctggccattgccaaaacgccgtatcataccgtggagtatccccttcttgaggtgattgtcacttatcatgatgaagagcgtgaggagcggtatctggctttgaacgaatgtacaatcaaaagcatagaaggcagtctcgtcgctgacgtggaaattaaaggccagctgtttgaaacgttcaggggagacggtttatgtctgtccacgccttccggaagcacggcttataataaggcgttaggcggcgcgatcatccacccttccatcagggcgattcagcttgcggaaatggcatccatcaacaacagagtgttcaggactgtcggctcgccgcttttgcttcccgatcatcataactgtgtcatcaaaccgagaaacgacgtcgactttcaagtcacaattgatcatttaaccttgctgcataaggatgtcaagtccattctatgccgtgtggcaaatgaaaaagtcagatttgcaagattccgcccttttccgttttggaaaagggtgcaggattcctttatcggaaaaggcgaatagaaagaggaaacggattggacaacttttttatccaaaagaacatgactgcccgggaagccggcatgacggtaaaagaatatacggcgcagctcggcatttcaaagcggcttctcgctgacattaaattcggcgggggagacctgcttgtgaacggagagcatgtaaccgtccgcaccgtgttagcggagggagacgtgcttaagattgaatttccgaaggagcatgtgagtgaaacgcttttgcctgagccggttccgcttgatattctttatgaagatgaccatgtgcttgtggtcaataaacagccgtatgtctcctcaattccatcaagagaacacccgtcggaaagcatcgctaacggagtgatcagccactaccgaaaaagcggcgtgccatcaacggttcatcttgtcacccgccttgacagggatacatcgggggcgatgctcatcgccaaacatcggctttcccattctcttttgtcggcagcgcagaaaaaggggcttgtcagcaggcgatatctcgctgtcgtacacgggatcatgatgcagaaggaaggaacggtggacgcgcccatcggaagaaaacatgacagtattattgagcggatggtaacgccggatggacaacgagcggtgacgcattttcaaacggaaaaagcgggacatgcgtttacgcttgcagccctgcggctggaaacggggcggacgcatcaaatccgggtgcacatgagctacctcggccatccgttagtcggtgatacactgtacggcggaaaaaatgagggaattgcccggcaggctcttcacagtgagcggctttcattcgtacaccccatgaccggagaaacgctcgtttttcacgccccggtgcctgacgatatgaaaacattaattgaacacatgtaaagcccgaaccgtttatcggtttcgggcttttttcatgcctgcctgccgtgatcctcgcgaaatcgtgaagcatcatagggcattgagctttccacagagacggtttcatgctccggaaatcgaaagcctgtcagctgattgccgaagacgcagcctgtatcaatgttgatcgtacggttgacgatccgggggcgttttaccggggtatggccgtacacaacccacgctttaccttcatagtcggcagcccagtctcttctgacgggtctgccgtcgggatgcgtttcacccgtaatatcgccgtacagaacaaattcttttaccttacgcgagtatttaccgatatcgtcagcttttatgccggcgtgggcgacaacgagatcgccattatgtaaaatgtcataaagcggcgctgactcatataatcggataaattgtccggagacttccgttctgtcggcgggagacagctctttcagttcggctgccgtcgtttccagtccgtgcatcacttttacggggtttccttttaagtaacgatatagtttgttgcaatgatttcccgggacataacggacggctcctttttcatatgcttttgccacaaaacgcatcacttctacggattttgggcctctgtccgttaaatcccccgcaaagacaagcgttctgccttcagaatggacgggcgttccgtctttcacttcatatccgagcttttgcattaaggcgatcatttcgtcataacatccgtgtatatcgctgatgatgtcgtaagccattcgtgtcagcctccttattaacggttttttatttattatggggctaattcctatacctaattacgctgtttttgcacaaattaaaaaagaattaaagaaataaagccttatcacttttttttcgcgttcagccttgttagaatatgcgttatgtttttaaaaaaaagtaaggtttcgcccgcttaaagcgggcttttataacccttgttttaaggaggtatttacaaatggaacacacatcagtcgcatctttagtcgtcgttttgatcgtcgcttttttgacgccgctccttttacatcggtttaagctcagcatccccgtcgtcgtcgcggagatcatcatggggcttattatcggaaaaagcggcctgaatcttgtcgttcagggagacacgtggctggagacgctgtctgttctcggctttatctttttaatgtttttaagcggcttggaaattgatttttcttcatttgagaaagggaagaaaaaacaattcctttcgaacggcaaggaagcgcccaacacgttttctgccgcactgattatctttttcggcatctttattttatcattgctgctgtcctatgcctttgtattagccggttttatacaaaacgcatttttaatgacgcttattatttcgacgatatcactcggtgtggtggtcccgactttaaaagaagaacggatcatgaactccaatatcggccagattatcctgcttgtcgccgttatcgcggacttggctacaatgattctgctcgctttcttctcttctctttacggagaagacagcggaaatatgtggcttctgttgattctctttgccgcgggggtcgtgctgtatttcttcggcaggatctttaaacaccgttcatttgtgcagtcgatgtctaaaggcactgtgcagatcggcacgagagccattttcacactgattatcgtgcttgtcgctttatcggaatctctcggggcggaaaatattctcggcgcgtttttggcaggcgttctggtatcgcttctgtctccgaataaagaaatggtggaacagctggattccttcggctacgggtttttaattccgatctttttcgtcatggtcggggtgaaattggacatttggacgcttttccaagatccgaaaacattaacgatgattccgcttcttctgcttgcgctgtttatcagcaaaatgttcccggtgttttatttaacgaaatggtacgacaaaagaaccgtgtttgcttcgggctttttgctgacgtccacgctgtcgcttgttatcgcggcggctacgatcggagaaaggctccacattatcagcgccaatatgtccggcgcgctgactttagttgcggttattgccagcatcatcacgccgatcggctttaagaaattattcaaacggcaaagcgcgccgcaggaaaaaaagcgcattacatttatcggcgccaatcaaatgacgctcccggttacgctggaattgccagaggaggaatatgaagtacgggtcgtccatgtgtatcaggaaaatgccggggaaacgcttgcggaatccgttttttcagttgacacgatttctgattacgagcccggcacgcttgagtcgcacggtatttttaaaacggatattcttgtcgtggcgacgggaaatgaagatgtgaacgctgaaatcgccttactagcgaaagagaaagggactgagcgtatcatcgcaagcgtcggctcggttgagcatgaaacaaaactgaaagaagagggcatcagtattttttctatccttatgtctacaaaaacgctgctgcgcgcgttaattgaggcgccgggcgtgatgagcctcctgacgaatgaggagtcttcgttatatcagatcaatctggaaaacccggcgtataacggcatcattctgcgggaatttccgctgatgggcgatgtgattttcgtccggattttcagaggtgtggacagcatcgttccgcacggagacacgcggctgaaaacaggagaccgtctcatcgtcacgggctcgcgcaactacgtgtcggaactgagaaaaatccttgaagcttgaccaaattgcaattcgtgataatatagaaggcataacaaataaatcattaatcgtatgaccactaggggtgtccttcataagggctgagataaaagtgagacttttagaccctcataacttgaacaggttcagacctgcgtagggaagtggagcggtatttttttggggttccttttatccatttaaattccaaaccacttttccgatgcgggaaagtggtttttttattttatcaggggggaagacatgatgacattttctgaagaatgcagacaggcggctgccgaatggtgggacggaagttttgttcatccgtttgtaacgggaatcggtgacggaagcctgccgattgaccgtttcagctattacgtgctgcaagattcctactatttgacgcattttgcaaaagttcaggcgttcggcgccgcatatgccgaagacttgtttacgacgggcaggatggcgggccacgctcaagggacatatgaagcggaaatggcgctgcaccgcgagtttacggagcttttaggaattacggaagaagagcgtgcggcatttaaaccggcaccgaccgcctattcttatacgtctcatatgtacagatcggtgatgagcggcaattttggagaaatattagctgcgcttctgccctgttattggctttattatgaagtcggcgaacacttaaaagagtgcaaaccggagcatccgatttatgaaaaatggatcggtacatacggcggagactggttcagacagcaggtcgaagaacagatcagccgttttgatgagattgctgaaaacagcacagaggaaatccgcgcaaaaatgaaagagaattttgtgatttcaagctattatgaatatcaattttggggaatggcttatcaaaaagaaggctggtccgagaaggacggaaaagaggtggaatcctttggagctgcacgcggtaactgataatcgcaaacccgttgccgagctggccgaggatattctatcgattcagcgcgaagtgagctttatccatatccgtgagcgggataaaacagcgggagagatcatgcagcttttgtcccttttgaaaaagggcggtgcggataaggacaaattgatcatcaatgacagggcggatatcgcgctttttgccaacatacaccgtgttcagcttccgtcccgcagcttttccgtaaaacaggtgcgaagcagatttccccatcttcatatcggacgttcggttcattcgctggaagaagccatccaagctgaaaaggaagatgcggattatgtggtgttcggccatatatttgaaaccgaatgtaaacaaggacttgaagcaagaggcatcagcctgctttcagagatcaaacgcacgctttccatccccgttatcgcaatcggcggaatgacactgcagacgatcggacacacaaagcaggcgaagccggacggaattgccgtcatgtcaggcattttctcagctgaaaatcctgaggaggcggcaaaacggtatgcacgcgcggtaagggaggccgattatgaagaaacactatgatacggcggtgatcggcggcggaattatcgggtgcgccatttcttatgagctggcgaagacgcagcagaacgttgtcttgtttgaaggcggagaagtcggccgaaaaacgacaagcgctgccgcgggaatgctgggcgctcatgcggaatgtgaaaaacgggatgcgttttttgattttgccatgcacagtcaaaggctgtatgaagcggcggggcaagagcttgaggaagcttgcggcattgacatcaggcgccataacggcggaatgcttaaactggcgtgtaccgaagaagatatcgcccgtttacggaagatggatgatctgccttccgtcacttggctttcagcggaagatgcccttgaaaaagagccttacgcttcaaaagacattctcggtgccagttttataaaagacgatgtccatgtcgaaccgtactatgtttgcaaagcgtatgcaaaaggggcgcggcgctatggcgctcacatatatgagcatacacaagtcacctccgtaaaacgggtgaacggagaatattgcatcacaacgtccggcggggatgtttatgctgacaaagtcgcagttgcaagcggtgtatggagcggccggtttttcagccagctcggcttgggacagcctttttttcctgtgaaaggagaatgcctttccgtgtggaatgacgataccccgctgaccaaaaccctttaccatgatcattgttatgtcgtcccgagaaaaagcggccggcttgtcatcggcgccacgatgaaacagggtgactggagcgatacgcctgacatcggaggaattgaggccgtcattgcaaaagcgaaaaccatgcttcccgccatcgaacatatgaaaatagatcggttttgggcggggctcaggccgggaacaaaagacggcaagccgtttatcgggcggcatcctgaagacagcggcatcatcttcgccgccggccattttcggaacggcatcctgttggcgccggcaacggctgtaatggtgcgggatatgatcttggggcaacaagtcaaacgggaatgggaagaagcgtttcgaatcgatcgcaaggaggctgttcatatatgatccttcagctgaacggaaaacaaattgattggaatcgaaaagaggggacggttcaggatttgcttgaatcgtaccagcttgatcaaagaatcgtagttgtggagagaaataaagaaatcattgaaaaaaagaattatgaaaatacaagtttgtgtgaccgcgatgtcatagaaattgtccattttgtaggaggcggatgaggatgttaacaataggcggaaaacagtttcggtcaagattgctgttaggaacgggaaaatatccgagttttgagattcagaaagaggcggtggccttctcggaatcagatattttaacctttgcggtgcggcggatgaacatctttgaagagtctcagcctaactttctcgaacagcttgacttgtctaaatacacgcttctgccgaatacggccggcgccgcaacggctgaagaggcggtccgaatcgcaaggcttgccaaagcttcagggctttgtgacatgataaaagtagaagtcatcggatgcagccggtcacttttgcctgatccggttgaaacgctgaaagcatcagaacagctgctcgaagagggatttatcgtgcttccgtatacgtcagacgatgtcgtgctcgcaagacgtcttgaggagctcggagtgcatgccattatgccgggcgcttcgccgatcggttccggtcagggaattttaaatccgctgaatctttcttttatcattgaacaggcgaaggtgccggtcattgtcgatgccggcgtcggatcttcaaaagacgccgcctacgcgatggagctcggggctgacggcgtgctgttaaataccgctgtatcaggcgctgatgatccggtcaaaatggcccgggcgatgaagcttgccgtagaagcgggccgtctttcttatgaagccgggagaattccggtgaaagattacggaactgcaagcagtccgcgagacggtcttccggtatgacggacagatattccagacaggagctgtttcagccgatcggtccctccggccaagagaagctccggtcatctcatgccgtgattatcggcgcgggtgcgcttgggacggcaagtgcggagatgcttgtcagagcaggggtcgggaaggtaacgatcgctgacagagattatgtggagtggagtaatctccagcgccagcaactttataccgaagacgatgtcagacaggaaatgccgaaagccgcggcggctgaaaaacggcttcgatctataaatagcgatgtagaggtcgagggatttgtcatggatgtcactgcggaaaacgcacccggattgattcgtgatgcctccctcatcgtggatgccgccgacaactttgaaacgagactgattgtgaatgatgcggctgtgcagaaaggaattccctttctgtacggcgcctgtgtcggcagctacgggctctcttttaccgtcattcccggtgtcacgccgtgccttcactgtctgcttgagacattgcccttaggcggtatgacatgcgatacggcgggaatcatcagcccggctgtattgcagacggccgtttttcaggcagcagatgcgctgaagctgttaacgggcggatctatcgagcatgttctccgttcctttgatttatggaaaaatgaacggtcagaaataaacgtcgcccgtcttaagtcggctgattgtccaagctgcggcacaaacgattttccgtttttatcctatgaaaatcagacaaaagcggcggttctgtgcggacggaacacggtgcagatcagaacggggatttccgaacagtttgatctgcaaaaccttgcgggacagctcagacgggcagggcttgatgtttcagccaacccgtatttaatttcgttttgcacagacaatttcaagatggtactgtttcgtgacggcagagcattaatacacggcacaagtgatatcagcagagcgaaatccttttatcataaatggatcggataatgcgaaaggagcgaaaaacatcatgagcatatgcaaagcattgacgattgccggatcagattcaggaggcggcgccggtatacaggcggatctcaaaacctttcaggagctcggcgttttcgggatgtcagccattacagcggtaaccgcccagaacacgttgggcgttcacggcatttatccgctcacccgggaggcgctgggcagccagattgacgcggtggcggaagatttgcggcctgacgctgtaaaaacgggaatgctgtggagcgcggaaatgattgcggaaattgcggaaaaaacggatcagtacgggcttgatcatctcatcaccgatcccgtcatgattgccaaaggaggcgcttccctgctgcgtgaggaatctcaggccgcgttaaaagagctgttaattccgcgcagctatgcggtgacgccgaatgttccggaagctgaggtattgacggggatggaaatccgcacgtttgaggaccggaaaaaagcggcagaacgcctttgcaagcttggggcaaagcatgtcatcataaaaggcggacatcagcctgaacaggggagaatcgttgatttattatttgacggttcgtcttttacccaaatcagccacgcttatattgacacgaaacacacccacggaacaggctgcacgttcgcagccgcgctgacggcggaaacggcaaaggggaaaaacattcagaccgcgtttgagacagccgtcaattttgtgcgggaagccgtggaacatacgctcggcatcggagcgggacacggcccgaccaatcattttgcctttaaaaggaacagtctgcagacgagataaaaaagaggccgcgtcaacatccgcggtctttttcccatgctttcaatctggacaaggttatgatatgataaaaattaagatcaggtactaaaactatgtctttaagacgattacaggaggctttatacatatgaatttctcacttgaaggccgcaacatcgttgtgatgggcgttgccaataaacgcagtatcgcatggggaatcgcccgttcgctgcatgaagccggagcgcgcctcattttcacttacgcgggagagcgcttggaaaaatcagttcatgaccttgcggctacattagaaagaaatgattccatcatccttccgtgtgatgtgacaaatgacgctgagatcgaaacttgctttgcaagcattaaagagcaggtcggcgtgattcacggcatcgcgcactgcatcgcgttcgcaaacaaagaagagcttgtcggcgaatatttaaatacgaaccgcgaaggattcctgcttgcgcataacatcagttcttactctctgacagcggtcgcaaaagcggcgcgtccgattatgactgaaggcggaagcatcgttacactcacttacctcggcggagagcgcgtcgtttcaaactataacgtaatgggtgtggcaaaagcgtctcttgatgcgagcgtgagatatttagccgctgacttaggaaaagaaaacatccgcgtcaacagcatttcagcagggccgatccgtacgctgtctgcaaaaggaatcagtgatttcaactctatcctgaaagaaattgaagagcgcgcgccgctgcgccgcacgacaacacctgaagaagtgggcgacacggctgcattcttgttcagtgacctgtcaagaggcatcacgggcgaaaatcttcacgtggattcaggattccatattaccgcacgttaaataacaagcagtccctttcagggattgcttttttctttcttctgattttaatcattccgtcatataaataaaacatgacagaatcggagggatgaagatgtcaaaacaaaacagaaacgcggaaaaaaaaccgctcatgtatattgttcaggcggattattcagacacgcaatcatcaatgcaggacatattaatcaaaaaaaggaaagcgccgcagccgccggaagaagagccgatgcatggaaagcgggaggaagaatgtaaaactcagcctgaaggagcagtggctgtcgaaccagaaaagcaagtacctgaacagcacagccgctcagaagaagccgttcaagaagttccggcgcaagcggagcaggacactgccaagcctgacgccgctaaaaaagagcctgatgccgctgaaaaagagcctgaagcggttcacaatgccgccccagaggaaaaggttccgccaaaacgcgtgaaaaagccgatgagcagaatgtccattcttgaaaaaattgatttcttaacgaagctgccgcataatatgccgcggaccctttgtctgatagaagccaacggaaaaacctacagaggcgtaatcgtcggcagaaaaaataatgcgatcttcctgcggacgacaagcaacggagcgccggcagaactcgcaatagacgatatcacctcgctgcatccgcttggattttaaccatacaaaaagctgcctgaattctttaatccggcagcttatttttatgctttttgatttaagaatgtgtgcggttgatcagtctcgggttcaggcaattgatggcgcagaagctattaagatcgacttcaacgcaatagttcgttttttctaaacggaatacatcgcagagagagtctttatctgtaaaatcaagaatgtgtttatgctcatcaaaagcaataagcaggcttaatgtggcacagccgtcacagaccctttcaactctgaaaaaaacggtattaaaacacggaccgttatccagctcgccgacgtttccgaatgcggtgaacggtttcgattttgaggtgaagatggcgaacggcactgtattgcctaatgtataagccggagataaaaggttagaataacagcctgtcgggcaatcttcttcgaccgcattttgcaggtcttcaatattttctaccgcttcacgcacacagtatgttgttttctggttcataatatccctcctgccttaacgttttaaatgggaccggattaaacgatatcggagagtcagccgcccggaagtccgggcgggctgatgattgcatctgtaatagaagattggaaggggattctctttagaaaagatgcgaatcaatgactatccgtgatgctttttctctttgtgcggctcaggccggttaacaagctccggtgaaaggcactgaatggcgctgaagcagctcagatcaacttcaatgcaaaattctgttttttctaaaccgaagaaatcaggatcacaaggatggcagacgctgagggtgtcgccgtgcacatctacggggcgcaatactgacagcgtcgcgcagcaatcgcatagtctttctacacgaaagaaaatggactcaaagcactggctgtcatccgcaaatcctccgacgttcccgaatgtggagaacaatccgccttttttatcaaatacgagaaacggaatggtgtctttacctgcaatcgtcgggctcaaaagattcgtatagcatccagtcgggcattgttcttcaacagcctcttgttctgctaaaatcttctcgactgcatcgcatacacaactttcatctcggccatggtgttttccgcagctcatggatttcagctccttcttttagggtatttgacttttgtctttaacaacatatgtacgcgagcctcacttggtgtgggtgaacgtctatatattcatcatatgcggagaaaataagaaaaagcagagcatttttagctctgctttttctttttagaggacgagggtgatgactaagacagcaatcagtaaatttgtggctgttgagatcaacactgcgatatcggcatctactgttgtcacgtttacgccgcgggagttttcgatgagcagtttttgacggttgatttgtttgttagctgttagctgcaataagtcttgtgcgaccaattcggcgatgactccgtcagcaattgaagtgagagtggccgttacgactgctgcattaatcgctgtcatgactgaagcgactgcttgaacgtctgttgacgtcacgttaatatcacaagagtctctgataataatcgcttcttcagaaacttgtttgttgagattcgcctgagccaggtcttggtcaaggaaggcattatcttcgccaaatccatgtccgttacagcaaacattacatcttcttccttctttttcttctttttcttctcgcggatgttcgcattcaggatcaagtgcaacccaagagtatggtctgctttccatatctattcctccttttcttttactattattaaatgagccggcctcttattttgactcaggcatctatcctgataaaaatcactattttttagttattgaccgggattttggcgtctttgccggagctgttcgattaattgttctctgcgggtttgcggatttgtctgctgttcttgcgctttttcctgctcttttttctgtttctggctttcaagaaaagcttctgtttttgcctgcatgtctttgactaatgcgatcagcatttctttttcttcatcaggtatttcccgcattttatcctttgtcacgccgtgttttttgaagacattgctgacaagcacctttaaaagcggatccacttctggtagattttcgagttctttttttaatttttcgttatctgccatttgttctcacctctatttaaatatttgaaaagaaaggttaaaggatgtctagttcagcaaaaagtatatttaataattgaaacaaaatttgtacaaaggccatgatatcgtctgctgtcagtgtgattttaatattgcggctgttcaggacttgaatgacggtcctcttttttatttggcaatcatccaggatcagcagttcggttgcgatttggtcggctgtgtcttcatctgcgatcgcgagctgtgtcgcgaggataatcgccgtagtaactgaggcttgtatagaaagagcggccgttatatgtgttgtatctattgtgacattttcgcaatcaatcacttcgatcgtctgctcgaattcgttggataattgttcgtatatttgcggttgcagtgtttcgactttttcttcaaacgacataaccttcactcctttctcattcatactctatataatgcaaatgaaacgccgagcggaataagaaaaacaactaaaccgcacctatttttttgccggacaaggtgcgattcatgaagatcagggttttcgcatatgtataaagaggtcatgttttgaaaaggagtgaacaggtggttatcaattggctttcatttattctgttatcgtttgccgttttccggctggccaggcttttcgtatttgacaccattatggcgccgcttcggagcctttttcacgaggaaaaaacagaaaccgcacccgacggcacgacagaaacctacattgtcataaaaggaaaaggcatcagggcatttatcggtgaacttctcagctgctattggtgtacgggcgtatggtgcgccgcctttttaattgcggcgcagattgtgatccccgaggccgcgcaatggctgattttgctgttagccatagccggcgcggccgggatcattgaagctgcggtttctcgtcttctgcaggaataaggcggttccaccagcaacttaccgtcactttcggcataaactggcatatatgacataaggaaaggaaggatcaccatgaatcaatcaagcaaaccttcccaacactctccatacaaatcaactgtgcatcagccttacgaaaaaaaaattaagaaaaaaggctgcggctgcggccaaaagaaaaaaccgaaatagccgtttttaaaaaaccggagcttccggtttttttgttttttgccgaacgccggcctctgtccggcatagatcataggaggaggggatgttatgaatatatttgaatcattcataaacggtaaataccgccggcacaatcaaaatcagcaggagcatgacaactatatcttatctattgaaaaacagctgtctgagtttgatgaagcgggatcgcgctttgaggaatggatagatgtgtttgccgccgaaacagaatcgaaactgaagaaaaatgagcattctcaataaaatgaatgaaatccgcaccggccctatgcatttatccaagccaaacaagtcggctcacatagagtatagagagtaaaggaggtgcttagatatgggattcggatatggcggattcggcggcggctacggttacggcggctgcggcggatacggaggcggctatgtcggaggcggctacggctcaacatttgttcttgttgtcgtattgttcatccttctgatcattgtcggtgcatccttttttggctaaaccttagcaagactttggataagcgcgggaccgttcagtcccgtgcttccctgatgtatgaaggagtatagagacggggcactctgaattttttccttgtcttacgggcacatgttccgctctttattcatacaatatcgtattactccacaaaaggaggcacaccatggataatcaatttttcaaaaatattgagaagaaaacaggcgtcagcatgaaggatgtcatgaaccttgcaggatcattgcaaaatgccaatttcaaagatgaaaacacggtgagaggcgtcattcagaaggtgtcccagctggctaacaagcgtgttccgaaagaattggaagacaaaatcgttcaatcgattacaagcggtaaagagaaacttgattttggcaccatttctaaaatgttgaacaataaataggcgtcagccggccttgctaaaaaggcctttttatgtgagaaaaacccggcagatcactgccgggttctttatatcctgagtgcgctccgtctgtccgtccggagaaggggctcgagaaatcttgagctgcgcgctgtttttccccgcctgtacgcgggacaagatacatataaatgctgcatggcccttgtcattgcgacatacaggagccgtctttcttcttcgagcggagcgggatcgccctgtctcgccgtctcaagcgcgaagtcatgggggatcgagccgtcagccgcgcctaaaatatagaccgtattgaattcaagacctttagagcggtgaatggtcagcagttcgacgccgttttcatcggttttctgattctcagcggcgcgcatatgatcgacatgcgcaagaaaatcgggaatggttttgaattttttggcggccactttgacatccctgagatcatcagagcctttttccagtttgtttccctcattgccccgtttttttaaatactcggaaaaacccattttgctttctgcaaaggtgatggcttcaaccggcttcattgtccggatgcttgcgaaaaacggaacgatctgcttgatcttccctatttgaaaaggcttcaggtcaggcagtttcgtcagtgccttaatcatcgtgcaatcttccgtgattgacagcgcctttaacgtttgcagggcggattgctttaaaaataaggcgggcagcaggtctttcaccgcatccgtatcatcttcattctgactcgcatataagtaggcgaggatctggcgtacgattctgcggctgtagaacgtctgcacgccacggtcggcatgataaggaatcgatgattggtgaagtctttcataaatggcccgtccggcgctgtttgtccggtaaagcacggcaaaatcgtcaggactcgccccgttttgaattttctctttcatatccgaaacgatcatggtcgcctcttcttcttcatcgtaaggataaaatatcacgggattgtgaacgccgtctttgacggcagaaagtattttttcataccgttttttatttttctttacgacggcatgagcgcttgagacgatcggatgcggcgagcggtaatttgccgttaagtaaatggtctttgctgccggataatccttttgaaaatcaagaatgaaagacgggctgctgccgcggaacgcataaatggattggtcgtcatcacccacgcagcacaggttattctccgggcttgcgatcatttgcataatgttgtactggacaggattaatatcttgaaactcatcaatcaaaatatgagaaaatctgttttggtactgcgcgagaatatcaggccggctttgaaacagttcataacagccttgggccatgtcatcaaaatcaaattgccgtttttcccgcttctgccgttcgtaacgttcgtagagccggtacacttttttctcccagtcgtccgcaagcggaatggtctcatgggggagatacgtgtttttccagcagccgataagctgtagcgcctggtcgacgggaaactctttttcatccaaattttcttcataaagcgcctttttcacatattgctctttttgccactccatttttaaaagctggctgccgttccattttgaagaatcataatgatagagtattttatagaaaaaactgtggaatgttccggtcacgagacgggagacttttccggctgccagcccgtactcattcgccatccgctctttcatttcggcgacggcttttgtcgtaaaggtcacaagcagcatattctcaggtgaaatgccgaggtgttcaatcatatgggcggcgcgggctgtcagcacccttgtttttccgcttcccgctccggcaagcactaataaaggcccgtccgtttcagtaactgccttcatctgttcgcggttcaggccgatgccggggaacaaagatgtatcagccgcctcggatgttggtgaaaacggttcggccgcaggcacttttttcgggcttttccattctgagacgatcggtttcggattctctgaaatcgcttttcctttcggcaggcggaacatgcctgcctccttatactcttctttttctttctccgcttgtggttcctcggccgcacatgctttttcacaggcggtgaagtctcccttttgccgatgataaaatgccggctgctctaaaatcgaaagccgcatcaagacgggctggtcacaatgtgcgcaaaaaatatttcctttctgagcttcttcaaaaaggaattggtaatgttctctagaatatgtatgtaaatgtatcgttcggttattcagtcgggcgcatttcaaaaaggggtcctcccattaaaaggtgttcatccatttgatagacaaagaatatcataacaaaagaaccgcgtttcaaaaagtaagattaagggaaataaaaagcgaaggggaggggtacatatgatttatgcaggacggattcaaaaccagcagtattctcaatacgcaaaccgggcagcgggttataagcctgattacgccggtattacgaaagcggccgccctcgccaatgacagggtgtacagagaggtggagcgccgccaggaaaacaccgcagccgcagcaaagaaagtgcatgaagaaaaacgtaagcgctctctttcccgtctgccgcaaattatgggaaaaggccggttgataaatcaatacgtgtgaaaaagcccggaaatctccgggtttttttgagccgtatagatgaaagatgcggaaaggaatgattcaatttgagaaagctttcattattaattgcggggttatttctattcggcctctttactgccggaatgaaaccggcacacgcggcggagagctccgcagcaaaagatgtcactcttacacagctggcgccgcatgtctggatgcatacaagcatcggtacggcagacggaagtcccgtccctgcgaacggattgcttcttgaaacttccaaaggaatcgtactgattgatactccgtggaatgacagtctcacagagcaattaatgacagaaataaaacagcggtttcccggcaaaaggatgaccgatgccattgtgacacacgcccatgacgatcgcatcggcgggctgaacacactgtacaaatacggtgtaaaggtgcacagcacgaagctgaccgccgacttcgcccggcagcagggatatcaccggccgctcggagatttgaaaaacgtgacaaagctgcagtttggcgatatgaaaattgaaacgttttatccgggaaaagggcatacggaagacaatattaccgtctggctgcctgaggataagctcttattcggcggttgtttaatcaaggctttagaaacaaaggaaatcgtgccaactccgggcttttatccggatcagtggccgcgcgccgtccgcaaagtcatgaaaagatatcaggacatcagcattgtcgttccgggccatggcagtccgggggatgaccgtctgctgccgcatacgataagccttctgaaagaaacgtaaaaaagaaaaccggcgctcccattacggagtgccggctttttttatctcttcctgattttcataaaactgaggaaagcaagtgcaagcgccaaaacggtatatcccgctatcggccaaatatgctgatgaaaggaagaataatctccggatatgacttcctgggccagctcgatcgagtgaacaaacggtaaggcataagcgatatgtttgaatgtgtcaccgagcaggctcacctccatccaagctccgcccagaaattgcacgagtgtaatataaatcgttccgatacctgaaatttgtttgtccgtaaacacagcccctaaacataaaccgaagaaaacggacatcatcgcaatcggcagcaagacagcgatacctgcgagaagattcatccactcggcggataaaccggcagcagcagctgcgataaaacaaatgatgatttgtaaaatggctaacggcagcatcggcattgcgtaaccgataacataatcggctgtttttaaaggggaagcaaacaaacgggtcaaaagggcggtctgtttgtcttttgcgatcagcaatgcagagaacatcgtaaggaaagcgaaaccgaaaacaatgagtccgggtgctaagtgctgaattttaaaggtatcaagtggcgcatttttttcaattgccgtaaacagaaacaatagaataacaggcagtgcgattccaaggataatagacagggggtcacgaaaaatctctttgcggttgcgaatggcgaaatcaagcataaagacccgcctctccgtcacaaatcgctaaaaaggcatcttcaaatgtggctgaatgagtttgttttttcagatcctccgccgtgcccagtgcttttagagtcccattttctaaaatgcaaatacggtctgccagggcttcagcctcttctaaatagtgtgttgttaaaataatcgtcatgtctccctttaatgtctcaagatttttccacaactcgcggcgtgaacggacgtccagccctaatgtcggctcatctaagaaataaatatccggttttgtaatcatgcccattgcgatgctgaggcggcgctgcattcctcctgataaggttttggtttttgctctttctttctcttttaattgaaacaattcgagcatctcatctgttcttttttttgcttcttttttcggaattccgtagactccggctataaactctaagttttcccgtacggttagatgaggagcgatggctgtttcctgcggggacatgttcaatttcggttttattttatccaaatcagtcaaaatactgtgttcaagcactgatgcatcaccctcatccggagagaggagtccgcaaagcatactgattaatgtcgtttttccggctccgttctcaccgagtaaagcgaaaaattcccctttctcaactgagaactcaagacggtcaacggcggcggtttctttataatgtttcgttaattgcttcagctcaatcgcgtgcatttactcgttctcgctatctgcgtcgatttgcttagcgtttaaaatatcttttgcaaactcgaaaaagagttcttgtttaacaagtgcgataccttgctggtcatccccaagcataagcagtgaatcccccggatttatatcgaaaacatctcttgcttctttaggaatgacaatctgtccttttgtgcccactttaacagtcccgaatatgtgttttccttttggtgccgtcatgtttatccctccgaaatatgaattatattttttgtatgaattgtaatacttcgtatactaaacatacattaaccttccataaaatgcaataaatttcatgaaatagtatgattttcataaaaaaagcactcctgccatatcaacaggagtgcttttgattttattgtttgtattcctttatcatttccagatgggggatgcccgcatcgagaaattcttcgccggaagtgacgcggtatccttgtttttcgtaaaacggaaccgcctgcgtctgcgcatgtaagataaagctgccggcgcccttggctgccgccgctttttcaagcgcctgcattatgatggctccgacgcctaaagaacgatggcttttcattacgcagatgcgctctaattttccatgcccgtctttcaagcgccatctgccggctccgaccggctggccgccgtcatatatgactatatgctctgacgtgtcttcgaattgatcaatttcctcttcttccggaacatgctgttctttcacaaagacctcttttctgacgaaaaaagcgtcgttcagctgtttttcagtttttgcgatgatggattccaagcagttattctcctccgcctaataaaaatgtttcgtacacagtccatgagccgttatccagctgatagagcaggtgaaaacggtcgatgacttcttcgtgggaaatgtcctgcattttcagctgtccgagtacgtcggaatgttcatctgacgacagcttctggccgaccgtgacatgcggaacgaagctgtattccggctcgccggataatgctcctgagtagcatttctcactcagagattttaattcctccgtcggctctgctttcatatatatcacattattcacaggagaaaacgagctgtattttgtgattttcagaacgagcggatgcgactctttcgccgtctgtctcagctgtgatacgacctgctcgatttcctgttctgtcgcttcaaacggatctcttaccgtcagatgcggcggaatgagcgcgtagctcgggtcgtagcgtttccggtacgaatttgcgagatcctgtaatttttttgatggaaataaaacaataccgtatttcatgaaagttccctccttaaatgaatggttacagcatttttttcagcgccggcgtgatgagcggctgccagtatgtccatttatgatccccgtcaaaggtttcatacgtgtattcagactgtttgctttccagcagctgtttgagctcttcgttcggcgcggtgaaatcaagcacctggccgtccgtcgtgtggacggcggtttctttttctccgatttgatgataaacggaaatctgtttgagatcctccgactgccggacggcatccagcacgtgcccgtcaacatacggagactgcatgatgacgtttccaaacatattcggatagtcaatcgccgtcatgagcgaaacggttccgccgagggaatccccgatcatggtgcggccgtatccgacttgataagtcgggtattctttgtcgataaatggaacgagctcattggcgataaaccgcttatatgaggcgaacttagagccttctggatggtatgtgtttcttcgctcccgcacatttttataagggacgccgataatgatgcagcggtcaatttccccttttgacataagctcttccgcctgacgcccgattctccctaatctgaaataatcatggccgtcctgagcgatgaccgtatgatatttatacagggggagaaggtggcgggcaggtagaccaaaacggtcatttcctcttcaagctcatgggagaaaagtgttttctcatgaatgattccgttttttgatgccacttcgcattcctccaggccgcttcttgtcttgatggttttttcctattgtaccatgaattattagaaatttctttcttcagatgcacttcttgcgagagttcagataaataaaaagttgttgaaatccattttatagtgcgttaatatagaacaatcagaaaatacaaaacaatattcttatcacgagaggtggagggactggccctttgaaacctcagcaaccggtttgctttgccgcgggaaggcaaagtgccaaggtgctaaatccagcaagcgattcacatgcttggaagataagaggaagagaaaagctccttcttcttatgaagagggggcttttttatttttgaaaaaggatggtgcttactgatgacgcagcatgttgaaacaaaattagcccaaattggaaatagaagcgaagaagcaacgggaacggtcagtccgccgatttatctgtccaccgcttaccgccatagaggaataggagaatctacaggttttgattacgtgcgcacgaaaaacccgacacgccagctcgtcgaagacgccatcgccgtgttggaaaacggtgcgagaggatttgctttcagctcgggaatggcagccattcaaaccattatggctttatttaaaagcggggatgaattgattgtatcctccgatttatacggaggcacgtaccgtttgtttgaaaacgaatggagaaaatacggcttaagctttatttatgatgatttcagcgatgaagactgtttacgctccaaaataacggaaaacacgaaagcggtatttgttgaaacgccgacaaacccgttaatgcaggaggcggacattgaaaaaatcgcccggattacgaaagaagccggcctgcttttaattgtggataatacgttttatactccggtgctccagcgcccgcttgaactgggagcggacatcgtcattcacagcgccacaaaatatttagcggggcacaatgacctccttgccggtctggctgtcgttaaggatgaagagctcggcgacatcatgtttaatcaccaaaatgcgatcggcgccgttctcccgccgtttgattcgtggcttttaatgagagggatgaaaacactcggactcagaatgcgccgtcatgaagaaaacgcccgtgaacttgcagaatttttagaacaggaagaggaaatcgccgacgtgttatatcccggaaaaggcgggatgctgtctttccggctgcaaaaagaggaatgggtcaatccgtttttaaaggcgctgaaaacgatctgtttcgcagaaagtctcggcggggtggaaagctttattacataccccgcgacacagacgcacatggacattccggaagatatccgtatcgcaaacggcgtctgcaaccgcctgctgcgtttttcagtgggcattgaacatgcagaagatttgaagcgggatgtaaagcaggcattacagcaagtaaaagagggggccgtgtcatatgagtaatcacaattggacgctggaaacccagctcgtgcacaatccatttaaaacagacggagccaccggagccgtcagcgtgccgatccagcatgcttccacattccatcagtcttcatttgaagaattcgggacatatgattacagccgctcaggcacaccgacaagaacagcgcttgaagaaacgattgcaggtcttgaaggcggaacgagaggttttgctttcagctccggtatggcggcgatttcgacggcatttctgctcttatcccaaggcgaccatgttctcgtcacggaggatgtgtacggcggaacattccgcatggtgactgaggttctgtcccgtttcggaatcgaacatacctttgtcgatatgacggacacagaagcggtcgcccgcgccatccgtccgaacacgaaagccatttatatggaaacaccgtcaaacccgacgctcggcatcacggatattaagggcgtcgtcaaactggcaaaggatcacggctgtctgacataccttgacaatacattcatgacgcctgctctgcagcgtccgcttgatctcggtgtagatatcgtgcttcacagtgcgacgaaatttttaagcggccacagtgacgtgctgtcaggccttgctgccgtaaaagatgaagagctcggcaatcagctgtataagctgcaaaactcgtttggagcggtgctcggcgttcaggattgctggctcgtattgagaggcttaaaaacattgcaggtcagactggaaaaagcgagccggacggctgagcggctggctgcctattttaacgggcatcccgccgtcaaaaacgtttactatcccggccttgccggacacccgggagccgatacccataaacgtcaagcgagcggagcgggcgccgtcctgtcctttgaattggaaagcaaagaagccgtcaaaaagctggtcgaaaacgtatcgcttccggtatttgccgtcagcctcggcgccgttgaatccattctctcataccctgcagccatgtcgcatgccgccatgccgaaagcagagagggagaaacgcggcatcacagacggccttctgcgcctgagcgtcggagtcgaaaacgccgaagatttagaacgggacttcgaacaggcattgaaaaaaataacccccgcccaagtgagatcataaacgaaaagggcgccgtcaattttgcgacgcgccctttttttattttagataaaaaaagtgttgacgaatgagaaatcaggatatataattataaatgtcagagagacaacaacatacccagcaacacatacatatcatgattccgtagctcagctgggagagcgctaccttgacagggtagaggtcgctggttcgagcccagtcggaatcatagccaaaacccttgcgcagcaagggttttttactttcttttaatatagccggtttatcaaattcgtaagttgttcgcaaactgttggcgaacttgattttttggctcgaaatttattggccgtatttctttttaggatcaaaatagttgaaaagttcagctggtgatgccgtcaagtagatccaaaccgcactgtgtggtattgcatttctatccggataaaaaagccaaaaaatcggtatcaatataaaaaggccctctcataaaatgggggccttcagtgtttcttttaaatagcttcttttagttgttctattacacttttcaaccattctataggtggtaagccaattgtcgggaaatatatttctgcattacactttataatgtcttccttttcttctttagttagatcgctatttagaaactcttcgcaatactttactgtaaataccaaaccttctttactaatttcctcaataaattcgtctaaggcgtgttcaggggattggatatcttgatgaaatgttgcacctaaaaaattttctaattcatctaagaaatcatacctttcatccatgatacttcctctctttctatttggttggatatcctgtaaggataaagttaccgttattatcttttttgagtataatttttgcgtttgtaacgttttctactagttctgaatttcttgatacacttctgcctattatttctccatcgcccttgtatcttaacattaatttaggttttttaggatcatcaatccaattttcgattttctttatattttttggatcgtttaaaactgaattagcaattctttcagcggtagccctatctttaaaagtagatgaagctgtaatatgtgggttaggatcagttttcagtctttctattaattctttatctgttttcccaacatgcctttctataaggtgtccgccttttgcctcgtgggcagctaatccgccgcccggtgcgagaggactgctgtctccttgtttaacactatgtatgccgttattgtcagaagtcacagatttactgagaacactttctttctgatcttcaataatacttttcaataaaggcgtattcttcacattgtgagtattttcaatatcctggcctattccggcaagtgcaggttcatacttatttttagaaacggaattgatataattttttcctttttcaatcccggtttttacatgttttgcagccgctttttcaccggcttccaagacgttatccactttggcggcacctgttttagcgagcttgcttgatacttttacagctgagccggaacctttgagcccgacaatgcttatttattgattttgtcatcattcatcgaggggcgaattggggacggaactgcttttttgggccgattttgaagtacattcgctgtatacttcaagggaggtgaacatcgcctttaaggcggcggtctttgccgaaacctgttcattacagagaaatacagaaattccgtatcactgaacggctaaagtgataacgatcagcagctggttaatcctgctgtttttttgtatttgaaaaacggaatatttagttttgtatgaaaaatacagcgaaattctggaaatcattcatagaacaggaaatgacgcatgcagccgctaatgaaatcagttatatgaccggtagcagcgaatcgactagatatcattttgccgtcgatgataaagaagtgatacagggggccctccatcctaaggcaagaaatcatccttccccttgctttccggttttttaaagtcaaaagcccattgagcgtaaaacagattcgaacggcgctgtcgaccctttattaaagcggaagaactttggggttgatggagcatatggagcgaagacagcgaatgcagtaattgatttcaattggtgaatggattaaaagctgatggaatttatgcgcttgaaccaaagcaaaacttgaagtgttgttaaaataagcggagactctttccttttttacagactctctcccacactgaacaagaaggggttgtgttaaagcaaaatctaagaaattaaatccaaaaagattgcaatgacaagcttctaaagagatgaaaaatatcgggatatcaactaaggcgcaaaatgcaataaaacaggagcttgaaaaaagaaaagaaagagaaaaaataaaggaacaagaatatttaatcagaaaacaaaaagcaaaagaaaagcataggggcaaatagttggagaacccgctgaagcacttcgattgaaaagttgagcggcatcagttttttgcttcggactgatttagagaaaaagaagtataagtcagagcccttctcaagatgaggagggtttttttgcaatttatttaaattcacttacatcagtaaatgcggctgaacgattcagtacgattcagctcatgtatggtttgaagccagacggaatttgcggaccaaaaacgaaagcgaaatttaattaataaaagaagcccttcttaaaagagggctctttttctaactatgttgtttaagatgctttttaatttgttcagtgacttgcttaagccattctaatggagttatatcatcttcaggaaagtatataccatccgctgcttcctctataaattcattcttgtcttcttctgaatgatcactatttacaaactcagttagtgctattaaatctctttcttttagtttttgtgatgcttcatttaaatattcatcaagtgcattttccggagactctatatcttggtgaaaatgtccaccgagaaatctaaatacaggatcagaaactttaatttcaatcattatatatcacctcgttgggtagcctgttagtataaagctaccatctttatttttctttaatactattctagcataagtcatatctttaacttcatttgaacctttacgaactcctctacctataacttcggttcctctataaggtaacggtaatggatcgttaacatcactttttaaccactcttcaatttcctttttatgtttagttaatgtttcattagcgactctttctgcagttggcctatcagtgaaactagaagaggcacgtatcttcttgtttatctgtagcctctgtaataactcttcatcagtcttaccaacatgcctttctataaggtgtccgccttttgcttcgtgagcagctaaacccccgcccggtgcgagaggactgctgtctccttgtttaacactatgtatgccgttattgtcagaagtcacagatttactgagaacactttctttctgatcttcaataatacttttcaataaaggcgtattcttcacattgtgagtattttcaatatcctggcctattccggcaagtgcaggttcatacttatttttagaaacggaattgatataattttttcctttttcaatcctggtttttacatgttttgcagccgctttttccccggcttccaagacgttatccactttggcggcacctgttttggcgagcttgcttgatacttttacagctgagccggaaccttttagtccgacgatgctcccgatggcgtaagtgatgtaatgggatcttgaatacgcatccccgttaaccattttatcattccatgaatccgccaggtttgtccatatgatttttgcgtaggagggcgtgttcaatacagcagatatggttttagcgactttttgttcatcagagagatggtaaaaatcccatgcgccgacagcgagatctttgacgcctattatggtgtcttttcccacatcataaaggccgacgcctattcctttgacgatatcccaagctgtttctccgacttcttcgagctgttttgcttgttcgagctgcatcacatattgcacctgagcgggttcaaggttttcatagccgatcttcttcgcgatttccaaatactcatccggatcggttacaccatcagccagctttttcttcagatccttgatttcacgctctttcgcctcttcctttttaatcgtcaaataagcatccgaatgtcttgcgatgtcgccttttttcttatggatatcgctttctcggtatgctttggcattgtagtgaagcggcgtggcgccttttcctttgcctgtggcgttttggagctgctgaaagtcggcttggatgaactgttcgtttgcttcggtttctgcgtattctttcgttagatcgtgatcaagtttgccgagcttatgtattgtttcgtttctttttttgtcagctgaagagagcttctgatccgtgttttcggttgaaaacagatcaagcgagatgatgtcatcgatctctccgaggatggagcgcatgtcctttttctgctcttccataatcgcctttgatttactgagggcgtgggtgagctcgtgttccagaaatgattcttctacatgtgaattggaaagtccggcatcttcgaccttgccgggaaggcttgtgagaaatgcgattttcatatcgatcagatcaagccaactgtctatgacgccggcgtggtccttgaaaaaagctttaatgttgtctgcgccccggccggagaaatcattgtcaccaagatcagccatgccttgaaaggcttttttcaggttgaccatctgaccgcgcagttttttgtattcacccgcgcgctgtttggcagcggccaggagggtgtttgcttcaaaaactttcatgaccatatcctttcatgcgaaatacttcaacaagatattaccatggaagaatgaaggaaaagccaaataagtattttgaaagtgcaaaatgattaatttgttctgggtaaatttacttattttaagatcgggaattggagtagagttagctttgggttgaatcggttgttagaacatcatgtgacgcacctcctttgaaaagcatacacacatattagagggctgaaattcacccgaatgaattaggatacgacggtcaaaccgcttttcgcatggaactaacatgggcaactggtcaacagctttaaaaacttcatcataacagggaaatgcggcgggcattgggaatataaaggaatataggcttacagctatgaaaaatgtatgaaaatccgtcagacggcgaaggaaaggcaatctccatgtgttgtgacagttcgaatgcgggtgtatggaacttcccattcatccgagttatgtcagagggacgaaaagactttttttgaggaggaagcggaatgattgaatttacacggccattgcctatgaagaaaacatgcacgatgcacccgggaaaggaatctgtcagatcggtttcgtttactgattttaacggcaattctgtaacagtaaccctttgtcaaatgtgtctggctgaattaaaaatgaaagccgcgactgaatacaggagcatgacagaggagcgggccaaactgaatcgtttcaagattggtgatcatgtgtatttagagcatttgggagtcgtcagcgagataaaaaacatggaaggcgttcaagtggcaaacaggacagacacagacggagtccgaaaggctacccctaaggaaatcgcagaatacaaaaaacaggggaagcaatgacggtgaaaaaacgattcagtcaattatttatcaattgtgttacttatgagagcggcggccgttgcgccgcctgcctccgccgcatggtccagctggcaaaatgaattcgggtggagcggcggggcggctccggcaagaaatcaaacgctgtatcacatgggttcttctcgaaatatctgccggaaattaaaatttcagctgctttcctaactgtcacggaaaacatctcacaggaaatatattgactttcatcctgtttgtaatgttaattagaagatgtatacaaaaacattataatgaggaggcctgagtgtgaaaaataaagcgagaatacaagttggactatgcattggacttttatgtttaagctttaccggtttcagccctttattcggctctacgcacgctgaagcaaaatccatagaagacacaaaaatgacaagctgtacaacgaacaaaaaatttgttcagcttgagaaaaaatttgatgtcaggcttggggtttatgcgattgatacaggttcaaacaagacaatcgcctatcggccgaatgaacggtttgcttacgcatcaacctataaagttttggctgcagctgctgttctgaagaaaagctcaaatgaaaaacttaatgccatcatccgctacagtaaagacgatttagttacatattctccaatcacagaaaaacacctggatacaggcatgagcctgaaagaaatctccgaagccgctgtccgttacagcgataatactgccgggaacctattgctgcagcagcttggcggccctaaaggtttcgaaaaatcactgaaacagatcggggatcatgtaacgaaagcggatcgattcgagacggatctaaactctgcgattcccggggatcgtcgtgacacaagcacagcaaaggcactggcaactgatcttaaagcgttcactttaggtaacactctcacgactgacaagcgcacgatcttaacggattggatgcggggcaacgctaccggcgacgaactgattcgggcaggcgctcctgcaggatgggaagtcggcgataaatccggagccggaagttacgggacgcgaaacgacattgcgattgtgtggccgcctgacagagctccaatcgttttggcaatcctgtcaaaccgatttacggaagatgccgattatcataatgctcttatcgctgaggctgcaaaagtcgctcttaatgatcttaaataaacattgccgttcattttttatggacggttttttatatgttgagaatgcggtatgccggtttcgatgttataatgtaaagccataaaatgatgggaagagggggagtttcgatgcattacataacggcatgcttaaaaatcatcagtgataaagaccttaatgaaataatgaaggaattcaaaaaacttgaggaagaaacgaacaaagaagaaggctgtattcagttccatgctcatccgcttgaaccatcagaacgcaaaattatgctttgggagatttgggaaaacgaagaagctgttaaagtccattttacgaaaaaacacacaaaagacgttcaaaaacaagaattaacggaagtagaatggttaatgaaaagcaatgtgagtgagtaaaaggctttgtctgttgttggccgactctgccggtaacaatcatcagtttcattcattaaaacccttgctgcgcaagggttttttactttgaaaagttctttatatcgcagtctttttatgggtaaggaacagacttggaatgaagatggccgcaaggatgatgacggatactaagaatccggcatggtagccttttaaactgttcggaatcgttggctgcaatccttgtatgacagttgcggtaacggttgcgatcacagctgacccaaagctggaaccgaggttttcaatcatatgaataccgacacctgcttccggaagccgtttgctgtcaagacctgtataagcttcactcattaatgggagcataattcctccaaaactggtgccgcggataaataatacgacggaaatccaaatcatacttgtgttatcggtgataaaaataagcgggatagatccgatcagcgaaagaacaagactgaccgtaaccacgtatttcgcaccgatcttatcaatcatttttccgatcagcggacgagtcacgagcattccgactccttgagggattaaagcgagtgctgctccgactgccgtgaactgacgaatgttttgaaaaaacagcggaaggattaacatcggccccatgatggcaatattcgctaagaacaacccaattgaagaagctaagaagctcttgtttgcaaacaaattcataggcagcacggtttggtttttcttgatcagattatatacaagataaatgactgctgaaacaagaccgatgcccgcccataaaatggtgtcgctattgttaaatgatgcatgatccgccgctttcgtaataccgtacatcaatgccgcgctcattaatgacaaattgataatcccgaaaatatcgagtttacgatctttgttgaatggttcaaagtctggaatggttttcatcataagcggtgcggcaatcaaagtgatgaacacgttgatgtaaaaaatccaatgccatgaagcgccttggacgatgaagcctccgatgacaggtcctaagatcgggccgaagatcataggggtgctgacaattgccatcacttttcccaggttttccggacctgccgttttaaccaagagtgatgacataagcggagtgataatgccggcgctgaatccttgaagcaaacggaagaagatgaagctggaaacgtcacggctcattcccgcaaaaacagaaatgacaccaaaggcgatgactgagccgatgaagattttcttaccgttatatttattcataagccagccggatacgggtactgcaatcgcaagtgctaacatatagcctgtaacggaccactgaatggtatccaatgttgtgttgaagtctttggtcagtttggcgatggcgatgtttaccatcgtagagtcaagcattggagcaattgctcccagtgcaatagcccaggcggctgtgagaacttcttttggcagccgaagttcctttcttttatgtgttgacatattattctcctctcaaaattgctgtatttgtttccttgtcaacaaaataatagagtgattttgtttctttgtcaacaataagagggatataaaaaggcagcccgttttcatggagcggggctgcctatggttttattcatatttattccgatttcatgtctgcaccaagtttctttatttctgaatccaaatgcctgctgtatgtttccacgaagctcagcattgtgtcaaattgttcatcggttacttgttcaaacacgattttgtcccgttcttgaaactctttatgcaattcctcgtgaattttataaatgacttttccttgctcggtaagcctgaaatagatttctttcttgttaagcggcttctgatagctttcgataaggcctttattgataagcttcttcgttaatttacttatagcgcctcttgtcatataaagggactccgcaagttttgtcacattggcgtcttcaattttttcgatgaattcgatgcaatgcacttcagaaggtttatgccccttaaggctttcttccatcttcagcctattcagccacaccatcttgttaaaaaagtccctgaaatccgtgaggagctgttcttttttgtccatggcccgtcctcctgctcggtggtgcttacacaatattataaaatgtttgtttctttttcaacaatcgtaaagttattatttaggaactgagagatagtgcgcagaaataagaaggagggggaacagaagaagtatcctatttttaaccgaaatgtggtttttcgagtatgtttctttccgtattcgttactagctcttcataacaggctaactctgcagccttacaaaaaagcaggctgcgaaaagagcctgctttagaattgcatcaatcattttcctgttgcggcatcataaaaagcgtcaattgcggttgtgtatttcaagacgtttttagacactttggcggttgcgcctaatggatacgcgtctgacagaacgctggagtgagcttcgggttcccagtaaaatacgccagttcctttgccgttcggaacggctttcaccagttttatggtgtcttttatggtccagtaggaatctttcggattattttcatctccgcccagttcaaccaccatgacttccttgttgtagcgtgaggcgatatcattcaaattagatgataaatggccggtgagctcccagtacggcttaccttcccaatagggatagaacgaaacgccgatgatgtcggtttttcctccgtttttaaagaattgatcaaaccaccatctgaataggctgttgtccgtgccgtgtgccaaatggctgatgaccttggtggccgggctgacggatttcacggcgtcatagcctttgttcagtaagccggtcaatttgctgaaatcgctcgtgctgccgtcgggcagtaaaattcctgaattcatttcatttcctacttgcacccaatcaggggagatgccgtgatttttaagttctttcatgacatcgtacgtatggttatacacggctgcctgcagctggctgtttgaatagccggtccattggttcggcttgatctggtggccgggatcagcgaacacgtcactgtaatggaagtcaaccattactttcattcctaacgcttttgcccttttggccgccgcaagtacgcccgctttgtcactatagccgagcatggtccatgttgtgccgtctttcagccaataatagctgcttggcggattcacaaacactctcagtctcacggcatttattccgtgatctttaagaatctgcaaggcatctttctgtttcccgccgtcatccagccagcgcacaccttcatcctccatttgtttcagccatcctatatcagcgccataggcaaacggggcatccgcttttgctttaggagacttctcaagaaatgtaaaagcggtgaaaatgagagaaagacagattgcgtttacaaatacacgtttcaatcggtttttgaacatcacaatacctcctgataaaaaagattgttgattgatttcactctgaatgtttcagctgtcattctccaataacgtcgtgaaacgctgaaacgcctgaattccttcgggtgtcattttaaaaacgcctgcatcggtcagcgcgcgtaaaaatacattcgcggtttctttttgtaaaacagcggctgcattttccggtgtcacgtctttatccgctttgatgttttcagcccacggaagatgaatgtctttgatgtcatgaggttcattcagtaaatactttttcacttctgccagctcatctttcaggcggggaggtaaaacggcgagccccatcacttcaatcagaccgatattttcttttttgatgtgatggacatcctgatgcgggtgaaaaatgccatccggataatcttcggaggtgcggttgtttctgagagcgagatcgatttcaaaatccgttcccctgcgtctggcaatcggggtgacggtattatggggttcatttgtcttcgcgatgatgctgacggtttcgtctgaatattcccgccacttttcaaaaacatacgcagcggcatctgtcagcaaatccggatcttttgcgcgaaggcggatcactgataccggccactttacggcttcggcctgaacgtctggaaaatgacgcatatgaaaagggtagagggaacccgcttttgccatcggaaactcatgggcgccgccttgataatgatcgtgagaaagaatggaacctcctacgatcggcaagtctgcgtttgatcccgcgaaataatgcgggaagatttccgtaatggccagaagccttctgaagctgtcgcggctgatgttcatcggcttgtgcacgcttgaaagaaaaatggcatgctcgctgtaatacgcataaggagagtattgaaacccccactgttctcccgctaagtcaagcctgatgatgcggtggtttgaacgggcggggtgatgcggtgttccggcatacccctcgttttccatacagagcaggcatgtcggataccggttttccggactgttttttaccgcggcgatgtctttagggtctttttccggttttgatagattaatggtgatgtccaattctccaaaaggtgttggtgagcggtacacgatattttttcgaatggcccgcgtcttaatatagtcgttgttttggctcagtcggtaaaaataatctgttgcttttttcgggcaatctgataacaattcgctgaaggcggcattgatcagagaaggggccggtgtgatcacgtccatgatcctgcttcccagcatgtctctttcagccggcgtatcgtttatgattgaccgttttaccgcgtctttcaccatttcgtccacatagtgaagcctgttttgtttcttgatatgtttcggttctgcataatccgtcagtccgagcagatcgagaagtctgtttcttgtgtaaatcacatctgtttcatttatgtcgcctaagacagtgctttctttcagaaaccctgccactgattcaaaaacgtcaatgaccgccgcctccatttcatttgtccttgtatccgttaggatgatgccgatgccaattccatgctgacgcaatgatttccgatatgtccgtttgtttcggattccagccgagaatgttccgcgctttatcgctggaagcgatgagggcgcttggatcaccgggtcttcttgcggccgctcttacttttatgtctctttcggtcacttgccgggccgcttccgccatttctgatacggaaaacccgctgcttgatcctaaattgaaaatgccgctgtctccgccgttttgcaaatattccagagcgagaatatgggcatcgattaaatcggaaacatgaacataatcgcgaatgcacgtgccgtcttttgtatcatagtcagtgccgaatatcaaaacctcctcgcgctgaccgagcgcggtttgtaaaaggatagggataaggtgggtttccggatgatgatcttctccgatggaaccgtccgttttcgcgccggcaacgttaaaataccgaagcgagacatattttatgccgcaggcggtttcacaccacttcagcattttttctgccatgagttttgattccccgtatgcgctttccggcttttccggcatgtcttctgtgatgggcgctttttcaggttcgccgtaaacagcggcggatgaagaaaacacaatgtgtttcaccccgaattcctgcatgacctccagcgtaatttgcgtaccgtacacattattattgaaatatgaaagagggtctttcattgattcgccgacaagggattgagcggcaaaatgaagaacgcctgttacgttctccttcgcaaacacagagcgaagaaacggtttgtcacggatatctccatggtaaaaaacggctttttcatgaacggctttccggtggcctgtctggagattatccacagctatcgtttcaaatcctttgtttactaattgatcaaccgcatgagaaccgatatagccggctccgccgagaacgagaatcgccatgatttatttttccctccattcagccgcgccatcgcttatatccgcgatgtagaaagaagcttcaagacctgtcctgctgcggtagtgagatgaaacggcctggataaagccggcggtttcttcactttccacaatggctatggcgcagccgccgaaccccgcgcccgtcatccgcgctccgagtgctccttctttccaggctgcttcagccagcgcgtctaattcgtcaccggtcacttcataatcatcgcgtaacgaacggtgggacgcattcatcagctccccgaacgttttcaaatcattcgatttgagagcttccgcggctgagagggtccgctcgttttcattgaccgcgtgccgggctcttttacgcaaagtttcacgggagagaaggggttcgagtttgttgaattcttctcccgtcaattccgcaagtgatgcgatattccgatattgccgcagttccgtgagagccgcgtcgcattcgctgcggcgttcattatactttgaagccgccagctcccggcgcttgttcgtattcataatgacgattttatatccgttaaaagcagccggaatcatttcgtgctcaagcttatcgcagtttaatagaatggccatgttctttttgcctttttgcactgcgaattgatccataatccctgaattcacgccgataaattcattttcgactctttttccgataagcgccagttcagtatcggaaacatccaggctgaataactttcttaaaatggaaccggtcaacatttcaatggaagcagaggagcttaaaccggctccgtttggaatcgtaccgtgaaaaagaatatccattccgctgtctatttggccgccggcttcaagaagataatggatcatccccttcggataattggcccagccgtcttcttttttgtatgctgtggcggaaagatcaaggcagacaatgccgctgtcaggaaagttttctgagtataaccggatctggtgatcttcgcgttttgcgcatacggcatatgttccgatcgtgatcgcgcagggaagaacgtgaccgcctatataatccgtatgttccccgatcaggttgatccggccgggtgcgaaaaacagttctccgttacttctcttgaaaatgtcttcgaatctcgatttcaaaagtttggcatccatgataaacctccgattctattttggggtatgctccagtatgaactgaatggctttttgtgaatttctggtgaggctgatatattccgctcctttcgttgcgatgagtttcacatgcaggcggtccgcatcttctttaatgtcatcataataagagccgacttgcggagccaaaatgatcatatcgaagtctttcatgatgtcgtaatgggatccgtaggcgcctgctgaggcggtgatcggcacgttgtattcttcggctccttctgtcagtgcgttcgcaagcatggcgctcgttcccgctccggcgcacagcactaacacattggtgccgtgttccaaggcggatgaggattcctgaagatttgtgctgatgacggaagccgcgtcttctgaggcgccggccatggcgggctgtaatgtttgcagcgcggtttcaggctcggtgtgttgggcttcttccgccgctaatactttgtcataagctttacagaatggcaggtatatcaggaaatcgacaatgattaatacagccgtcagaacaaaagccgagagccccatgccggttccgagaatcaagccggcgggcgccggggtggcccacggaagaacatacataaaactgttcattccgatgacatccacgaaaaatttaaacagacagacattcaccatcggcgttacaacaaacggaatgaaaaaataaggatttaaaatgatcggcgcagcaaagagaagaggttcgtttactgcgaaagacaccggaactgcggatgcttttccgactgctttcaattgcttggatttcgcgaaaagaagaaagataaacggaacaacaagggttgcgccggtccctcccattgtgcccacgaagttcccgagtccgacggtcagcacgttggacgcctgctcaccggcattatgaagctgaaggttcgcctccacatttgcgtaaataatagctgcgatggccggctctacaatagaaggcccgtgaacgccgacaaaccagaacagcgccatcattccccaaatgacacaaatcccgagataaccgtctgcggcggtaaaaaacggcgataagagagaggagagagcctccgcaaacgatacattaagcgtattcctgatcaataaatcaacgctcaccatggccaaaacggaaaaagcgaacggaaaaacatctttaaatgtttgtgaaatggtacccggcacttctttaggcattttaatcgtaatatttttcagcacgcagaatctgtaaacgttcaccgttatgaaagcggatacaaaagcggctaaaagaccttttgtgccgagatattccgtggagaatccgccgtcgatttgagtgacgcttaaaatgagaaacccgacgactgaagcaagcatcgctgaaacggggttgatccctttgtttttcggcatttttcggtttattgattcactcaggcacttcgcacttgttgccgcaacgatcaggccgagggtgcccattgaatagttataaactttccaaagccattcagaaacacttttaggccaagtgaaacccaacacttccggcacagcggcggtgaggatgaaaatgctggcgaataaaataaccggcatggcagttaagaagccgtcgcggatcgcacctaaataaatgtttcttgagattttttcaaaaaacggttttcccttttcgaattgcttgatgataccgttcatttttccactccttatcggcggcttcggtagagttctataaaatcctgaataagatcacggagcaaaagggttgtcatcaagtggtcctgaccgtgaacgaaaataaaccctaaatccatgtccttgccgtcagcttcttcagctaacattttcgtttgcgcattgtgggcgagggttaaattttcatcggcgcttttcaatgctgcttccgtgttttcgaagtttccgccacggacttctttcaggactttcaataaagtgcttctggcgtcgccggcataggcgacgatttcaaaaccgagcatctgcaattcttcctttgtcatgaaaaaacctcctaaagacggcacacatgatgaaaagagactcttttcaccatgtatgatcgttaaatgattgtttttgtttcacttacaagtttgtaccagtaggccgattctttcggataccgtttttgggtgtcgaagtcgacgtaaaaaagaccgtaacgtttgttgtagccgttggtccatgaaaataaatccattaaggaccataagaagtacccctttacattgactccgtcggtaatcgctttactgacggcttctaaatatacttttaagtagtcgatccttgccttatccataatgatgccgtcttcaaactcatctttatagcccatgccgttttcggtaatgtaaattttgttatattgcggatagtcccgtttgatgcgcatcagcatgtcatacatgccttcagggtaaatgagccagtcccaatcggtccgcttcaggccttctttgtaaattcgttcgccgattccttttactttatagaccgaagtgcccttatcgcccgttccgttatggtgaataacggtttctccgtcgtacgctttgacgaaatggcattgataatgattgatgccgagataatcattgcgcgtcgaggcttttttcatcacgtcaaagtcactgtctgaaaactcgtatgaagcgccgtttgcctcacagatttcatccagagcacgcatggtttcctcagaataatagccgaggtaggtggcatcgaggaggaatctcactgataacgcgtcatccagaaaacaggcgtggcggtcttcttctgtgccgctggcgggatattttgtttccaatgaatggacgaccccgatttctcccggataaccgccgtctttaaaaagattgacggtcatcgcatgcgctaccatcatgtgatggaggcattgaatgacttttgtgatatcacttttaatagatggcgggaaaaccccgagtaaatactggttggtggctgtgggataaatttcgttaaacgtgctccaatatctgatttcgctgaattctttaaagcaaaactccgcatagctgacgaacgcttctattgcagcgcggttgaggaaatctccctgatcaaataatcctttcggtgtatcgaaatgatgcagcgtgacaaaaggggtgacgttgcgtttatggcactctgagaaaatacgatgatagtagtcaacaccttcctgattgattttgcccgtgccgtcagggaaaattctcgtccaggctatagaaaggcggatgccgtttattccgaatttttcacatagtttaatatcttccggaaactggcggtaaaaatcacttgccggatcagggctgaatcttccctgtttttcaagaaattcatcccaggccacaggccctttgccgccttcttttgtggcgccttccgcttgatatgccgcagtcgctccgccgaaaataaagtcatgaggtaatttgagcattactgaatcctccttcgccaatgtgtgaattgtagtttattaatgtttgtaattgttatcttttgtttaatagtaaacgcatacatttttgttgtcaatagcttcataaagaaataacatctgtatttataggggttatgtaagtttgtcgttgttttttatgttgattgtgttgtttattagtgtttgtttttgttgaccggattgccgcagtatgttagattgtgtgtaaagttgaggggatgattgaacatgttaaaaaaagagcggcttttaaaaatcatcgatattgtaaactcgcgggggtttattacggtgagtgatattatcgatgaactggaagtttctgatatgacagtgagaagagatctggacgagctggataaggccggaaaaatcgtacgtattcacggaggcgcacagagcatatcttattccattgatcacgaattatcgcataatgaaaaactgggtgttcaaatggaggagaaggggaagatcgcggaactcgcagcttcctatgtaaatgacggcgataccgtttttttagggcccggcacgacgattgaacttttagcgaaacacctgctgcataagcgaatcaggattatcacaaacaactatcccgtatttgatattttgaaacatggcgacactgcggataccatcctgattggcggcgacttccgaaaaaataccggtgccttcgtcggccccatcgtgaacggcaatctgcagaaattcaattttacgaaggctttcatcagcgccaacggcatacataatgatgagatttcttcttacagcattgaagaaggggaagctcaccaaatcgcgctgaataattcgcggacgaaatttttgctggcggataataaaaaattcaaccgggaagatttttacgtgttctataacttgcacgatatggactatctgattacggatgataaagtcatgaaagatgttcaaattcattacgagcaatatgtagatgtcaaaatcgcaaaaaaataaaaaaggcgggcggttcgatgaaaggggttatttttgatttcaacggcacgatgtttcaagattcgcatctgcacgaaaaagcatggtttttcatggtgaaaaaatacgcaccgaaaaccatttctgatgaagacattttcgttaacattcacgggagaacaaacagtgaaatcctgacgtattttatttccggcgatttaacaaatgaagaaatcaagaagctgtcttttgaaaaagaagcctactacagagaattatgccttgaaaacaaagacgagttaaagctgacgaagggactgaccggcgtattgaaccatctgaaaaaatcggaaacaccgatgaccatcgccacggctacggtaaaggaaaatgtcgagttttactttgacgtctttcatttggatcagtggtttgattttgacaaagtcacgtttgatgacgggagcttccccggaaaaccggcgccggatatttttctcatcgcatcggaaaaattaggcctcaaacctgaagaatgcttagtcattgaagatgccttttcagggctcacagcggcaaaaaaagcaggtgcgggcaagattatggccattgacccgctcggaaaaaaccgcgcgctatttgaagaaaaacagctggcgggtgacgggatactgacagatttcacctcgttttttgaggtgattgccggacattctgtttgagagatcagccggttttcatgcgggtatggctgtacaggctgcagactccgttcgcaacacgggatgtttttgtgtttggcgcttctcgtgaagaaaggagtttcgctttttattcggagtcacttttaagacagggatatccctgtctttttaattcctcgtatttcttccaaagaagcgccaaggtgcctattgctgactgtttatatgtttcacgataaaatcctgagcatacaagaaaaccagccatcctgtaagtccaagccctgatgcggcaatgaaagacagtgaatggcgaagggcgatgccgataatgaccagcataatgactgtagaggggatgccggaagccacgctgaatgcaaaatgacttaatgtctccttcgtttcgccttggatgtacagccaaatcatgctcagcatactgacaattggtaaagccgctataatacctccataactcgggcttcttcttgatatttcagtgataaccccaataatagcagcggagacaatgattttaacgatcgtaaacatcttcagcacgctccttcatcaaacagaatgcttttaagacaagtgttcgttcttcattattcatgttgtcaaaaagaagctgtttaagcttttcttcatcaagaccggaatgccggtaaaggacatccgcccccaaactggtaagttttaaaatgactttcctctcatcttcaacacttctggttttataaacatactttttcttcagtaaccgctttatatgttccgaagcggtattatgcgatacttgaatcgctccggcaatgtcttttattccgactgccttctctttttgaatgacttgcagaatccgtacaccttggtgagtgattttttcatggtgctgataacggagccgatagtaaatatctgtccagaggtcatttaatcgtataatttcgttagacatcataagccaccttttatcgtttattaagattatatcttatattacgatatattttcgcggattgaaagcaatttttgagcatgagggagcggcattcgttctgtttttagaagattggaagagacaagcggccgcagcttcaacgaataaacttatttaatatactctcaataagtcattttccttattttaagaaacggcagcttaataccttccgcatataaataagagcactgacaatatgataaagaaccaaagtatatattcaaatgcagtttttttcagcagggcagtcctgtgctgattgaaaaagatacgggggataaaaagcgggtaagaagataaggaaaggagagagacggatggaacttgattttgtgattcgtctggcggttgcgggtctgcttggggctcttattggattggagagagaattcagggcgaaggaagccggtttgaggacgcattttttagtggccgtcggcagcgccttgatgatgatcgtttccaaatacggcttttttgatttgttatccaacagccatacgtcctttgatccgagccgggtggcggcgcaggtcgtcagcggtgtcggatttttaggagccggcacgattattttgcagcggcatgtcgtgcgggggcttacgacggcagcggggatttgggctacgtcggggatcgggctaacgatcggggcaggtatgtatgtcatcggcatcagcggcacgattttggcgttaatcgggcttgaactgttaaattttctgtttaaaccggcggcgcattctttgtctgtcagtttcaggattgaagagaaagccgtcatgcatgatattttaacttctcttgaggaaaaaggaattctgattacgtcctatgaattgaataaggcggtgcttgaagtgaagggaagggtgaaaagcaaaagcgggaaagcagcggtaatggagaaagttcaagccctcccgtatatcctgtcggtcaaagttgaatagcagacaggggaagcctcctgtctgcagtcatttcttttcaaacattaataccaaggatagaacgggatatacggccgcggatagtatgggtatggtctggggtaataataaggcggccgcggatagtatggatatggtctggggtaataataaggcggccgcggataatgatatggcacccgttcgtggctctcggctgtgtattcatgatcgaaaggatcgtacaagaggaaaacctccttttcaaatgttggttccgtttaccttattcctgtatgcccggtacggtgtatgtacaatgggcaaaaaaaagacgccggttatcatccggcatctttttttacactttcacatcaattgaatggccggcagtcgggtgctgggacggcagcattttcactgtttcttccgccgcagcctgtgcatgctgcatgaccgtttttgttaaagcgatatttacattctgcgccagagatgcctgatgcattgcgattgataacgcagggatatccatagcttccacctccttatcccttcatatcggcggcgtgctccgattatgaagagggctggcggtttctttttacggcccattctaaaagtgcggcagcgcaaaccccgagggtataggcgaaaatgtcactccagacaaattgccagccgaggatcagcccgccgagcgtgctgcttctgatcgcgtcaatccacggcgcgtgatacagctggctgcattcaatcagaaagcaaaacgagaggctcaaaattgcggctgtttccgtccggatgtgccgaaacaaaagcccgaatcctgtaaaaatcatggccgcccacagggcatctcctaaataagcgtttataatgccgggcaatagggcggtgatgtatgcggttctggacagcaaaccgagggcgatgataaaaacggtacatattccgtatgtcaatggatgtctattcacttcacactgttcccctttttttgtactcccatgtattgtaaggaacaacggagaagctgtctatgaaaaaaaacggcccgggaggccgctttttttgcgttatctggcttttaggttgacatgatctgctttttgatcactgccgatgacgaagcggagctcatactgccccgtatggtagacgtaatctgtttcacccgtttttggcactgtcaggattttgtcagcgctgccgatttgtttgcttaagacgtcaggtgtgacgctgccgaggtttaagcgccgctcgacccccgttccaaaatagcgtatttccgagatttttccgtttttatgataggaaaatccataaccggggtttcccatgttccagctgtataaatcaaatggattgcggctgtctgctttttgttccggctcgccgattttattgtaaacgtcctgtcttgtgctttggttgatttccaggcctttcacattttgcggcatttcccctttaaatgccgattggtaaaggctgttcaccagttcttgtgcacgctggttttccgtttttgaagcggctgcggcatggacgggctgtgtatccgaaaatgcttctgctccgaaagcgcatcccgtgagcatcactgccgataatcccgtgacgagtgtttttttcttcaacatgtgaacgcctcctttttaccgctcatacccgtatgtttcctgagataaaccagatgttttagtgaaaggccggttgggaatcatagaggatgtatagaggggtacagaaaggggaaaagaaaatggctgatacaaagaaagttacaatcaatggggttgaaatggaagcgccggacggtcaaaccgttttgcagcttttgaacaatagttcaattgacgtgccgcacgtgtgttatcacccgagtctcgggccgattgaaacgtgcgatacctgtatcgtcaatgttaacggggaactggtgcgttcgtgttccgcgcaaataaaggacggagatgtcatcgatacgctttcgtccgatgtaaaaaaagcgcaggttatcagcatggacaacattttgcacaaccatgaattgtactgtacggtctgtgattacaacaatgggagctgcgaagtacataataccgtaaaggaaatgaaaatcaatcatcaaagcattccgttcgatcaaaaaccgtatcctaaagatgaatcaaatccgttttaccgatatgatcccgatcagtgcattttgtgcggacgctgcgtcgaagcctgtcaggacgtacaggtaaccgaaacgttaagcattgattgggagcggaaacgcccgcgggtcatttgggatcaggatgtgccgatcaatgaatcatcatgtgtttcctgcggacattgttcgacggtatgtccgtgcaatgccatgatggaaaaaggcatggaaggcgaagctgggtatttaacaggcattaaccaagagacgcttcggccgatgattgacatcacaaaaggcgtcgaaaccggatacggatcaattttagccatatcggatatggaatcggccatgcgggatgaaagaatcaagaaaacgaaaaccgtatgcacatactgcggtgtcggctgcagttttgatatatggacgaaaggaagagacattttaaaggtcgagcctcaggctgaggcgcccgcaaatggaatttcgacgtgtgtgaaagggaaattcggctgggatttcgtcaatagtgaaaagcgccttaccaaaccgcttatccgggaaggagactcgtttcgggaggcggaatgggatgaagcgctgcagctgatcgctgataaatttaccgatataaaagaacatttcggcccggacgcgcttgcttttatcacatcttccaagtgcacgaatgaagaatcatacgtgatgcagaagcttgcaagagccgttatcggaacaaataatgtcgacaactgctcacgctactgccagtctcccgccacggccggattgttcagaacggtcggatacggcggcgattcaggatcaattacagatatagaaaaagctgagcttgtgctgattatcggttcaaatacatctgagtctcaccccgtcctgtccacacgcattaaacgttctcataagctgcacgggcagaagctcgtcgttgctgacttgcgaaaacatgaaatggccgagcgctccgacgtgtttttccagccgcgtgccggatcagatattgtctggctgaatgccgtatcgaaatatctgcttgatcacgatttggcggatactgcatttctgaaggagagagtgaacggattagatgaattcgtgaaaagccttgaaccttatacgatggaatatgcggaaaaacataccggtgtggacaaggataccttaattaaagtggcccggatgattcatgaagccaaaagtgtatgcgcactgtgggcgatgggggtcacccagcatatcggaggaagtgatacgagcacggccatttccaacatgcttcttgtgaccggaaattacggaaagcccggcgcaggctcatatccgcttcggggccataataacgtgcagggagccagtgatttcggcagtatgcctgacagcttccccggctatgaaaaagtaacggatgaaaaagcccgcaaaaagtatgaacagggctggggaacagacctgccgaaagaaatcggaatgacaaatcatgaaatgatcgagggcatccactcgggaaaactgaagtgtatgtatgtaaaaggggaagaaatggggcttgtcgactccaatatcaaccatgttcatgccgcctttgaaaagcttgatttcttcgttgtgcaggatatttttctctcgcggacggccgagttcgccgatgtggtgctcccggcaagcccgagccttgaaaaagaaggaacgtttacgaatacggaacggagggtgcagcgcctttacgaagtgtttgaaccgctgggcgattcaaagcctgattggcagatcattacggacatcgccaaccggctgggcgctgattggcgctatgaacatccggcagacattatggaagaagcggcaatgctttcgccgctctacgcaggcgtcacttacgaacgtctcgaaggctacaattcactgcaatggccggttgcagcggacggaaccgattcaccgcttttatttacggacaagttcccgttttcagacggcaaagcgattctatatcccgttcagtggaccgagccgaaagaatttggtgaagaatatgatatccatgtgaataacgggcggctgctcgagcattttcacgaagggaatctgacttaccgatcaaaaggaatatccgaaaaaacaccgagtgtgttccttgaggtctctcccgaactcgccgaagaaagagggctggaagacggaacgcttgtccgtctgacatcaccgtacggaaatgtgaaagtcaaatgcgtcatcacagacagggtaaaaggcaaacaagtctatctcccgatgaacgattcaaaagacgccgccattaaccttttgacaagcagctatgcggataaggataccgatacaccggcttataaagaaacatcagcgaagatggagattttgaaaaaagaaggcgttaatccgcttccgaaaatcaatttccgttacggaaacccgcagccgcagatcggtgtccgggttgatcggaaatgggcgcgtcaagattatgtatttccgggagacgccgtaaaaagggggaaacagcaaaatggctaaagcaatcagcggcatccgaaaacagatcgtcacagaagaagacaaacgaaaaaaggacttagaagagatcgagacggctcttttacgaaataaagacgcgattttggaatctttgcacattcttcagcacatgaacgagcgcggcgttttggcgcttctgcgcgggctcttcggccaaggagacaaagtgatggatattctggtgaagaaggcgaatacgccggaaacggccaatatgctgaaaaatctcctgctgttaagcggcgttctcggcatgctcgatgtaaaacagcttgagccgtttatcgttaaaatcaatgcgggcgtcacaaaggccgtcgaagaaaaagacagcggcaggaagacggggtattttgatatcgtccgcgctttaaaagacccggaaatcaacaaggccgtcactctgctgttttcttttctgaaaggcatgggcgctgatacggacgatatggaaagaaatacgcagcctcctgaagaccaaaagcagcaccagaaaccgcagacgaatgagtgagcatttctcccgagcctggccgaaggctcgggttttttgtgcacttctgctgttttcttgggagaaatttcacctccggattcatgacttttgttgtgttatgttaatagttaaggttatgaatagaaaaaaattgaaaatatgtgctaggataaaattcaaggtacgtcaactattcaaatatgaaacaatcaggagtgatgtaacatgagtaagctgaggagcacgagacaagccatccaaagaaccctgatgaaaggaaaaaacggcctggacgtatacaacccttttccttggtatgaaaaaatgagacgggaaagccctatatactttgatgaagagacgaaggtttggagtgtgtttttatacgatgatgtcaaaaaagtcatcagtgataaagagacgttctcaagccgcatgactgatgtgaaaagctcgattgcaaagtccatgctgaatatggacccgccgaaacatacccaaatcagatctgccgtcaatcgcgctttcactccccgcgtcttgaaggaatgggggccgagaattaaagacattaccgatcatctcctgaaacaggcaaagaacaaagggcggattgatatcgttaaagatctctcttaccctttgccggtcatggtgatttcagaattattaggcgttccgtccgaacgtatggatcagtttaaaaaatggtcggatattctcgtcagcatgccgaaagatgcgagtcctgaagcggcggagaaaaatcagcaggaacgtgaccaatgtgaggcggagctggcggcgttttttgcgggaataatagaaagcaaacgaaaacagcccggccaagatattatttctattttgataaaagaggaagaagagggagagaagctcacgccagaagatctgatcccgttttgcaatctgcttttagtggcgggaaatgaaacaacgactaatctcatttcaaatgcggtttacagcatattagagacgcccggcctttatgaagagctgagacaggacccttctctcatcgcgcaaacggtggaagaaacgctgcgttttcgcgctcccgctccgtttgtcagaaggacggtccggcacgacactgagctgcgcggacgccgcttgaaaagcggagagatcgttctctgctatgttgcatctgccaaccgtgatgaaaacaaatttgagaaggcgggcgtatttgatattcatcgccaatcgaatccgcacctttccttcggattcggcgtacacttctgcttaggcgctccgcttgccagacttgaagcggaagccgcgctgaaaggaattgtaaaaaccttttcacaccttgagcccgtccggattgagccgatccgaaacagtgtcatgtacgggctggagtctttagaagcggagataaacgaaaatgaaggagaagaaaaaagatgagaaaaacacacatcgccattattaatgtggccgctcacggtcatgtcaatcccacgctgcctgtggccgaggaacttgtcaatcgcgggtataaagtgacattcgctacgactgaggaatttgaagcttccgttgccaaaacgggtgctattcccgttttataccgcacaagcataaaggcggacccgaagacgataaaagaacgggtaaataaaagtgacgcgtttgtaatgtttctggaagaagcggttgaagtgcttccgcagctggaagagctgtacaaagacgaccttcctgacatcgtcctgtttgattttttagcgcttgccggaaaattgtttgcggataatggcggcatcccggccgtaaagttctgcccaagctatgcaatgaatgagtattttcaattaggaagagacgaagaaacgatggaagcggccaaacaggcgatagaagaatatcaggagaaaattgaaaatgaacaagtgaaacggatgacaatggaagaatttttcatgcctgaaaaattgaatatcgtctttatgccaagggcctttcagccgaaacaggaaacctttgatgaacgattctgttttgcgggtccgtctcttggagaacgcacaaatacgggaagtctggaaattgatgcagccgatgaccgtccgcttatgctcatctcactgggaacggcgtttaacgcctggcctgaattttaccggatgtgtattgacgcgtttcgggactcggactggcgggttattatgtcagtcggcacaacaattgatccggaaagtttttcggatgtgcccgatcactttatcatccgccagcacgttccgcagcttgatgtgctggagaaagcaaagctgttcgtatctcacggcgggatgaacagtacaatggaggcgatgaatgcgggtgttccgctcgttgtcgttccgcaaatgcacgaacaagaggttaccgcaaagcgtgtggatgaattggggcttggcgtgcatctgccgccgaaagaagtcactgtggcccgtctgcaaaaagacgttcagaacgtatacagcgataaaaacatcctcagccgcgtgaaaagcatgcagcagaaaataaaagaaaccggcggccccaaacaggctgtttgcgccattgaagaatttttggaaaaggcgtccgtcgaaaattgattaggaaaacaggcagcaccggacggctgcctgttttgttatatatttttcttcatgccgcatctccggcattccctcaaaaattttccacccttcactgaacttttaaacagcgtgtaatcgcaattgtcacatcggccgctgtgaacatcaggatattcattgaactcataaatgaccgaagtatcgtatccttttgtctcgaactctttttttgtttccatgattgaaagtccctccgcgaatcaaatcgttctgcccggttaatgatacagcaactgcacgggggattcaacgggagcatagcttgattttcccggctgattgcgtaacaataatagaaataaatgacggcctgccatagggcgcccggcatctgaagggaagaagaaaacagcgatgggaaaaggattgaacgggaaacggattgccatcggcggttcgcggaaaacagaagagatcacaaaattaatagaaaagcagggcggaacggcagtcatccgttccctccaaggaaccgtatacctggcggaggatcaaatggaacccgacgtaagaacatttgccgagcaaaaagctgactgggtgatattcaccacaggcatcggtacggaaacgttattgtcggtatcggaaaaaatcggtctgaaagaagaatttttagcggccgttcatgaagcgaaaatcggctgcagaggctataaaacatatgcggccttaaaaaagctcggcatcacgccgcatgcctcagatgaagacggtacaacaagagggctgatccgctccttggaacgatttgactttaaagataaaaaagtcatgatacagcttcatggcgagaaagcgccggttttaacggagttccttgagaaaaacggagcgaaggtattccctgttctgccgtatcagcatattccgcctgaaagggagacggtcgataaactgctgggagagctgttaaacggagaggtcgatgccgtatgttttacgacagccattcaagtgcgctctctctttgattatgcaaaagaaaaaggatccgcaaaagaattgcagcaggcattcgaaaaacacgtgcttgccgccgcagtcggtaaagtgacggctgaagcgatccgggatgaaggggtaaagagggtccttgctccggacattgagcggatgggagcgatgattattgaattatcccgttactatgaatctctgaccttgtcatgaaccaccattcagcagggaaaaagcttacgcttccctgctgaatttttttaattgccagtgttccgtgaaaagggaaggatatgtcaaggcgctgagtatgatacatgtaagaagagcggaggccatcgttgtaaaaacgatcagcagctgaaagcgcaccgcctgtatcggatcagcccccgctaaaatctgccccgtcatcatgccgggaagctgaacgagacccaatgttttctggctttcaagcgtcgggatcatactgagcttcatactggacgtcaatatctgccggacggcctgcttaggcgttcctccgagagagagaatcagctggatttcttctttccgcaggtctgcttccgaactgagccggcttaaaaacaggcttgagagcaccatggagtttccgatgaccatgccgcttatcggaatgacatatcttgaagtgaacggaatgatgtgaagggtcagtaaaagtccctgcgtcacggtttccgcgattgccagtgtcagaaaaacgcgccaaaatgagccgatccgcatttttttccgtttggcgacattgtgcgaagcggccgtgagcatgagaagcaccattaatatgataaatatcgggtgatcaccgcgaaaaatcagcgacagcacatagccgatgatgagaagctgaatgacggccctgacggttgcgacgatcatatccttttcgacgccggctttaaaagatttagacaggaataaagcgataatgacaaatatacttgttagtaacagtgaaagatcattcatatcagcacccgctcccttgtaaaagcgcccgggccttttcgtgtttcggttccttaaagaacgttttcgtttccgcggtctctaaaagccgtccctcagccataaaccataccgtatcggataatcgttccgcttgttcaaggttatgggtgatccacaggattgtcagctgtttttgccgatggagtttcgtaatcagtttctcaatggtgagaacggatgaggggtcgagcgccgaggtgatttcatccagcagcaggatggaaggcagtccggcgagagttcgcgctaatgagagcttctgccgctgacctccggataattcttttgcattccgatccagaagcccgcgcggaaggtctgtaaaatctgcgagctcttcaggggtatagtgctgcgccccgtggagtttttctgcgagcagaaggttgtcccgcaccgtgccctccgtgacgggagctgattgaaatgcaaggcccgcggtttttctgagctccctgatatcccagcgccttatttcttttccgaatacaagcacttccccttcatcaggtgtattcatcagattgcaaagtgacagcaatgtgctttttcccgcgccggaaggccctatcaaggccgtgatagaacctttttgaatatgtccggttacacggctcaggacatcaaaggacgtattgttttgttcaaggcgtttgccggctgacagaaaagatattgccggaatttcttctttcatttgggatgacacctttcgtaaaaaatcaggaaccagtgagattggctgacgtttgctccgccgttttctggtctgtctgccgggaagcgaatgtatgcatgaccattcccccaataataatgaacagtccggcaaatgaaagaagtgacggaaacgctgcggataaaaagacgatttcgccgatcagtgcaaaaagaacctctccggactgtgtcgcttcaacagcagcgagcttctgcggctcattcctcaccatatcggtggcgcggaaaaataatactgttgcgataacgcccgagctgagtgcgacgataaaggattggaatgtctgtcccattgagggaagcccgtctctatgccagccgaaagcggcgatcaaaagccaaaacggaaggcttgcgagcgtcatgccgagcacccgctgaaacgtatcgagttttccgccgtattgttccagcattttgcggttgccgagcggataggcaaacgccgcgatgacgaccggcgccacgctgaatagtatcgtgcggcccgacagagaacccgcatgctgaagctgaatcagcccggctccgatcaggatgatgacggaagtaaccagcgaaatcagcgggatcttttgtctgacggaaaccgggcccgccggtgaattttttgtttcatagaaaaacggcgacagaagcacacccgcgacaattgtaatctgccacgtgccggcgatcagccagccaggcccatatgccgccgcaaacgtaatcggggcataaaaaagcacgaacccggtaaaactccacttcagccaaaaaaacggttttttccggatttcatgccagagcggcgcccattttcctttcgcataaacgatcaaaaataaaaacggaatcataaaaagaaaacgcagggaagagctccacatccagcttccgccggaaagctccatcgccctgtttaaaataaatgtgactgcaaaaaacagagatgccaatattccgatcacgatggctttcattaaatccctcattttgacacatatttttttatactatactattcaccggcaggcttcgcaatggaatatgagaaaatagcgttttaataaatgatgaatgggaaacagacatatacggaggtgaacacaatgcagaaagaggatattcaagtgctttatttcgaagatgacggccgcattccgaataacccgaatcttccgcttgttatttataaagcggtatttaatgaagaaacggtacagaaagcagagtccgtcctccgccggcacgattggtctaacagctggacgggcggagtatttccgtatcatcattttcacagcaccacgcacgaagttcttgtcgcggtaaaaggaaccgcggttttgaggttcggcggggaacaaggggcggacgccgttcttcaaacgggagacgcagcggtcattccggccggcaccggacataaaaaactgtcgggcagttctgattttaccgtgatcggagcttatccgggcggccggcagtacgatacaaaaacggagaaaaatgatagaacttcagaagaaatcagccgtgtcccgctcccggaatgtgacccctttacgggaaaatcgggcccgcttttaaaattgtgggaaaaatgacaggggaaaagcggacggtctgtaaaaaaatagcctaaaagaaacgttattacacccccgccatataaataatttcataaacgaaacaattcacgttcaaattttgttcaaaaagtgttattatataagagtaaatcaaattggggttttttatgtttgctattttcagagaggaaaaagaaattttgacttattcaattgtttttgttgatataaaaataatactggatatggcaaagtgaaaaactgggtagtaaacatttatttttgtaaatgattgtgcatgaattcacaatcttgctttttcatgcttttctgcatgaagggggaaaggctaccctttccaaaaaaatcagcatactgcttatagtaaaggagaatcggatatgccagaaacaatcgatcaaacaaatgcatctgtcagccaaggccaacgcgatcttattgatcagctgctaaaacctgaagttcaagaatcactgactgttttagtggatcagcttccaaaactgactgagttagtaaatattttaacgaagtcttatgattttgcacagtctgtagcgacagacgaagtattgaagagcgatacagtgggtgcgcttacagaaattcttgagccggtgaaagaaacagcgaaagaagttgcggctactgcgatcgaagcaaaagaccgcgcggatgcaagcaatgaaacgatcggacttttcggcctgctgcgcatgctgaaagatcctcaagctcaaaagctgttccgttttgctaacagctatcttgaaatcatgaacgaaaaacaaaaataatctcagattcaaattgatataaaggacggaggatatacgatgtcaaaacatattgtcattttaggcgctggttacggcggagttctttctgctttaaccgttcgcaaacattacagtaaagatgaagcacgcgtaaccgttgtgaacaaatacccgactcaccaaatcattacggaactgcaccgccttgcagccggcaacgtgtctgaacaggctgttgctatgccgcttgaaaaacttctgaaaggaaaagacgtcgacattaaaatcgcagaagtcaattctttctcagttgataagaaagaagttgccctttctgacggttctaagctgacttatgacgcgcttgttgtcggacttggttctgttacggcttatttcggcattcctggacttgaagaaaacagcatggtgctgaaatctgctgctgatgccaacaaagtatacaaacacgtggaagaccgtgtgcgtgaatactctaaaacgaaaaacgaagctgatgcaacaatccttatcggcggcggcggcttaacaggcgtcgagcttgtcggtgagcttgctgacatcatgccgaaccttacgaaaaaatacggcgtagatccgaaagaaatcaaactgaaattagtagaagcaggtccgaaaattcttcctgttcttcctgatgaccttatcgaacgcgcgacaaaaagccttgaaaaacgcggcgttgagttcttaacaggtcttcctgttacaaatgttgaaggaaacgttattgatctgaaagacggttcaaaagtcgttgccaacacatttgtatggacaggcggcgtacaaggcaacccgttagtcggcgaatccggccttgaagtgaaccgcggccgtgcgacggttaacgatttcttacaatctacttctcacgaagatgtattcgttgtcggagacagcgctgtatactttgcgccggacggccgtccgtacccgccgacagcgcaaatcgcttggcagatgggtgaacttgtcggttacaacctgttcgcttacttagaaggaaaaacgcttgaaacattcaagcctgtaaactctggtacgcttgcaagccttggacgtaaagacgcggttgccatcatcggagcgaactctactccgctgaaaggccttccggcatctttaatgaaagaagcaagtaacgtacgttatttaacacatatcaaaggattattcagcctcgcttactaatccttaagatcacacagaagacattgccggacttttctcggcaatgtcttttttacatgaaaatgttaacggatacaattttctgaaaaataaaataaaaatgattgatatgtgagaaagaggaagctaaaataaaaaagaaccattttgttaacgttaacattttttaagagggaggatgagagtgtgaaagcttttatgggtgatgactttttactggatagtaaaacggccgtaaagctgtaccgggaatacgcagaaaacatgccgatcattgattatcactgtcacttaagcccaaaggaaatctatgaaaataaaaccttcgcaaccattacggaggcatggctttacggtgaccactacaagtggcggatcatgagggccaacggcattgaagagcgctgcattaccggaaacgcttcagatgaagagaagtttttcgcctgggcaaaaacggtgccgatggcgataggcaatccgctgtacagctggacgcatttagagctgcagcgctggttcggcatttatgacgtattgaatgaaaaaacggccgcggcaatttggaaaaaaacgaatgagctcctgcagggagacgggtttggcgcaagggatctcattctgaaatcaaatgtcaaagtcatttgcacaacggacgatcctgccgatgcgctgacataccatgaactgttaaaagaaagtgattttccggttcaagtgctgcccggatttcggcctgacaaaggactggacatcagcagcccgggttttgccgattgggtccggtcgctggagagcgcttccggaatggctgtcaccacctaccaatcgtatttggatgcattggaatcccgcatccgcttctttcacagtgccgggggaagagtgtcggatcacgcattagatcaaatggtttatgccgagacgaccgaagaggaagcggcccggatttttgccgccggattaagtggagagcatgtgtcttttgaagatgaaaagaaattcaaaacacggacgctgcaatatctttgcggtctttacgccgaactggactgggcgatgcagttccatattaacgcgttaagaaataccaatacaaataagttcagcagcctcggtcctgatacgggatatgactcgattaatgatgaacgtatcgcaaaaccgcttgcccggctgttagattccgccgaaaaaaagcggcaattgcctaaaacgattttgtattctctgaatccgaatgacaactatattatcgccagcatgatcaacagctttcaggatgggaaaacaccggggaaaattcaattcggcacagcctggtggttcaatgacacgaaagatggaatgcttcaacaaatgaaagcgttatcaaacacaggtctgttcagccgttttatcgggatgctgacggattcaagaagtttcctgtcatatccccgccatgaatacttcaggcggcttgtctgcacgctgatcggcggctgggcggaacaaggcgaagcgccctgcgatatggagcttttagggaggattgtcgagggaatttgttaccggaatgctgaggaatatttccgcttttaaaaaatggaatgaaagaggtggcctatgagtaatgtgcctgtcgtgacagcacctgccgcaaaagtgaaggagcataagctgagtctgaaagaaaaagtatcctatggtttcggagattttgggaacggatttatgtttgatctcgggcagatctatttgctgaagtttttcacagatgtcgcaggcattccggcagcgttcgccggcagtatttttttggtcagcaagctgtttgcggctttgactgatccgattgtcggctcggccattgactacagaaaaaagatcggaccccgggggaaattcaggccgtacttattattcggaagtattattcttgcggtcatgaccgtattgatttttgtgtcaccggacgtgagtgtcacctggaagcttgtgtacgcctatgcttcttacatgctgtggggggtcgcttattctttcgtcaatattccgtacggctccctcggtgcagccattacacaggatgcggaggacagaacggcgctttccgcattccgccagatcggctctctcggcgcgctgctcattacaagtgtcatcgtcatcccgattctcgttcattttgataacgttcacatcggctacccggcagttatgggaatgatggccgtaatcggaatcgcgggatttatgatctgctaccgaaactgcaaagaaagaattatcgtccgtgaagcgccgaaagaaaagctgtccgtcatgtcggttttcaaatgctttatcggcaacaaaccgcttctgactgtcgttttcatgacgattttctcaatatcggcatataacattaaatccgctatgcttgtttacttcgcccaatacaatctcaacaatgcggagctgatgtcctacatgagttttatcatcatcggttcttcatttttaggtgtgttgtttatgccgaaactcgtcaaacgcttcggaaaaaagcaaacagtgatgatcggttttgccgtcagcgccgcggctgatgcgctgaatttctgtctcccgtcaaatgtatatatctttacggcgttagcgagcattgcttttatcgggatcagcataccaaacggcattacgtgggcgcttgtgtcggacattattgattacggagagtggaagacgggtgaacggaaggaggcgacgacatattcgctttttaacttctccagaaaactcgcccaatctttatcaggttttctttcaggcatcgggctgagcgttatcggctatatcccgaatgcatctcagacaaaaggcacgttaatcgggattaaagggcttctgctgctgtacccggctttcgctttagcgtgcgccatgctgattatcggtttaatgtataaactgacggaccggcagcatgccgagctcgttcaggacttacatcatgcaaaacctcaactttagtgattttatggactgtccgttaatggtacaatagaaataaatgacagcatacagaaagaaaggaaaaacgatggtaaccataaaagatatcgcaaaactcgccaacgtatcccacacaaccgtatcccgggcacttaacggcagcccctacattaaagagcatacaaaacagaaaatattagagctcgcttcacagctgaattacacaccgaatgtaaatgcaaaaagccttgccatgcaaaagtcccatacgatcggactgttttttacaagcatcaccaacggaacctcacacagctttttttccgataccatcaaaggtgtaaaccgcacaatcagtgaggaatacaatttgttcgtccgcgcgattgacgatctgaaaagctttgaaaccattacgcccatgagatatgacggaatcattttaatgagccaaagcgacagtgataattcatttatttatcatatccgcgagaaaaacatcccgctcgtcgtgctgaaccgggacattgatgaccggagcatcacgaatatcctgtcaaacgataaagaaggctccagacaggcggtcgactgcctgatcgcaaacggacacagagatatcgcgatcattgagggaaaggaaggattcaggtcaacttctcagcggaaagaaggctatttgacatctttaattgatcattctatcccgattaagcatgaatacagtgtaaaaggccgctatgatatggaaagcggcagtcaggcgatggaaaaacttttggcgcttcaatcaccgcctacggctgttttttgttcaaacgatgatatggcgatcggggcgatgaataccattttcgccaaaggcctgaacgttccggaagatatatccgttatcgggtttgatgacatcggcatttctcaatacatgacaccgaggctttcgaccgtaaaacgcccggttgaaaaaatcagcatactcggcgcagagaagattttggcgcttatcaccgacccggatacggcggcggaaaaaatatacgaaaacaccgaggtgatgataagagactcaattaaaaaactcacataacagcccgtctgaatatccgggttttcgtacgggaaaatgttaacgtgtgcataaatgcagaaggaggcggacagcttgcggcagctgaataaaaagatgttggttgaatacattcaatatcctgaaaaagtccttcagttcggcgaaggcaactttttgcgggccttcgctgattggcagatcgatcaattgaatcaattgacggattttaacggaagcgtggtcgccgtacagccgagaggctctgagaaaataaaacgtttaaacgaacaggacggtttgtttacgctttttttgcaggggataaaggacggaaaaccggctgaagaacacacgatcgtcaaatccatcagccgcggcattgatcttttttctgactatgattcctttaaacggctggcagcacaagaggatcttcgttttatcatctccaatacgacagaagcgggaattacgtttgagaaaggcgaccggcttgaggatagacctcaaaaaacattccctgggaaattagcggcgttcctttatttccgctataaggcatttgcgggtgacgccgagaaagggtgcattgtgcttccatgtgaactggtcgaagaaaacggacggaaactgaaggcggccgtgcttcaatatgccgggctgtgggagctggagcctgattttactcaatggattcatgatgcgaacattttctgcaataccctcgtggatcggattgttccgggatttcctgttgataccgctgaagaacttaccgattttctcggatacgaagaccgtctgcttgtggtcggtgagcattattatttgtgggtgatagaagggccggaacagcttcagaatgagcttccttttgctgatgccgggctgaacgcactgatcacgtctgaccttacgccttacaggacaaaaaaggtgagaatcttaaacggcgctcatacggcattggcgccagtggctttattatacggactgcaaaccgtccgggaagcggctgagcacgaggtgacgggcagattcatcgaagagctgatcaatgaagaaatccttcccgtgctgcaaatggagggtgtcacccagtatgcggcagatgtgttacaccggtttaaaaacccttatatccaacattatctgcaaagcatcacccttaacgccgccgcaaaattcaaaacaagaaacctgccgacgctgaaggcttatatcgaacaggagggccggcttcctgagaggctggtattttcattcagcgccatgatctattcatactggaacgggccgaacaaaccggcagacggcgaggaggttctgaaccgttttcaaatggctcggtcccgttgcaaagatgatatgtttcaagcggcatttactatattaggagaagagcgactgtggggaaagaatctgaaccatcttccgggactgactgaacgaacggctttttttctctctgtcattcataagcgggggatgaagcatgcgttacatgaatgctgcggcaataaataagggggaagtgaaatgaaagaggtcataaaaatccataaaaacgataacgtgcttctcgctatgcgccattttaacaaaggggagcggctgcatacagacggactgacgattgaagtgaaggaccctgtaaagcgggggcataaaatcgcgctgcaaaccattgaagaaaacggcagcatcattaaatacggtttttcgatcgggcgtgcgacaaggcggatttcggccggcgagcatattcatacccataatctgcaaacaaatttatccgatgtgcaagaatacacgtattcaccgcgcttcgaggacaatccttttacaaatgagaaccggacatttcaaggctacaaaagagaaaatggtacatccggcgttcggaatgaactgtggatcgtgcctacagtcggctgcgtaaacggcgtcgctgagaaaatcctgcagcgcttcgtaaaagaggcgaaagacattgccccctttgacaatgtgctggttttaaaacaccaatacggctgctcccagcttggcgatgatcatgagaatacgaaacaaatgctgataaacgccatccgtcatccaaatgcgggcggtgtgctggttttagggctgggctgtgaaaataatgagctggcggcaattaaggaaacgctttctgaagtgaacggagatcgggtgaaatttctcgaatcacaggctgtcacagatgaaattgaagcgggaacagcgcttcttaaagagatacaccttgcggcaaagggagataaacgtgaggagattccgctgtcagaattgagcatcggattgaaatgcggcggatcggacggtttttccggcatcaccgcaaaccctttattagggagattttcagattacttgattgcacagggagggagcacggtcttaacggaggtgcctgagatgttcggcgctgagacgattctcatgcagcgtgcggcgagtgaagaagtgtttcataaaacagtccgattgatcaatgatttcaagcaatattttatgaagcacgagcagccgatttatgaaaacccgtcaccagggaataaggaaggcggcatttcaacgctcgaagacaagtcgctcggctgcacccaaaaagccggtcttgcaccggtttctgatgtgctgacatacggtgaaacactgaaaacaaagggattgacactgctcagtgcgcccggcaatgatttaatcgcttcttcggcgctcgctgcggcgggctgtcacctcgtgttgtttacaaccggaagaggcacgccgttcggcacatttgtcccgactgtgaaagtatcaacaaataccgatttatttcaatcaaaacctcattggattgattacaacgcggggagattggcggaagacgaaacaacagaagatcacattgtaagagattttattcaatacattattaacgttgcaagcggacaattcgtcaataacgaaaaaaacgattttcgggagcttgcaatctttaagtccggtgtgacgttataagagaaaaggcgatctgacaacagaccgccttttttagattaattttatcccgctgattaaaataatcgccgccatcacaaactgcagcgggcgcggtgagaatttcggcgaaaagaagctgccgagaagcacacccggcacagagccgatcaacagattcaatacaagcaggtaatcgacgcttccgaagcttgcgtttaacagaccggcaacagttacgagcagaaaggcatgtgcgatatccgttcccaccacttctgccgttttcattctgaacaggtataacatggcgatcgcaaataatgagccggacccaatagatgtcaggccgacgatgaagccgaaaatgacgccgatcagtatcatgagtgtccgcttttcttcaagtgttttttgctgccagcggttcggccgcagttttttatcgaaaaaaaggcgggcgataatggaaatagcgacaagggtcagcacgtagccgagcgcctgtttgataatctgctcctgatgctggtgaaaagcgggaaacaagtgaagaataccgatggcggctgttgcgctgggaatgctcccgagcgccaagtagccgacaagtttaaattgaacggtgcgctgcttccaatgagaaacgacaccgaacagtttggtgatggaattatataaaaggtcagtgccgacggcgattgaggggttgatccctaaaacgatcagtaaaggagtcaaaagcgccgctcctcccacacccgtcaatccgaccagcgttccgacaaagaaacccataaacacaatgcttacagtcatctgtgtgcctcctgaataatcctactatttttatcagattatatatgattaagaggcggtaatcaattaaattttcggaaaattttatacagaacaaaaaaatccgcctgcctgctgttatttcgcagatcggcggatgatggccggattatgatttttgctgataaaacggaagttccgtgtggcccatttctctgacatacacgaaaagattgcctttatgatgaatttcatgctccatggcaagctgaaggagagccgcgccggttatttttctgccgaaagaggcagtcaggtcaatttcgcggttcagctgctcttcagtcagctgtgacaggatgtttgtcgttttttcagtacatgcttcagccagtttgacgaggtctgtttccgcttcttctttcggtttgttctggatagctgatccgtttccgtcgttaatgacgtttgcaaacataagaaaagaataaacgatgtgttttacaagttcctgagcggacattgatgtctctgccggcttgtagtcgtaatgctcgcggctgattttttccgccagctcaatcgtcacgtttcgatgtgacagaaagtggctgaccaattgattttgtgctgtcatgtgaaaacccccatttaatacagaataaaagctgcaaggatatgctatatcaacggcacggaagaaacaagcaataagcttgtgatggagataaatcgttgcggatatccgaaattcgacaattgcggtctttttgcgttcttctttttctagcaattatgataaaatatgacatatctcggtcattccaaaagggggatttattgaggatgaagcagactattccgtcctcttttgtcgggctcaaaattaatgaatggtatacccatatccggcagtttcacgtccttgaggcggagcgcgtcaaacgtgaagtagagagagagattgaggatatggaagaagatcaggatctgctgctgtattattcattaatggaattcagacaccgcgtcatgctggattacatcaagcccttaaaggaggacccttctcagcctgagttttcagaattattggaagacattgaaggcaaccagtataaactgacaggactgcttgattactactttaatttttttcgaggaatgtacgaatttaaacagaaaatgttcctaaacgccatgatgtattacaaacgggctgaaaaaaaccttgcactcgtttctgatgacatcgagaaagctgagtttgcttttaaaatggccgagattttttacaacctgaaacaaacctacgtctccatgagttatgccgttcaagcccttgaaacgtaccaatcgtatgagacgtacaacgtccgcagaatccaatgtgaattcgttattgcagggaattatgatgacatgcagtatccagaaagagcattgccccacttagaacttgctttagatcttgcaaaacaagaaggcaatccccgtcttatcagttcagccttatataatctcggaaactgttacgaaaaaatgggagacctctctaaagcagccgaatattttgagacatccgtttccatttgcaggtcagaaaagttcgataatcttccgcgttctatttactcattaacacaggttctttataaacagaacactacagccgaagcagagaagcaatatcgcctcgggctcagtatcgcccgcgaatacaatgatgaattgtttgtcaatctgttccaatttttgcatgcgttatacggcaaggaaatggataacgcatccgtcaggcacacgtttgattttctggaagaacacatgctgtatccgtatgtggaagaattggcgcatgacgctgccaaattttacatgaaacacggacagcctgaaaaagcgctcacgttttatgaaaaaatggtgcacgcccaaaaacaaatccagagaggagattgtctatatgaaatctaaactattgtcaggattgctgcttgttgctgtcgggttcagctttacacaggtgatcggccatgaaagccatttggaaaaccaagcggacggcacattccatattgccgcgcgcaaccaaacataacataaagacccttctttggaagggccttattttttgcatgcgtatccattccatttttatccgaatgcagggtctatatactcagttatctgtcctacgaatgccacctattgatgaaaaaggcataaggagagatgaagagtggggattgaagtgaaaaaacggctcgtatcggctgataaatatgcgttaaaatgtccgaatccgatgacgccggagtatattaccattcataacacggcaaacgacgcatccgccgctaatgaaatcagctatatgacgggaaacagcgaatcaacgagctatcattttgcggttgatgacaaagaagtgatccagggaattccgttggaccggaatgcctggcattcgggagacggcacgaacggtaccggaaaccgaaagtcgattgctatagaaatctgttacagcaagtcaggcggcgaacggtacagagccgcagaagaactggcgattgcgtttgcggcgcagcttttgaaagaacggggctgggggattgacagaatcagaaagcatcaggactggaacggaaagtactgcccgcaccgcattttgtctgaaggccgctgggatgaagtgaaggcgaagattgaaaagaaattaagcggaagtatgacggcgaaaaaagcctctatttcttcttccgcgtctgagtaccatgtgaaaaaaggcgacaccttatcggaaatcgccgcatcgcacggtgtcagcgtaaaatcgctgcaaagcatcaaccatatcaccgatcagaatcacattacagtcggacaagtgatcaagctcgctcagacgggttcttcttcaaaaagtcaggctgtgtcttcctatccgcttccatccggtgtgatcaaagtgacgaaaccgctgacgaaagggacaaacgtaaaacaagtgcaaaacgctttatccgctctttatttttatcccgataaaggagcaaaaaatcatggggcggacggcgtttacggcccgaaaacggcaaatgccgtaaaacgttttcaatccgtcagcggattaacggcagacggaatttacggcccgaaaacgaaggcgaaaattgaagaaaaactgtaatcaagaaaacggaagctccccgggcttccgttttcttcttacatacaaactgcggcaagggccttttgaatatcataaatgctttcatcttttttaaactgctttgagacagcgggaagttccgcgcctgaaatccaaattttcagctctgaatcaaggtcgaagcggccggcggtttctacgctgaatctggaaatgctcttgtacggaatggattgaatctccgttttcttccccgtgagtccctgtttatcaacaagaataagacgcttatccgtaaagacaatgatatctcggacaagcttaaatgcggcgttgacattctcaccttccagcaaaatacgggccagttctgcttttgcttcagccgtcgatattgtcgacgcattgcccagcaatccgttgatgaaccccataatatctcccccctgatacgtattctatcaatcatactataaaaaggtttccattcccagatgagtagagtaaactggtgctgactggaaaaggagagcatgttacacatgaaagatagatatgacaatttcgcagccctttccgctgctgaatcggaatacagaattatttatgaagaaaaagagggaagtaaatgtatcgtcctcgctccccacggcggcaggattgagccgggtgtcagtgagctggtgcaggcattttctgaccaaagctcaatttatttatttgaagggacgaagcggtgcgataaccgttctctccacttgacaagcacacgctttgacgagcctctggctttagaaaaagtggccgcccatcattacgcattggcttttcacgggtatcatgatctgaaaaaggcaaatacactcgtcgggggcgcggatctggaaaaagcaagactgatttgtgatctgctgcgtgaagcgggatttgatgccgagctgacagagaagaatgatcggctggcaggtgtaaatcccggcaacattgtcaatcggacaaaaaggaaaatggggctgcaattggaagtgagcacggcgcagagacacgcgctgttcagcaattttggctgccgggtagaaaaatacacgccaaccgatctgttttttcggtatgtagaaaccgtgaaggccggtttttatgataaatgaacagggggcccgttcttacattcactggagctatgcggtgcatgaagtgcttggcgggcagcacggtgattacagcgtcatgatgcaaaaaccttttctccgatgtcaaaatgatgacattctgccggctgtgttctaagccggcggagaatcgctaattttcaataaaatacggcgttttttcttcagcggcatgcaagtgtgtctgtccgcttccataatacacattcggccgcttgtcggataacagacaagcgagccgcttctgaaattgaatacctgctttacgccgttcaaacagctcgagccttttttccgcaaatgatgccgtcacccggaaagcggctgcgattaaaataacggcgtggctcctccgctggggcagctccatgtttaacagcataaaggtcggcacacagaagtggtacataaaatggttggcctgaaattcctgcagttccctgaacagcttgttcatatgaaaatggttcccggtatgcttcagcacatggcacagttcgtgcgcaaaatcctgccattgctcttcgggtgactttttttgattcaggacgatgctgtacatgccgtcccgcttcagcatcatactgtgcgtatcttcaaaatgaatccaaatgtcaagctccttggcaatcatctgcatatcaatatggagaggggcggtcattcccatgcggcaatataagtttttgacgtattcctcaagatgtgttaaaaaatcgcccaattgaatacaccctttcgaacatatgttcttttttaagcgagaaagaaaagccctgatcggactttgaatcaattcccttttcttttaaaaataaacattcagcttttatatcggctgaacgttaagcagtttaaaggaaaagagcggattatttatgtttcggcctgcggtttttctctttttcttttaaataattaatgaattcaatggcctgctgcttgctttccggggaaaagtcctgcatgtcccgatatgcgatctgcaggtcgggatcggcaaacatgtcttcatctgaaggttcttttccggttaacaaataatcagtcgacactttgaaataatccgcaagcttttgcagcgtgtcgtaatcgggttcagatcggccgttttcataatgagaatatctggcgcgcgagacaccgatatgatttgcgacttcttcttgcgttttcttacctctgagactctttaatcttccgcctatcatccgaaatgacctctcttttttcaacaccctaagttacttatgattatagatacaaaatgtatcaaaagaaagagatgataaaaaaagtatcaaaaaggtcttgatgatacgaaatgtatcgtatataatcaacatcatagagatacaaaatgtatcaaaatgcgataagaaattgatcaggagggtgagagatgcagccgataatcatccgtttcagcagcaatccggctgaccagagatgtttaggaaaagcaggcggttcgatatcttttaccgcttgcggactaccggtattccgatttgataaccgattgcagtatgagcgctatatacgtctgaagaaaaatggagacgtcccttatgaatcgtaaaagctacccgtttttcatctattccggattattgaattctgaacattatgacaaaatagggtccgccatttggctgtttttatggttcatcagctcaacgacaaaggaacatgtaaaagacggcgtaaagtgggggatcgtcctcggacataagcccgtaaaagcaagagaaatggccgatgtattcgcggtcagcgaaaaaaccgtcaggcggtggctcgagagcttggaacagcatgagtatatcaaaaccgtccgcgccccttacggactcatcgtctccgtaaagcactcgaaaagattcacgccgaaaaagacattaacccgcccggaagcaactgaccggacaatatcggcggatcaccgggacaaaaatgtccggagagaaatagatataacaaaaaatcatactgctgaagaagcgattaacgacattgccgcccattttatcagattaaggtctgcacaggaggggcggagcgtatatccgtcgccccgggattatcaggccatcgcccgtattgtttccctcggtgcgtcagcacaagaagcaatcaaatggctcggcgaatgctttaccgcttttgaacagcggcgcacctcttcagctgaaacgatcaaggctttcagctattgcgccaagtttatggaagaccgcttgaatgcacgaattgcgggaaggacaatcacaacaaaaaaagagaggaatacgatacatgacaaaacgaacgatcgagcagattcttgccgacctgaaaaacggaaaacgtccattactggcggacagaccggaagaatcagacaaaagccgctttgactgcccgctctgtaaagatcagggcggttatctcaaaaaccagctgggaatggaagtatgggttaagtgccgctgcgccgccgaacggaaagtagaacgcattctcggcgcaagtgagattacagatgcctttcggaagctggatttcaaaggatttatcacgcggggcaagcctcaggcagtcgtcgacgcatatgagtgcgcccttgaatatgttgagaacttcgacaagatgaaaaactgccggaaaaacagcattgcccttttagggcgtccgggatcgggaaaaacccatcttttgaccgctctcagcaattatgtcatgagacagaagcagacaccggtgctgtattttccttttgtggagggctttacggatttaaaaaatgattttgatctgctcgatgcaaagcttggccgtatgaaacaggcggatgtgctttttattgacgatctgttcaaaccgctgaacggaaaaccccgggcgaccgattggcagattgaacaaatgtacgccgtcgtgaattaccgctatttaaatcataagccggttcttatctcgagcgagctggcatgtgacggattggtgcaggttgatgaagccttgggcacaagaatttatgagatgtgcagcgattatttagtcatcattaatggcaattcatttgacgtaaaccacagattagagggggcgagataatgtgtaagctgtgcgggccgaagaaggtcattgtgatggaaacgggtttcggcgctgtctttcacccttgcccgaactgtaaaacaggcactgatttaacgccggtcattaaacggcttgaacgaatggttcaagacgcaaaagcgaggcttgatgcacgtgtgtaaatatatcaaatggcttttttgcctgctgttcagggcaaaacggatagaaaagcaaattgaagcatggcatgaggctgatggaaagtgaggatcaccattgcaagaaaaacacagccccgctccatggcgggccgtacacagcggagaagaaaaacccatttacatttattccgcttacagcgaagcggataaagagaagttcccttattcaaacggaaggctcatcgcggccgttttcaacttaagttcatactcacagcagatcaacgcggcattgatggcgaaagccccggaactctttgaggcggccgaaacggctctccgcctgctccggggagaaagttctgaagaaaaagaagcgttcataaataagctcggaagcctcatacatgaagtgaacattttgaaaaagacggaggacgtaaaacatgaatcctaaaaaactgactgacattgaacatacaacattaaaaagccagctggaagaaggcaaggttcgggtgattatagtagacggactgaagaaggaagcatggctcgccgaagcgccggagcacggcaaaacgcttgtcgaaacacgaaaaggggatctggcccgggtcgaatatgaaatcggctttaaattgaattaatcgaaaaaaacagaatacgtccaagacggaaagcctgcggacactgatcaatcgcgcacatgctgcgcattggttggtgtcctttttttgttccgaaaaagaggaggatctacatggaagacttactatttgaatataaacgcacgctgaaagagacgaaaaagtggtacaagcagctggaggcagccgatgaaacggtgcttacttcagaagaactgaaagataaaaaaatcatcagaacgattattacagatttggagtatgtcatcgaatggcttgaaaaaggccggcagcccggcataagaagagcgatagaccgcagagacgcttatcagagaatgctcattaaagatccgagaatcatagaaacctattcgcaggcgctgatgtttgaaccgtccgcaaatgtgactgaagaagacagaatcagactgcgggacgcattagccgttttaacggatagagaaaaagaaatgctgctgctccacaaagcggaatgcttttcgtatgaacggatcgccgccttgctgaatgtaaagaaatcaaccgtacaaacgacggtcaaacgggcgcttctgaaaattcaaaaacagcaggaacaaagaaatcaatcgcctgcttcataagttgtcatacgtttgccacctagaagtgaatagtagatcacaaaaagcggcccgattagaagccgctttttattatagacaatcatgtcggaggtggcggtgatgccgtagcatgaaaaacgcaaaaagagaacaggcatttacaatctatcagtctcataaaggccgcatcacaaatcgcgcccttgccggcaaatcaggcgtatccgcaagaacgatcggcagatggaaaaaagaagggcgctgggacgaggcgcttaataagaacgcggaaagcggcggaaaaaacaccccgggcgaaggtgatgagttaaacgaacgccagcggctgttttgtctttattatgtgaaaagctttaacgccacccaatctgcgataaaagccgggtattcaccggaaagcgcgcatgtgacgggaagcaggctgttaaaaaacgaaaaagtcgctaaagaaatcagccgcatgaaaaaggaaatggtcaataaagtgtttgtcgaagcgatggacgttcttcaagtctatgtgaaaatcgctttcgccgacattaccgattatgtaaccttcggaaaaaaagaggttcaggccttcggaaaatcagggccgctctttgacgaaaatgataatccgattatgcaggagatcagctacgttgacgttaaagattcgcaccttctggacggaaccatcgtcacggaagcaaaactcgggaaagaaggcattgcaataaagcttgccgacaagatgaaggctcttgaaaagctgtccttgtactttgaccttttccccgatcaatttaaacaaaaaatcgaaaatgaaaaattaaagctggctcagcagaagatggaaaaaacagaagacagccaaaagccgattgacattgtcattacgcggaaagaggaacggtcatgattgaaaaagcggtcaacccgcgctttgaagattatttgttcaattggaatgaaacgtaccaatttctcgttggaggctacggctcgtcaaaaagctatcataccgcgctgaaaatcatcctgaagctgcttcgtgaaaagcggacggcccttgtcgtgcgggaagtattcgatacgcacagggattctacgtttgccttgtttgaagacattatcggggagcttgagctgggacatgccgtaaaggccgtttcttcgccgatgcagctgagattttcaaacggaagccggattatgtttaaagggatggacaacccggccaaattgaaatccattcatcatatttcactgatttggattgaagaatgctctgaagtgaagtatgaaggctttaaggagctgatcggccgtctgcgtcatcccgagctttcgctgcatatgatatgcaccacaaatcccgtcggcacctccaattggacgtaccggcatttttttcgtgatgaccaaaaaaaacggttcgtattggatgatcagacgctgtatgaaaaaggcaccgtcgttaagggagatacgtattaccaccattccacagcgtgcgataatctgtttttgccgaaaagctatattaagcagctggacagcttacggcattacgatcctgatttgtaccggatcgcccgcaaaggacagttcggcgtcaacggcatccgcgtgtttccgcagtttcaggtcatggagcacaacgaagtaacggagcggattgcttccatcaggcgccccctgtttcggacgggcatggatttcggttttgaagagtcatacaatgcggtcattcggcttgccgtcgatccggatcaaaaagatctttatattttctgggagtattacaaaaacaaaatgaccgatgatcagacagctgaggagcttcaggaattggcggatcaaaaagagctgatcaaagcggattcggctgagccgaaaagcatccaatatttccgcaggcagggattttgcatggtcgcggccaaaaagtttccgggctcaagacttcagtatacaaaaaagctgaaacggttcagacacatctattgctcagacagctgtgaaaatacgatccgcgaattgcagaacttaacgtacgcaaaaaacaaaaacggcgctctgtcggaagatgagttttcgattgatccccacacactttcagccatttggtatgcgctggatgactatgacgcggcggatctgaaagatgcatcacaaaaacggagacgtccgaatcgggaaaggaggagataggcgttgccgaactatcaaaacgttagagccaccgtctttaaatcaaaaatggccgcgccgcaggcaaggcagatgaacgaagatcaatttgccgatctgtacggcgaagacatcatttcaccgccctataatctcattgaactgaaaacaatcgccgaatactcgacgattcttcagcagtgcattgacgcgtatcgggtcaatattacgggttttgggttcgatgtggaatatacctttgatgtaaatagcccagattgctccccgtcaaaaaaggcccgggccgaaaaaaactggatgaagctggagagcttttacaaatgtcttcattttgatgaatcggccgagacggtcctcggatatgcgatagaagaccgcgaaaaaacgggcaacggtttcctcgaagtgcttcgggacggcgcgggaaaaccggcggggattgaatatctggatgtaaaacatatgcgcgtctgcggtgtgactgatcccgttgaagttacattttcatatgaagaaaacggcgcatccaaaacgattaaaaggcaaaaacggttccgtaaatatgttcagatgctgaacggtcggaaagtgttttttaaggaatacggcgatccccgcatgatggacatgagaaccggcgaatacgtaaagaccctgtctgaagaataccgggcaaatgaagccattcacttaaaaatcggcagcggcacttacggcattccgcgctgggtcggcaatatcgtcaatctgtacggcgcccggaaagcggaagaactgaattttatgtatttcaagcagggccgtcatgtgccggccgccattacggttgaaaacggcatgctgtcagaaacctcgtacaaagagcttcaggattatatgaatgacctggaaggggtggaaaacgcccacaaatttctgctgattgaggcggaaggcattgcgaaggaaaaagaccttcacggaggcgaagacattacgcccgtgtctgttgaaattaaatcacttgcggaaattctgcaggatgatgcgctgtttcttgaatatgacgacaaaagcagaaataaactccgttccgctttccgtctcccgccgctttatacgggagaggcgcaggaatacaacaaagccacagccgatacggcacggaaaatcacggaggagcaggtgtttcagccggagcggaaaacgctgattaataagctcaacacgttatttttgcctgaactgggtctccacgatgtacagctcacattaaaagggcctgattttcgcgatccgcttgaaattgcgaaggtgcttacgccatttatttccgccggcgcggtctctcctaatgacctccgtgatctggcgggaagagtgctcggcaagacgcttgaggaatggcctgaagagtactacagccggccggtgctgaaagggaaataggagcaatcctgaaagggggtgaaaacatctcgtgccgagagaattgagaaatgccgtcatcagttttgtgagctatgtcgataaggcggcgaaccaaacggaattcttttttacaaaatcagccggaggccttccgtcatttgaaaaaaaggtgcaggtgtttacaaaaaacgaatcggatgagcagaagcttgtttacggcatcgtttacgagccggatgtccccgatgcacatggcgattatatgacggctgaagagattgaaaaggccgctcacggttttttggcggacgcccgcaacatcgatacaaatcataactttgaaggcgggaccggcgaggtggtggagtcgtacgtcgccccggatgactttgaaatcgggaatgctgtgatccggaaaggatcttgggtgcttgtcaccaaagcttccgatgaagtatgggatcagattaaagccggtatcattacgggctacagcatggcgggaaccgctgacgtttacgaagagccggcagaaaagcaagccggcttattcggcgcggtcaagcaatttctcgaccgtgaccgcaaatcaagaaaccgcaagggagaggacttgaacaagatgagaaaagaagacgtaagagaatcgattgaacacgcgctgcacccgcttttaaagcggcttgacagtttggaccagaacacggaagacaaagacggggcggctgcgccgtctgatgaagaaaagctgaaaacgcttgttgaggacatgctggcgccgattattaaacgcattgaagcgcttgaaaaagtaagaggcgcatcaaagcagccggaagaagagacgggcggccaagagcctgttaaaaaatccatttggagcggactgctttaagcccagtcagaaggaggaactgtagagtgagaaatcaagatatcatcagaaaggcggaaatgtcactttccgctttaaaaagcggcggtttaatgaaccccgcacaagcttcagcatttatccgcatggtgcagaacacgccgaccattttcagcgaatcgcgtgtgattcaaatggaaaatgactcgcagaaatttgaaaaaatcggtttcggccagcgtattctgcgtgccgctgaggaaggaaaagctttaactgacgatcagctgaccgtcccgtcaacaagtacggtgcagctgaatacgaaagaagtcattgcggaaattaatatcacctatgacacgcttgaaaacaatattgaaaaagacggcctgcagcagacgatcatgcagattttggcggagcgggcggcagtcgatattgaggagcttgtcgtaaacggcgatacatcttcttctgatccgtacttggcacagcttgacggaatccgaaagcagactgtatctcacgtcattgacggaaacggggaagagctgtccagagccacatttaaaaaaggcttaaaagccattccggcaaaatatttgcgactgcctcaggaattcagattttacacatctcaaggcatggagattgaatggaaagaccgtgtggctgaccgtcagaccaatctgggagatcttgcggtgcagggcggtttgtcttcagcattcggcgttccggtcaaaggagtgtccaatctgcagccgtactcagtcggagaaggtgattcccagtacgatgcgtctgacatcattttgactcacccgaaaaatatcattctcggtttttcaagaaatatccgaatcgaagtagataaagatattcgcagccgcaaatttattatcgtactgacggctaaacttgacagcaaatttgaagaagaagatgcaagcgccaaaatcgtaaacgttaaagaataagacgggggtggcagttatgttaattcagccgtctgacgttgtttcatattcagtttatgatcaagtcaaaaacaggccggaggcgcttcttatacaggacattctggaggcggaggcggaagcggccagaatagcggggcattcgttcactgaccctgtttactcaccgcttcccgaaaagattaagcttgcgttattaaagctttctcaatattttgcgctgatcaaccagaatgaagcagccgcttccgcctatcaatctgaaaagataggcgactactcgtatacggtggcaggtgaaggcggaatcagaaaaccggcggtgcaccatctgctctgtgaatatatcgcgccgggttattccccggtttctgcacacgcaaaggtgaggcctttatgagctacgaacggctgctcactgacagatgcgatatttatcatgagacggtgtcagttccgaaggccggacgcttcgggattcccgccgaaaagctccagcctgtcttttcttatccggaagtgcccgattatgaagacgtgccgtgtctgtttgttgaaaaacagcagcagcttattcagcttgagcctgatcataaggtatatcagcggtttctcgttcattttccgaaagaggccgttgtgcgtgtcaatgacaaaatcatttgggaaggccaggcgtatattctggaaatgccgaagaaagcaagacagcaccattgggaggttatcgctgtgagagatgacagactatgaacataaaaaaccttgaacaatggaatcggtcgctgcaaaaggcatcatctggagaatttgcccgtcaggcaggcgaatggctggaacagtcaggagaggattttctcgacttggtacgggaggagcttattcattcgggagggattgatacagaaagcctgctgtcttctttccgaaaaggagcgcaggatcatgtatggatcattgaaaacgggggactgacccttgaaatcggcaccaatgtagagtatgcctcattcataaatgacggacattggaccgtctcagatgaaaatgtcagatgggtgcccgggtattttcaaggctcccggttcatctatgatccgtcagcttcaacgggaatggcgctcaaaaaacagtggatcagcggaaatgggttttgggacaaagcccttcttttgtatgaaacactcttcgccgaatcgctggataagcgtttcaatcagtggcttaacacgttggggggagatatcggatgaatcgcgaaaccggttcaatcgccgcttttttgtatcagcaatgcggcgtgcccgtatatgaaaatgaactgcctgaacaatttcaggtgccgtcactttacatcccgcccccgtacgcttttgacgagaatgacacagtctccacctttaagaagacatacagtctgaatgtgaagctgttccatgccgactcggtgcaggcgctctatgcagccgaccggatcgccgatgcggtgagagaatcaagacagctgatcccgctgcttacggaatcaggggaggataccggtgatttcgtccgcatcagccgtatcgaaacaagagtcggagacaaaggcgaggcagtgatcaccatccgctggacgagccgctactactatcagaaacaaacatctcccgcactgcgggatgtggacattaacagcggggtgaaacaaaagtgaaacaatataaaaagaaaaacgccgcaactgcggaacgagcggttctttatgacacggcggatttaacaaagcacgcgaaggagcttttcggcgtaaaacccgagattctccagggggctttattcggcgtgaagcaaaaacaaatgacaaaagcgcaagccaagtcttacattgaagcatttttaaccaaggaggtcatgcaataatgaatggcggaacatttacgcaaggaaaagaaaaagaacgtgccggaatctattttaactttaaaacaaccgcccaggagcgggtatcgatcggtgaacgcgggattgtcgcccttcccgtcgcatccggctggggggaagcgaaaacattcgtttccatttcaagcgttgaagatttgaataaaaaagtggggctcagtattgaagatccgtcactgattctgcttcgtgaggcgaaaaagaaagcaaaaaccgttttgatgtaccgtctgacagagggaatcagagcgagcgcagatctttcgcaaggtgttaaagcaaccgctttgtacgggggttcaaaaggaaatgacatcatcatccgcatcagtgaaaatgtccttgatcagaccgctttcgatgtgaccacttacatggatgaagcggaagttgacaaacaaacggtgaaaaaagccgaagaattaaaagcaaacggctatgtcacatttacgggaacgggcgaactgtcggcttccatcccgctgacaggcactgaggaagaatccggggaaacgttaaacccgcaggcaggcatccgtctcgcgggaggaactgataaagcaccggtcaactcagactatacggattttttagctgcggctgaaacggagaatttcgatgtcattgctcttcctgtcgcggaaaacgatcagctgaaagcgacatttgccgcattcattaaacgccttcgcgatgcacagggacagaaagtgcaaggggtgactgcccattacagcggagattatgaaggcattatcaatgtgactgaaggtgtgctgctggaagacggaactgagattaaagctgaagatgcgaccgcctgggtggcaggcgcaagtgccagcgccgcatttaatcaatccttaacattcgttgaatacgaaggcgccgtcgatgtgctgcaccgcctgactcatgatgaagtgatcgaacgtctttccaaaggtgaattccttttctcttatgatgcccgtgataagtcagtcagcgttgaaaaagatatcaactcattggtgacatttacggcagagaaaaacaaaaagttcgcgaaaaacaaaatcgtccgtgtgcttgatgcggtgaataacgatttgacacgtgaactgaaagccttaattaaatcgaaaaaaggcaccggaagcgatcttccagcgacaaatgacggccttcaattcgtcaaaacgatgattattcaatatttgacaacgcttcaggatgcgggcggcatcgctaactttgattcagacaaagacattacaatcggccttaatgaagaccgcgacggctttttaatcgatctcgccgtgcagcctgtggatgcggcagaaaaattctactttaatgtggaggtaaactaagatggcattaaaagcgcaaaacacaatttcaggaaaagaaggccgtttatttctcgacggagaagagatggcgcatattaaaacgtttgaagcaaacgtggaaaaaaacaaatcagaagtaaacatcatgggccgccgcatgacgggacataaaacaacaggcgccaacggaacgggcacggcaacattctataaggtcacatccaaattcgctgtgcttatgatggattacgtgaaaaaaggcagcgacccgtattttacgctgcaagccgttcttgacgacaaatcatcaggccgcggaacagaacgcgtcaccctgtatgacgtcaactttgattctgcaaaaatcgccggactggacgtagactcagaagcgctcgaagaagaagtgccgtttacctttgaagatttcgatgtgccggaaaagctttctgaaacgttttaatcaggatcattatgagtgaaacaggcctttaacaggcctgttttttataaaaaaaagagtaagggagttttcatcatgagcgaaaaaaacgaacaagtatttgatctgtcattctttatgccgggtaaaacagtcgaggctgaggagattcgggttccgctttcaaagcgttttgtcgataaaaaaggaaacatcgtgccttttatttttaaagccattacgactgagcgcattgacgaactggagaaggaaagcacgacatataaaaatgtgaagggcagaggccgcgtaaaagacttagacagccagcgcttctatgcgcggatcgcggttgaatctacgatttaccctgatttccggtctaaggagctccgcgacgcttacaaaacggcagatccggtcgaggtggcaaaacgcgttctttcagtcggcggtgagtatgcaaattggctgaataaagcgattgagatcaacggttttgaagatgaattagaagatctggagcaagaagcaaaaaactgataaaagatgggaataaggaagccgtgtatctctattacgcgatgcatgagcttcattattctccatcagaactgaaagagttatatgaagcaccgagacattttaaggcgctgttgtacggtttaatcggttacaagctggacattcttgaaaaacaagcgaagaaagggggagcgacatcatggcaaagctgaccgctcgttttgaattggaagatcgggtttcaaagaaaataaggaaaatccaaaatggcttcagagcgcttgagaaatacaggaaaatgacaaaacgccaaagtgaaattgatatacgcaaagagagtaaatctgtcttaagaacaattgaccgcatccagcgctctatgaaaagaaagctgggcgcacaaacgatctctatttcagctgaagacggagccagtgccgtcattcaaaaggtgcaagcccaattagcgggtctgcctgcgtctttaaccgttaaaataggagcaaaagacagcgcgacagcggcatttgagagattgcgggatctggctgccggttttaaaggatttaccgtttcactgtatgcgtcagacgaagtgactcctgccatggaacgtatcaaacgctacatgcaatctgcgttaaagaacgggtactctgtcactatacgcgtcatagatcacgtcatgaaaacagtcggccgaatttcagcggggattgattcgctgacggggaaaaacaatgtcattcaattatcgttaaacgaaacggtgacagcacagctggctgcaatgcaaaagaatatgccggacgtcggaaaagcttctgcatctgctgctcctgcttcgccgaaaaatgatttttcaatgcttgactccattgcagacatcttcatgaaaaaagtcaatgacatcgcatccaaattttatccggaaacaatcatagcggaactggataaattcgctgcaagctttatgaagaaagcggacgaaatcgcaagcaaattcagtccggcaacgattttagctgaactggataagttcacgacctcattcatggggaaagtggacgaaatcgcaagcaaattcagcccggagacgattttagccgaactggacaagttcacgacctcatttatgggaaaagtagatgaaatcgcaagcaaattcagcccggcaacgatattagcagagctggacaagttcacgacctcatttatgggaaaagtagatgaaatcgcaagcaaattcagcccggagacgattttagccgaactggacaagttcacaacctcattcatgggaaaagtagatgaaatcgcaagcaaattcagcccggcaacgatattagccgagctggacaagttcacgacctcattcatggggaaagtggatgaaatcgcaagcaaattcagcccggcaacgatattagtcgagctggacaagttcacgacctcattcatggggaaagcggacgaaatcgcaagcaagttcagcccggcaacgatattagccgaactggacaagttcacgacctcattcatggggaaagcggacgaaattgcaagcaaattcagcccggcaacgatattagccgaactggacaagttcacgacctcattcatggggaaagtggatgaaatcgcaagcaaattcagcccggcaacgatattagcagagctggacaaattcgctgattcgtttatgaaaaaggtagacggagtcgtgagtaaattcagtccggaagccatattgaaagaactggataaattcactgattcatttatgaaaaaggttgatgacgttgtcagcaaattcagtccggagaccatattgaaagagctggatcattttactgattcgtttatgaagaaagtcgacgacgttatcggtaaattcagtcctgataagctaatcgaccgtgctgaacaatttgtaaatgacacgattgaccgaatttctgagaaattcgattttctcaatccggataagattttggaaaaagtggagcagtttacttcctcactgttcggaggcattgataaaaagttcggcaaattcagtcctgatgcgatcatcgaaaaagctgaggcatttgttgataaaattgtcagcaagattgccaagaaatttgagaaattcagcccggacaaaatcatcgaaaaagccggggaattaatagaaaaaatattttcaggaatcgctgaaaaattaggcaaactcaatgtcggcggattattaggaggcggcacgaaaaaagaaaagagtaaggggagcctttctgccggcggcaccaacagcccgaagcgtcctgatctgacaaagggtccgcagcgcacgggaccatcaccgaaatcttcaggaaggtcagccaaaaaaacaggcggggctttggggggctgctgctgtaccggagtgacgaggggcaaaagcagtaaagtcgaagggcggaataaatcttcgaaaagaggttcctccgtaaaggaaagcaaacaggcatccgtaaacacgccgaaaacaaaaggggcaggtaaaggcatcggcgggcttttgaaaggcttaggagattcaaaggcgctgaaaggcggtatgaaagggttaaaaggtgccgctaaaggaattcccggcataggtgaattgttatcacttactgatttagccggcatcaataaagataatgcaggagagaaggtcggctcagcaggcggcggtcttgcaggagccgcggccggagcggcaatcggcagcgttgttcccggagtgggcacattaatcggcggcgcggtaggcggcatcgccggcagtttaggcggttccagcttgggagaggcctttgattcaggggctttgaaagacacatggaatgatatttccgaagcggcgcaaagtgcttggacaacaatacaagatacttggggaagcgtttcatcctggttcatggaaaatgtatggacgccggtttcatcagctgtcgccggagtggcgacaagcatttggtcaaatatcgtgaatgcgtggacgacgattcaagggattttcagcacggtgtcatcctggttcatggagaatgtatggacgccggtttcaacggctgtcgtcggagtggcgacaagcatctggtcaaatatcgtgaatgcatggacgacgattcaaggtgtcttcagcacagtatccggctggtttatgagcactgtctgggagcccgtaaaatcggctgtcgtcggagtagcgacgtccatttggagtaaaatcacaggagcttgggataaaattaaatctgttttcagtacggtatccggctggttcatggatattgtctggaacccggtgaaaaacatggtggaaaaagtcggaaaaggaatatcagacgctttcacgactgctttagatacggtaaaggatatatggaaagggttaagcggctggtttgagaaacatataaaagaacctcttgtcaaagtgggaacagccatatcagatgctttttctgcagcattcgactgggtgaaaaagatttgggataaaaccggcggcaaattgatttcaggcgtaatggacttcgtcacaggcggcggagataaaaagaaaaaaccggacaaaaacgccacgggcggctacattacaaagccgaccatttcctggatcggtgaagccggtaaagaatttgtcatccccgtcgacaacaatcgcggacgcggaaagatgctgctttcacaagctgcgtctaagctcggcatgcgtgttgtcgatgatatgggtgcggcttcggctcagtcttccgctgtgccggcgggagcgggcggtgtttcttcttctgcatctgtatcggccgcagcgtctgtagaggcatccggacttggcgggacggcttcatcactcggcaaacagtttactgaaggctttgacagcggaatcagcaataaatcggtggatatggacggctggaaggagaaaaacatcggaacgccgttcaatgccctcatttcgtcttcacccggttacggaaagcaagtcgttgcgggctatgccaaaggtcagaatacatcgccgacgggcaccgattcatttttaaaaacaaaggtgaaagcaccttatcaatcggcggttaatcaatcgtcatcatggggcgccgccacagtgaaaggatattcggccggacagaatgcaaaagatacgggaacgtcgcaatacgtaagcacacatatcaataaaccgtttgttcaatcaagagattccgcgaacggctggggatcaggcctgatcggacacttcgtatcaggaatgactgcaaaaggaagcgaagtcaaacaggcggccaaagatatggccaaaaaagtcgaggacgcattcagggaagagcttgatattcactctccttcccgtgtcatgatgagtctcggacgctttgcttcagtcggcgtcgtcaaaggcctcagctcagttgacgtgaaaaaatacgccgaaaaacaggcaggctcgcttgcagcagccttttccggcatgggtgcagcgggaggaagcgtcaaagaatggcttttggccgcaatgaaagcaaccaatacgccgatcagctggcttccgggattaatgacgatcgcacagcatgagtcaggcggcaaccctaattccattaatctatgggacagcaacgccaaagccggacacccgtcacaggggcttatgcagacgattccgagcacctttgaagatcacaaagcgccgggcatgaatgatatcagaaatccaatccacaacgccgctgccgctatcggctatattaaaagccgatacggctcgatcagcaatgtccccgggattaaaagtatggctcatggcggcccgtacgtcggttatgccaatgggggtctgattaccaaggagcagatcgcccgtgtcggcgaagggaacaaacgggagtggatcatccctgaagagcggggcatccgcggccgttatctgctgcaaaaagcggctcaggcgctcggcatggaagtgtccgatccgtcccagacggaaccggcggcgctttcagccggcacggtatccgcagccgttaaaggcggcggacaaaccgttcaaaaaacgggaacaaaagaaattaaaatcgaattcagcggcgatcagcatttccataacggacaggacgccgacagcctcgccgccaaaatcaaacaggcgctgattgatgaactgcaaaaagacatttataccggagcaaagggggccgttgcttttgactaaatctgtttacgaattttggctgtctcaggggaaggacaagctccggcttcccgttctccctgaagcgattgatatcgcaaacagcgtgcagaatgattccgtgaaagtcaccggacttggagaggtgacgtttatcgaagaaccgggagcgaaagaaatttcgttctcttctttttttccgaaacggtacagcccgattgtcgaatatcaaagcattccttcaccggaaaaagccatttcagccattgaagcatggatgaaagcgaaaaaacccgttcagtttttgattacagggacaaaaatcaatgtcacatgcagtattgaaagctttaattacagcgaaggtgacaatgcaatcggcgaccggaattttgatatcgtactgaaagaatataaaaccgcttcgccaagaaaaatcaaacaaaagaaaaaaacgaaagcgaagcgcccgtccaaagcttcacccaaaacatataccgtcaaaaaaggggatacgctttgggacatcgccggcaagttttacggaaaacacacggagtggcggaaaatctggaacgcgaataaaaccgccatgattaaacgcagcaaacggaatatccggcagccggggcattggatcttcccggggcagaagctgaagataccgcaatgaaacgggtgaaaagatgattgaactatttgtcataaaagaaacggagtggcttgagcttgtcacagaaagcgtaacgctggaaggacacagatatcaggcgccccgctccatcgaagcgacgattgtcgtaaagcagggcagccagacgtattacggcgtatcagaaggggatacggttttgttcaaatggaacggaaaagagctgttccgcggtattgtttttgcaagaacgcccgatgagcataccgtcgccttcaccgcatacgatatgctccaataccttgtgaaaaaccaggacgtttacgtgttttccaacaagcgcgctgatcaaatattaaaaaggatcgccagcgattttcaaattcccgtcacatccattgccaacacaggccataccattaaatcactcgtttttaaaaatgatacaagcctttacgatatgatgataaaagcgttaaagcagacaaaaagccagacggggcgcaattatcagctctattcagaaaaaggcaggctcggcttgcgtgaatggccggagccgtctgacatatgggtgctggaaacaggagttaatattacagggtatcaatacagcacctctattgatgacaccgcaacccgtgttgtcatgcggctgcaaaaagacaataaaacgataaaggcttccgcctcagacagcgccggcatgaaaacattcggcgttttgcagtataccgaaacggtttctgacgacattaacgaagcccagctgaaacagcgcgcaaaagtgaagcaggctgagaaaaaaggcattaagaaagagctgaaaaatatacaggcgatcggtattcctgggttggaaagcggattgcccgtctatatttcaattccggaaatcgggctgaagaaaacctattatgtagatacggaccgccatgaattccaaggaacaaaacataccatgacgattgatgtcacggagaaaaattcacttccggaggggacatcctgatgagattaagtgatgccattaaacatttagccgtcggagcggttgacgccgaagcgccggtggagctgatcccggccgaagtgacctccgtttcgccgctcgagctgaaactgaaagatcacgacaaacttttgattccgtctgatgcactcattgtgccgaagcggctgagatccgggggagaggatcagctccaggcgggagatcgggtgatgaccgccgctttaacaggaggacagtctttctttgtactggacaaaatttaaccggcatccggacggagatatacgagaatatcagcctattaaagccgctttatctgccgaagagggcttttttacatgaacaaatctaaaaggagcgggtgcaatggccctgacaccggaaatcgaatttgaagatttggaggatgcgagtgaggccgttgagacttcacaaacctaccgaattgattttgaaaacaaccggattaccaatgaactgataaacggactggacgcaatcagacaattcgtctatatcgctcttcacacagaacggtattcatattcggttttcagccatgatatcggaaacgaacttcaggaagtgctttcagatcagaacacgacggatgcttataaaaaaatggagattccaagactgatagaagaagccttgctgtatgatgaccggattttggccgttaccaattttgagattgagaaaaaagatgatgccttcatcgtctcttttaccgttgaaactgatgagggcatgcttgagatagaggaggtgctgggtgaggatgtttgaagctcagacgtttgacgacattatggacagaatgctggcgcgcgttacggcggacattgatacgagagaaggcagcgtcatttacaatgcgctcgcgcctgcggccgctgagctcgcaaagtcttatatttggctggataccgtgctggagctcgtgttttccgatacggctcagggagaatttctggacaggcgtgctgctgaagcgggaattgaacgaacacctgccacaaaagcggtcagagccggagaattcacagcgggcatcaccattccgccaggctcccgtttcttcgttgataacctgtattttcaatatacgggggatggaacgcttgaatgtgaaacagccggtgaagcgggcaatgccggcatttcagggcaaaacctgctgccgcttgatacgatacccgggcttgagaaagcagtcgtgcgcgatatattgattcccggccgtgaggaagaagacgacaacagcttaagggcgcgctattttacccgtgtccgccgggaagcagtcagcgcaaataaacagcattataaacaatgggccgaagaggttgacggcgtcggcagggcgaaaatcttcccgctttggaacggagacggaacggtgaaagttgtcatcacaaatgcgaatttggaaccggcatcagatattctgatcaaaaaagtaaaggattatattgatccggacgaagggcagggagaaggacaggcgccgatcggagcggcagtaacggtggaaagcgccgtatggaaagaaatcgaaatctccgcttccgtgctgcctgagctgaacagctcgatcgatgacgtaaaagcggagattgaaaaaggcgtcctgaatttatttaagaaaatggccttcgaagaaaacaccgtccgtttatcacaaattaacaacatcgtttataactcggcatccgtcagtgactacgccgatatcaaaatgaacggtgcggcggaaaacctcgtgctcagtgacgtggaaattccgaaactcaaagaggtgagaatccttgagcagactcgatgagatgacggcgtacctcccgccgtttttaacccgattaaaagagatggcacaactgcttgaggcggaagctcctgagtttgagcggcagaataacgatattttcgatttgaccgatcagctctttatcacgacggcgacatgggggcttgaccgctgggaaaaaatattaaaaataccgcgggaatcaggtgacacggaggatatgagacggctcaggctgatttcgaagatgtcgaatattccgcccatcacccatcaagcgatcgagcaggcgctaaaccgttttttaaaacatccgtcagcttatgttcggatgttcccggggcagtatcgtttttatgccgatatcgggcttgatgacctgcagcacatgaacgagctgattgaaacgcttgaaaaaatcaaacccgctcatttggcgtatacactgagagccgcattaaacgaaacactggaaatcaaagaccgggtcattctcaacaatcggagataccgaaaagtcagtgaactgaaggtcggttattccgtcacactcaacaataacgaggtggtcttaccatgatatcagccgcttacagacagcgtgccgcagccgatctgaaaaacaggatcacaaaagtgctgttaaacggcaaagaaactccgattgcggacatttccgtaaaagatgccgcagtcaccgttctcacacgcagagaagaagacgtcaaacacattgaaaccgtgcagatgcttgacgaaacaggaagcgtcattacagaacgaaaaacaaatttagatctcagcaataacagaacgcttgatttaagatttacctttgaggtggtgtaacgatggcttacgaagaaaaaacagactggcttccggacgatccgattaatgaagatgatgtcaaccgctgggaaaaaggcataaaagacgcccacacggatctggcggcccataaaaacgacatgaacaacccgcacaaaacgacaaaggcgcaaatcggcctcggaaacgtggacaacgtccagcaggcagcaaaaaaagatttcgaccagcacaatcaagatctggaccggcatgtgacgaaagaagagcgccagaagtggaataacgggcaattaacaaagctgacggatgattcagggaaatatttaataagtatacaagatggcttggattttcatcaaattgtagaccagcttaatcaatcttttttcttttacacaaataacacgggagttcatactcctccgctttccaccagaggcttatatatcggattcaagtcttatggtgaggctctggcaatggattatgaaggaggcacatggagaaaaacccttaaagcttccggctggaccgattgggttcagttagaaacttcggaaggcgcccaaaaaaaagtcgatgcccacacaaatcagactgatatccatgtaacgaaagctgagaaggatacatggaatgcagggcagctgtttaaaatcaccgctgataacggcacgcaaaaaatcaatttaacttccggctcgttttatgactcgttaaaagatgttggttctgtaactttttacggaaccaatgcagtaacagacaacccgtcaaatacgagtctgcgcggtatgcagttagtggggcagccgggaataggtaatggttatgctgtagacgtgaagggtaatgcatggtggttttattataactctaatcaaacagcaatcaattggtatccaattgaatccatagctggagcgcagtcaaaggtcgatgcacatgcgatagattcatcaattcatataagccctatcgaaagagacaaatggaacggcggccagttggcgaagttgacaaaggatgatgggagacggacacgattagaaaacggatcagacatactggcgctgagctcggggttttattgtggaatgggtgctcagcttaaaaacaatccggttgaaaatgataattcctggtttaactatgatgtggttgagggggagtcagggaggaagtcgattttagcttggagaagttacgataacaatgtatggattgcaactgttcatacagacggtgtttttaaggggtggaaacgtctatttactgaagaagattttaataaaataacttggtatgatttaacgctaattaatggacataaggttggcggaagaaaacctcagtatgcagtgtggggcaaccaagtattcacccgtggtgaagtggttcctccagacttcgatagtgtttttgctgtactccctgctgaagctcatccttcaacacagaaagcaatggctgccactttctttggaacaacgggggtaacaaaatattatgccgaaccaacgggtgaactgagatttagcggaaaattcgctaaaatagaggaaaatattacagggatttcaatagataataatttcactttgtaatgagggatgaatatgcaagtctttttgtatgatgagagtttttattttcaaaggcctgaaatcttagacagtatatcaagtacaatgccgcaaaactcaacaaccataaaacctccggacggcttatggagaccgcagtttgatgaagtaaataaaatttggaacgaatctgctgatcaagaatataaggaaaatcaaaaaaacaagtatcaggatgtggtggagccggatcccattgtggaacagttgaaagaaatcggacagcaactggcagatgaaaaactagcgagaaaacaagcagaacaagctcaaaatgctttaggtgtacaattgtctgccgaagtggtagcaagggagaaaacagagatgttgaataaagctttaggtgaaaaattagcgtctttaaaactggaactcttacacgtaaaaggagaatgaaaaaatgaaaaagcttaacttttgggtttacgccttgttttatgagtgggcctcaacagaaatggtaaaacaggctatgggctatgatgactgctctgccgaagatctggctgaaggtgtggccgcgaagtatgtcacacctgaggaatttcaagaaataacgggtgaaacatacgaagactataaaaatgctgtgtcataagccagacggctttttttatttgtcatttttaataaatgagaaaaggaggacggccgatgaaaaagcatccatttgaatttcccgccgatcaacttggcaggcccggcgctgtaaaagcttatcgcggtaacaaaaacgattatgtcacaccggttgctgatttgtccggaatggcagagcttcttaccaatacgccgctagaagcgattgaagtttacagtcaattcggacaagaccgtttaggagccgtcttaataaacagagcacaggggtgggcttattcggaccgcagcggaactctttttatcgaagagagcgaggataacaattcgtggacagcttcacattctgtcgcagtaaaaggcggagtgctgaccgcttcggggtgggtctgcctgacaaaaagatattaccggttccgttttgaaaatggaaatcaaaaacagtccgaatttgttttataccaatctgtcggttcgggcggtgatatggcgttttcatatactgacgtgatttttcatgaaaatgcagcagaggcgggcgtgggaagcatcttctcagcgggcgcttggaaaaaacttctcgtcgaaatcaccggcacggctgagtcgggccatgtcgcgttttgggggagatccatctcgggaaaaaatgtgccgatcagaggaatcaggtctgatgacgggacatcagccgccggtacgtcaggcacagaagaagtgtggtcgtttgatattgccggctttaaggaaatcgtcatggaaatcaagagcatttccggcgggagcctttctgtcaaaggcacggcattttcttaagaatgaagcttccgaagggaggtgagaacaatgtaagaggggggagcggaagtgcttctggatgaacaagcggtgcaaaaagaattcgcaggcatcaaaggtgaacaaaaggtgcttgaacagcgggtagccgcattagagcgggtatcagaccggcaggatcagcaaatcatgacgctgaatgaaaaactgaacaaaattgacgaaaacacaacatggattaagcggaccattacaggagcgatcgtgacagcaatctgcacgggcgtcattggcggagccatcgccatcatgtacaatctgctgcaaaagtaagggggaaaccgatatgaaattcgcggacaaaggcacggtcgtcaggacggtgcttcttttgcttgctttattgaatcaaactttgctgatgttcggcaaatcgccgctgaatattcaggaggaccaggtcagccagcttgcagatacgctgtatgccgccgggtcggccgtttttacaatcataacgactgccgccgcctggtttaaaaacaattatgttacagcaaaagggaaaaaacagcaggctttattaaaaataaacaatttatcgaaataggagagatgagaatatggtaaaaatcacacaggattttatcccggcaggaaacaataaccgcccaggctatgcaatgacaccgatttacattacggtgcacaatacagccaataccgcagtcggagctaacgccaaaagtcacgcaagctatgtgaaaaatcccgatacaccgacaagctggcatttcacagtcgatgatacggaaatttatcagcatcttccgctgaacgaaaacggctggcatgccggtgacggaaacggggacggcaaccgtaaatccatcggtattgaaatttgtgaaaacgcagacggcaacttttcacaggccgtggcaaacgcccaatggctcatccgcacattaatgacgtcgcacggcatcccgcttgcgaatgtcgttgcgcacaagcattggtcaggaaagctttgtccgagaagactgctggatacatgggatgagtttaaagcgggaatcggttctgaggaaagacagacgtataccgtccaaaaaggagatacgctgtcggcgatcgcgcggaaattcggcgtcagcgtggccgatctgcagaaatggaataacatcgctgacccgaacctgattaaagtcggacaagtgctgatcgtcagcccgccggttgaagcactgtattctcttccggacgaggtgatcaagctgacagagccgtacacgtccggtgaaaaggtataccaggtgcaaaacgcgctcgcagcgctttatttctatcctgaaaaaggagctgtcaataacggcattgacggtatctacggtccgaaaacggcagatgccgtggcccgcttccaatctgtaaacggactgacgtctgacggcgtctacggtcccgctgtaaaagcgaaaattctgatgcagctttaacaaaaaaggctgagtcccgttcacattgcgggattcagccttttttctttttcaaccggttcaatagcccgagattcctcgcccgcatcctcagcgaataagcggaaagcccgaagcgtccgtaatccacaaactttacacgcctgacaattttcttcacatcatcacctgtcgcatctctttgttggttttattatatgaaagataaggaaaaaaggaataaggacaagagccgtgtctcctgtccttagtgtaatcaagcttttttttgtttatacttgtcaatcagccgctcgttttctttgaaaattctggcggtatgagggctgacctggtaacttgcgatacttgtcattgaacgttttttaaacattttgaacggtttcgctctttgttccggctgcccgttttgaaatgcctgctccatttaaccgtcaccttcctcttctattggcagcattaaatcataaatgctcgttagcgatgtgaaaagcaaataatcgaattccgtcaacaggttttccgacgtgagtttgatcacgtaatggcggttctggactgtaaacggaataagcacaagcctgcctttttgatcatagtagacgtctttacggttaagacgggactgaacgtccgccgcatcaggcatatgctccgtcaagcggtccttatccgattgtgcggaatagtcgcacaaggaagccgtgacattcattttttctccataagcggccagcagtctgctgatgccttccgcataagcttctgtacttccataatatacatggatcggttcatttttcaacagatattgataggttttcagtttttcaagataggagtgaagcatttcgttattttcttctaaaatttcccgcgtatccgtctctaattcattgccggcgagctttttgatatacgcgctcaaaaagataaacgcatcaataagggcaaagcagacggcaacaatcaaatattgtctccatgcggcaaagagcgattcgggatcatatgtccaatagaccatggcgcctactacaaatagtaaataccacgttttacggatggcaaacattttttcttttacctttgcctcataccgccaggatgcgtacacatataaaatgagtgcggccgccatcgtccacaccatgatctgaaaaaacaaaagcatgagcatccctcacaattcgaaaaatggtctgctatgttcattctatgtcatgacatcattttcctgtcacaaaaaaaaccgcttctgtaaagaagcggatgtcatcagaaaaagagatctaagatgaaaaaggcgatggcgccgagtgtacctgcaatcggcagggtgatgacccatgtaataagcatccgtttagccgttccccagtttacgccttttacgcggtgggaagcgcccacaccgagaatggaagacgaaatgacgtgcgtcgtgctgacagggagatgaataaacgtggccccgaaaataatggctgcgccggttaagtcggcagatacgccgtttaccggacggattttcataatttttccgccgacggttttaatgattttccagccgccgatggatgtgccgagacccattgccagggcacaagagagctgcacccaaaaaggaatggcatcacttttatgtaaattggccgtcataagcgccatcgtaatgatacccatcgctttttgcgcgtcgtttgttccgtgtgtataggactgaatggcagccgtcaaaatctgcactctgcggaagcgtttatttgttttcgccagattgctgtctttaaaaatcagcttcacgatcgaatatacgataaagccgagaacaaaggcgataatcggcgataaaataagtgcttcgataatcttaatgaaccctttataattaagcgtcgcaaaacctgacgctgcaatggccgctccggcgatcgctccgataatcgcatgtgaagagctgctcggaatgccgaaataccatgtgatcaagttccaggcgattgcggcgagtagagccgccagaatgacaactgacccgttgtctaatgtataaggattcacaatgtccttcgtaatggttttcgccacaccggtaaatgtcatcgctccgagaaagttcatgatggcggccatgacgattgcgtgccgcggcttcagcgcttttgtcgaaactgaggtggcgattgcgtttgcggtatcgtgaaatccgttaatgaagtcaaataccaaagcgcatatgacaattaatatcgttaaaagtaatagagtatccattataacccctcgttacgcgtttttcataataatggtttcaaggttattggcaacgctttggcaagagtcggcaatttcctcaagcgtttcgtaaatctcgcggtactgaatcactttaatcggatcggtttctgtgccgaacagattttttaatgatttacggtgcaggttatcacagctgtgctcgtattccttaattttaatggcgtgagggtgaatgtccttcaatcggttttctgcaagcagctcaatcgtgattaaaatttccttcgcgcactctctgatgtatccgctgaacttatcgatatgctcatctgaagaagtgatcgagaaaatctccatcattgctgaaaaatgttcgattccgtcaagcacgtcatcgaggctgtttgtcagctcaaggatgtcttcacgttcaatgggagtgataaaagctttgttcagctctttaatcatgacatgaacatgattatctccttttgtttcaaactcttttaacgtatcggcaaattcctttaaagtcgtctggttcgtcactttaaagttgacaaagtattctgcggtttcgtctatgttttttgcgatttctgttaaaaggagtgagaacttatctttttttctttttatcattaaaaaccctccattgtttgaatgagacaatgcacacatcaaattattatatagccttttgtcgaaaaaaaacagataaagtcgaaaaaaacgcctcttgattttttcgtaaaaacgtgtctcatcctgtttttcttatgttacccacttcgccaaaaaaacgtaacatacttcgaattcagacatcttgcttaaaaagtataacaaaagatgtgaatttgctgtcaacttttgcacgtgattttgccagaaaaaaaacggctcccgtaaaaggaaccgtttttgtcagttttttctgccgtttttcagccaaaaataaagcggcagcccggcgaggccgatcaagagggacagcgcgcagctcagtgtatctgtaatgatcgtgctgatcagcacaaacagtgaacccgcgatggccaaaacaggaatgatcggatacaaaggcacgctgtaggcgcgcggttttcctccgcttttttttctgaggataaacacggcgaaaaaagccatgacgtaaaaaatataaatcatgaaaatagagatttcagacagcttatcgggattgctggcgatcatgaaaataatggccagcgcgatctgaaatgacacggcaatccacggggtgcggaatgtcggatgcacccgcgaaatctgtccggcaaacggcagctgtttccgttccgccatcgcaaacgagacacgcggaaaagcgagaatctttccgtttaaacagccgaagatgctgacgatgattccgacgctgatcaattttcccccgatgtcgccaaacagcattccggcagctgtgccggtcgcattttcaccgagtttgacgatgtcggtcgcaggaagaatgtgcagcagcgcaaggttaatgaaaagataaatggcggtgacgaccaaaagtccgcccgtcatcgctctcgggagcagcttttccggatttttcatttcgccgccgagtgccgcaagcagaatccatccgtcataagcaaacaaggtggccagtatggcagcgccgaaattcatttccgacatgctgcttgtgacggctgtgaaaatatgctgatcgcctttccaaaggccgaacacgatcatgcagataatcggaatcaatttgccgacagtcgtaattccctgtacgatgccgccatatttcgttccgataatgttaatgatgcttaaaaacaaaacggctgaaatcccgatcaatttagaccagccggaatcccagctgaacagatgggccatcaaggagccgaaatacaagccgattgctccgataatggcggggccgtaaatgataatttgaacccatccgcacaaaaagccccaaaattcgccgtacacttcttcgagatatgtataaagtccgcccgttttcggaatctgagtgccgatttccgcaacggtcaagccgccggcaagcgtcaaaatgcctcctaacagccacgcgataagcgcggttttcgcatcaccggagtaggcaagcacggcgcctggtttcataaatacgccggaaccgatgatggtgccgataacaagtgagagggcgatggtaaggccgatctcttttttaagtccgttctcttcaatctgcatatcctttccctccagatgtaaaatcgtcatgctgaaaaaactattttccatattgtaaaccctaattgctgaaacacgaataaaataaattttctgattttggtgttttgcctaaaagataaaggtttatgcttttgagaaggaaaaaatactgttttaaaagcgaacgttaatggtttttttaatatcaaaagttcgttattttgagaacggcagtctgcagaccgtctgtgaagcagatgggttgactttacgatccggataacataaattgtatatataaaatatctcgaaatcgagataattgactggaggataacataatgaaagttaatggaatacaccatgtatcagcattgacggctgatgcgcagaaaaatttagatttttatcgaaatatcctggggctgaagcttgtgaaaaaatcggtaaaccaggatgaaccgacgatgtatcacttattttacggtgatgaatcagccaatccgggatcggaattgacgtttttcgagattcctcggatcgcgccgttccatgcggggacaaacagtatttcttcaatcggcctgcgtgttccggatgcacaagcgcttcaatattggaaaaaacgatttgaagagcatcaggtctctcacagtgagatcgtgaaaatagcgggcagggacacactcgcttttcaggatcatgaaggacagcggcttgtgctgacagctgacgaaaaaggaaaagacatcggtgaagcggtgaagcaaagcggcataccggaagaatattctttccgcggtcttggtcccgttgaattgaccgtcccgtacccagaaccgacgctgcgtgtgttaaccgatgtgctgggcttcactgaaatcgggaaagaaacacatgaagaccggggcatggttacggtgctcgaatccggaaacggtggcgcgcgtacagaagtccatctcattgaaagaaacgatcttccgcgcgagcgtcctggaaaaggcagcgtgcaccatgtggccttccgtgttcagaatgaggaggagcttgctttatggcaccgcatcattacgaaagaaggtttcagcaactcaggcattgtagagcgttattatttcaaagcgctgtacttccgggaaccgaacggaattctgtttgaattgtcaacggacggtccgggatttatggttgatgaaaaacctgaggagctaggcaaaacggttgcgctcccgccttatctcgaacaccgccgttctgaaatagaagcgcggctgaaaccgattcagtaaatcagaaataatgaaagatgccttccggcttgacgggggcatcttttttttgcttttttacccgttttgtcattctttttacctatttgtaaacggcaaaataattgtctttgtttattaataaatttttcacatttggttgttacacttgttcaaagttaaacaaaaggagtgaaaacacaggtgaaaatgaaaaaacgcgagatagacgcggtcttaatcctcattttactcgcttccgcattcttgaatatgtacaacatctggaatgacgatacggtgaatccttattacaccgcagcggtaacgagtatgcttcaaagctttcataatttcttttacgcttcatttgacgcagccggatttatcacggtagataaaccgcctgttacataccagattcaaacgatcagcgcgctgatattcggtatgcacgggtggagtgtcatcctgcctcaggcattggcgggggtaggttcagttctattcatgtacttattaataaagccgacgttcggaaaaacggcggcgcgcatcgcttcgtttgtcatggcgtgtacgccgattgctgtagccgtagcgcgcacaaacaatgtcgatgcgttactggtctttttcctcttgttcgccacatggcttctctttaaagcgattcgaaaaggaaaactgatctggcttttggcggcattttttgtcgtcggagtaggctttaacacaaaaatgcttcaggcttatatgatcttaccggccttcttgctgttctatatgatggcggcaaataccacgattaagaaaaaaatcatttcactggtaagcgcgctggccgtattagcagccgtttcattgtcatggccgctcattgttgacaatattcctacagacaaaaggccatatgtcggaagcagccagacaaactccgtattggaattggctttcggatataacgggattcagcggctgacggggcaaagttccggcggccagggcgggcccgacggaaacgcatcgaaagagatgtcttcttccggcggttcttcacaaatgcaaaaaccgcccggccagtcagcaagcggagacaaatcacaaaccggcagtatgacggcacctccatctaacggccaaatgccaagcggcggtcaaggaggccctccaagcggcggagatggcggcaatggcggtcctggcggaggaaaaagcggtacaggcaccggctcgaaaatgcagtcaggttcaggaatgttcggtacgggaacacccggtccgctgagactcttccaacaagaattatcagatcagatcagctggctcctgccgtttgcgatttttggattggccggtttattgatcgccggggcgagagaaagaagaagattatcagcagaacagaaggaaacgatcttttgggcagcgtggcttgtgccgattgccggattcttcagtgtggcggaatttttccaccattattatctcattatgctggcgcctccgattgctgctcttaccggtgcgggatgggtcgccctcgttcatctgtaccgcaagcaggcgggatggaaaacttggctattgccggccgctattcttgtgacaaccggatttgaactgtttatcctcagaaactacaatgatcaaatcggcgcaggctggagcatcggagcaggcgttctcggcgcagtggcagcaatcgccctgttcgtattcaaacagcgccaaaaaccgctcagttactatgtttcacttgcagcccttctcgtcttgatggtgatgccgatttattgggcaagcacaccgcttctgtacggaggcaacagctcattgcctgaaacaggccctcagcttgcgtcagcaagcggaaaaggcatgggaatggataacgcatctgtcaatacaaaactgatcaactatttagagaaacataacgccggagcagactatctatttgctacaaccgattccaacacagcggcgccttacattataaaaacgaaaaaagcggtcatggcgatcggcggattcagcgggtctgacccggccattacgctgactcaatttaaaaagctcgtaaaagaagggaaagtaaaatacttcttaacatccggaatgggcaaaggcggaaacaacgatattgttgaatgggttgagaaaaacggaaagaaagtatcttcagacaaatggcaatcaagcacagatcagaaaacgaaaaatcatgatgcagctgatacaaaaagcagcaaggccgcgggtaaaaacagccggatgagcggcgggccgggcggaatgaatcagtcagcttcactatacgaacttcaatctgatgaataggaggaaaaaacatgagcagacatattcaatattcaatagtcgtcccggtttataacgaagaactcgtcattcagacaacctatcagcgcctgaaagaagtcatggatcaaacaaaagagcattatgaattgatctttgttaatgatggaagcaaagaccgcagtattgagattttaagagagcaaagtctgattgatccgagagtgaaaattattgatttttccagaaacttcggacatcagatcgcgatcacagcgggcatggattatgcagaggggaatgcaatcgccgtcattgacgccgatttgcaggatccgcctgaattaatccttgatatgattgagcagtggaaagaaggctacgatgtggtgtacgccgtcagaacgaaacgaaagggagaaacctttttcaagaaacagacggcctctctgttttaccggctgctgcggagcgtgactgatattgatattccgcttgacaccggagatttccgcctgctggacagaaaagtctgtgatgagatgaaaagattaaaagaaaaaaacccttttgtcagaggactcgtcagctgggtcggctttaagcagactgctgtagaatatgaacgagatgagcggcttgcgggggaaacgaaatacccgcttaaaaaaatgctgaagctttccatggacgggatcacaacgttctctcataaaccgctcaaggcggcaagctatgcgggaatgctcatgtccggagcgggttttctctatatgtttatcgttttatacatgaagctttttacagacagcaccattacgggctggtcctctctgattgtgatacagctgttattcagcggcatcgttctattaatgctcggaatgatcggcgaatatatcggaaggatttatgacgaagcaaaagaccgtccgctctatatcgtgcaaaaagcgtacggtatgaaaaacgaaaagatttatcgggaccagcatatgtcttaacaaacaccctgtccggccggcggacagggtgcttttatgtaaaataaaagccgcgggatgacagaatgtcccgcggcttttttcattcatctgcggccggtctgcgtgtgcagagagcgcatgatcagtccggttcccgaaaggttcagtaaaatgcttgcaccaagcgtcattccccaagcagcgttttgctgaggaagctgaatgctcagctgcagcaagatcaggccggtaacgaccagcaaaagtccggtttgtttcatgtgtatgtatcctcctttgcacactgagtcatacggctgatccaggcctaaagtttcagctgtatataaaaaaatccaaggcggctgccttggatttttgttaagaagatgtttcttctttttgagtcagtttcatttttttcgtcatttccttgccgtttctgataatcttcacgtcaacggtgctgccgactttcgtattcttgtagagaatattgcgaagttcgctgcccgtgtcagtttctttcccttttaagctgataatgatgtcttctgcttttaatccggctttggcagcaggggatccctgcgccacttcgcgaatgtaaacccctttattcagctgtttgccgaagaggccgagtgtgccttcctgatagttttgcggcacttgttccaagtcgatcatgctcacgccgatataagggcgctccacctgtcctttcgtgagaagctcttcggcgatcggttttacatcgttgctcggaatggcaaagccgatgccttctacatcattttcgctgattttcatgctgttgatgccgatgattttgccgtctgtattcaagagcggtccgccgctgtttccgggattgatggcggcatcggtttggatgacgttgatgcttgactcaccggctgacgtggagatcgagacggttctgtttaagccgctcacgatgccctgtgtgacggtgcgggaaaggtcttttccgagcggatcaccgatggcgatgacggattcacccgttctgagagcggatgagctgccgaagcttgccgtttttgttacgtgtttatcactgatttctaaaacggccaagtctgtcagagagtcgctgccgacgagtttagctgttacatcggtgccgtcatataatgacactttaagggaagaggcgccttcgaccacgtggttattcgtaatgatatacgctttgccgtttgctttcttaaaaataacgcctgaacccgatcccgtttccgcatcatcacccgatgaattagagtttgaatctgagcttgatccgaatccgaataaatcggaactgctttgctgcttttgcagattagtgattccgacgatcgccggtgaaatgtcttccaccatattcgaaatgctgcttgaatttgccgatgagctgtttgccgatttgccgctgccggattcagaagatgtctgcttagcggttaccgatgacgtttcctgagcgggagccggattggaagtatcttgagtctgatggtctccaagcggcgtaaatgtatagatgccgagggcgagccctccgccgatcactccgccgagaagcggtctgaaccagccgaagcttcgttttttcttgtcctcgtccggcgcggaatatccggccggctgcgggttttcttttactaaaaggacttcctgttctttttggtctgtccgattttcatcacgatagttatccatcatgttcactccgtttctctatttcatcatagcatgatttgcctattattactgactccatcttaaacaaaaagtgtgggataataatgaaaagattgtgggaaattgtgaaaaagacgaaatcggacggcggcgctttatattgacaatttccatcggatttgaaataataaatgagatattatgttcaatccttcacatgaaaagatatgaaaaattctgttaagctaatgggggaaatctgttagctttttcactttgtcaaatagtaagaaaggagctgtcaaatgaaagaaaaacatcactggatcatttctctgcttgctgtgctggcggtcgggccggggctgatgtcgaataccgctctttcggctgtccaaagccttgtccggcagacggtcggcggggaaaactttgactctcttcatccgattattatcggtaatatggcatttgccttattcgtgccggcggggccgtatttaagaaaaagattcggctcccggcctgtctatatgatttcgatggccgcgggtgtcatcggagcgctgcttgctgctgtgacaaatgatatttatccgctcgccgcgggccgttttttacagggagctgcggcgggcactatgctgatgattatgattccgatgctggtgctttcgtttccgattgaacgccggaattacgcattatttgtgttaatcggcggattttacgggtccgtcattatggggaccgttttaggcacggcggcggcaagcgccggccattggcattggctgttcggcatttttggcctgctgtcttttttcggcctcattttcagttatatgtggctgagggatgacgttcataaaaatgctgaaaaatctccatttgacggcatcggttttctgttagcgggtgtatcagctgtgctgaccgcctatacatttattcatctgccgaaatggggcttttcatcatggcagacattggcgggatttggaggaagcatcgtcattcttctgatcttgctgattatgcagtacagaaacgaacatgcgctgatttcgattaaacttatgctgattccaaagccgattttgggtgttttcatgatcgctgcgggcagtatttccatagcggtcagtctttctgcatttcacggggagcttcagaccgcatatcacatgtcacaaactcaacagatattcctttatgcgagccttttgggaggcgtggccatcgccgctgttatcagtgcattagcatatgataaagtcggtccgggcatgctcggcataacaggctctgttatactggtgttcgtgaatttccaatggatgacggcggatcatcatataccccttattctatttgcggggcttttcgtgatgctggcggccgggacagggcttatcgtggcagccggactgatgggagccgcgttgggcggaccgcttccggaactggtgaaacgcatgacggccgttcagtttttgaggctgttcatttatatgggcgcacctgttttaatagggtattttacgaaaagagatgcttccggcatgcttcggggcgcgcgcggcacacaatcgccgcatgacctgctgatggggacatacagcgatttgtttcttattgctttcatcttaagcttgcttttagtgtgtttatcatttgtcatgaatgcgaccggcatgggacataagctggcgcataaaccgcatgccgtccgtaagcaggcggatgaagagccttcgccgcaggctcctggaccgatcaggcatcaggtcattcccgatcgcgaatacagaagtgcggtcagacagtttcggggtcaccctatcaacaaaaacggtatgtaactttttctatcagcaaacccttttcccggtgaaaagggtttgttttttcctataatggcagaatggtatattgcatgtttcatccttttttaatataatttgttagaatattcataatttaatatcgaaattttaagtaaaaaaggaggcattacatgaaactgtatctatctgtggatatggaagggatttccggactgcctgatgaaacatttgtcaattcccgcatgcacaattatgagcgcggcagggttctgatgaccgaagaagcaaactggtgcatcgcagaagcgtttaataacggatgcacggaagtgaccgtgaatgacagccactcaaagatgaataatctgctcgcggaaaagcttcaccctgaggcagagctgattacgggggatgtcaagccgttttccatgatgcaggggcttgatgaatcgtattcaggtgtgatgtttatcggctatcatgcgagagcgtcgatgccgggcgtcatgtcgcacagcatgatattcggcgtccgccacttttacataaatgataagccggtcggtgaactggggttaaatgcctatctcgccggattttacgatgtcccggtcatcatggctgccggagatgattgcgccgcaaaagaggcggaggagctgatcccgaatgtgacgactgccgccgtcaaacaaaccatttcaagaactgcggtcaaatgcctgtcccctcaaaaagccggacggctcctgacggaaaaaacagcctatgcgctcaaaaataaagataaggtcaaaccgctgactccgcctgaaagacctgtattaggcattgaatttgccaattacggacaggctgaatgggcccatttaatgccgggcacagaaatcatcccgggaacgacaatcgttcaatttcaggcaaaagacatgccggaagcctatcaggccatgctcgtcatgacagaactcgccatgagaacaacattctgttaaaggggtgaacggcattgctgcggtattttatcaaacgttttatcgccatgatgatgaccgtcctcgtcatcaccactctgacatttgtcatgatgaaagtgatacccggctcgccttttaacgaagagcggggcacaaacgaagcggtccagcgaaatcttgaatcctactaccatctgaacgaacctcttatcactcaatacgccatctatctaaaatccattcttacctttgatttcggtccttcaatcaaaaaaccgtcagacagtgtaaacgccatgcttgaacgcggatttccggtttccttcgagcttgggataacggcgatcatcatcgctgtgatttccggactcgcgctcggcataacggccgctctcaggcgcggcggctttctcgattatgcggccatgagccttgcggtgctcgggatttccattccgaattttataatggctacgctgctgattcagcaatttgcggttcatctgaaatggtttccggcagctacctggacgagtccagttcacatggttctgccgactgttgcgcttgccgtcggtcccatggccattatcgcgcggctgacaagatcaagcatggccgaagtgctgactcaggattacatccgcacggcaaaagcaaaggggctttctcccgtcaaaattgtgatcaaacacgcattgaaaaatgctcttatgcctgttgtgacagtgctcgggacgcttgccgcaagtattttaacgggcagtttcgtcatcgagaaaatttttgccataccgggaatgggcaaatatttcgtagaaagcatcaatcagcgtgattacccggtcatcatgggaacgaccgtattttacagtgtgattctgatcgtcctgctgtttctggttgatttagcatacggcctgttagacccgcgcataaaacttcataagaaagggtgatcctgatgaatctcccgcaagaaacggtaaaacacacagaagtgcctgatgactggtttcagccgggcgcggaaagaaagggtgaaaccgagtcggtcaagcgtccgagcctgtcttacagtcaggatgcgtggcggcggcttaaaaagaacaaattggcgatggccggacttgtgatattatgctgcctgtttctagcggctgtgttcggcccgctgatatcaccgcacagcgtgacaaggcagacgctcgccgagcagaatcttccgccgtctttttcacactggttcggaaccgatgaacttggccgggacgtgtttacaagaacgtggtacggagcgagaatctctttatttgtcggtgtgatggcggcactgatcgactttttgatcggcgttatctacggaggcgtcgcgggctacaaagggggccggacagacagcgccatgatgagaatcatcgaggttctctacggattgccgtatctgctcgttgtcattttgttaatggtgctgatggggccggggctcagttccattatcgtcgctctgaccgtgacgggatgggtcggcatggcgcggattgtgagagggcaggtgctgaggatgaagcatgatgaacacgtattggcatcgaaaacgtttggagcgaaaacatttcggatcattaagaaaaatctgctgccgaatacgatgggagccattattgtccaaatgacgctgacggtgccggcggcgatttttgcggaatcatttttaagttttctcggactcggcattcaggcgccgtttgcaagctggggagtcatggcaaatgacgggctgccggcgattttatcaggccattggtggcggctgttttttcccgcttttttcatttccttaacgatgtacgcgtttaacgtgcttggagacggcttgcaggacgcgttagacccgaaactgaggaggtaggaaaaatggcgcagcaagttctttccgttcaaaatctgcatgttactttttcaacatacggaggcactgtaaaagccgtgagaggcgtcagcttcgatttatataaaggtgaaacgtttgcgatcgtcggtgaatcgggatgcggaaaaagcgtgacgtcacaagccgtgatgagtctacttccgaaacattcggcaaagattgaatccggaagcatacaatttaaacagaaagacctttgccaaatgtcggatcgggaaatgcggggaatccgggggcgcgaaatttctatgatctttcaggacccgatgacggcgctcaacccgactttgaccataggggatcagctatcagaagcgctgttggaacaccgcgccatgacaagaaaacaagctgaatccgaggttctcgccatgttggatctggtcggtatcccggactcgaaatcccgcctgaagcagtacccccaccaattaagcgggggcatgcggcagcggatcgtgatcgcgatggctctgatctgcgagccggaaattatgatcgccgatgaaccgacaacggctcttgatgtgacaattcaagcacaaatccttgaattatttaagaagattcaaagaaaaacaggcgtgtctattattctgatcacccatgatctcggcgtcgtcgctcagaccgccgacagagttgccgtcatgtatgcggggaaaatcgccgaaatcggcacgaggcatgatattttttaccgtccggctcatccatacacaaaggggctgcttcgttcagtgccgcggctggatatggaggatagtgagctttcgccgattgacgggacgccgcctgatttattcgatccgccgccgggctgcccgtttgccgcccgctgcccggacaggatgatcgtctgtgaaaaggtatacccggcaacaaccgtgaaatccaaaagccatatcgtcaactgctggcttcaggatcaccgtgcagagcggctgaagcagcagctgacggcagcagaggaaaaagggggattgaaatgaaaaagagatgggcgatcggtgtgattgctgttgtttcgtttgctctgatgggctgtacagccaatgaacaggcggggacagaacccggcaaagcaaaagaacaggggggtgagacggtgctgcggctcaataacgaaaatgagccgacctcacttgatccgccgatcggatttaataatgtttcctggcagccgctgaataacatcatggaaggattgacgaggctcggaaaagataataagcccgaaccggccatggcggaaagctgggaggtgtccgctgataagctgacatataccttcaatatccgtgataacgccgaatggacaaatggcgatcccgtcacggcggaagacttcgtgtacgcctggaagcggatgctcgatccgaaaacgggcgcatcttccgcttttctcggctacatgatcaaaggcggggaagaatttaacagcggaaaaggcaaacgagaagacgtgaaagtcacggcaaaggataaaaaaacgcttgtcgtcacattggcggccccgcaggattattttttgagcgtcgtgtccaatccggcgtatttcccgattaatgagaaggtcgccaaggctgatccgaaatggttcactgaagcaaaaacttttgtcggcaacgggccgttcaaactgacggaatggaagcatgacgacagcatgacgatggtcaaaaacgagacgtattgggataaaaagacggtgaaactggataaagtgacatgggcgatggtcagtgaccggaataccgactatcagatgttccagtcgggggatttggataccgcctttgtgccggcagagctgagcgagcagctgatgggaggaaaaaatgtccgcacctgggatcaggccggactctatttctatcgttttaacgttaaaatggagccgtttcaaaatgaaaagatcagaaaagcgttcgcggcagcgattgatcagaaagaaatcacggattatgtgaccaaaaacagtgaaaagccggcacatgcctttgtatccccgggatttactcagcctgacgggaaagatttccgcgaagcgggcggcagtttactaactccggatgaatcagaagccaaaaaactgctggaaaaaggcatggcggaagagcattatgacaagctgcccgccgttacattgacatacagcacaaaaccggagcataagaaaatagcggaagcgattcagcagaagctcaaaagtgtgctcggtatagacgttaagctcgccaatatggaatggaacgtctttttagaagagcagaaaggactgaagttccagttctctcaaagctcatttttaccggattacgcagatccgatcagttttcttgaggctttccaaacggataattccatgaaccgcaccggctggggcagcgcggcatacgacggctgcatcaagcaggcaaaacaggaagccgatgccaaaaaacgttttgcgctcatgcataaagcggaaaagctgctcatgaacgaggttccgatcattccgatttacttttacaatcaggtgcatctgcagaacagcggcgtgaagggcattgtccggcaccccgtcgggtacattgatctgaaatgggcggaaaagtcctgatcttacagcggaaacatatgccgctcttttgccgttaaaggagcggcgtgtttcacttttcaatccggaaaggagattgaaaaagtcatgaaccataaaccgaaagcactgcaaaaaggcgacacggtcggtgtgattgcgcccgcaagcccgcctgagagcgggacgctgcaaaccgcgctgctgtttttagagaatgagcttggccttcaagtgaaactcggccgggcgctgaagacccgtcacggctatttggcgggagaagaccgggcgcgcctcgatgatctccatgacatgtttagtgatcagaatgtcaaagcggtgatatgcgcgtgcggaggattcggcacgggccgcattgccgccgacatcgatttcggcttaatccgccgcaatccgaaaattttctggggatacagcgatattacgtttttacataccgccattcatcaaaatacggggctcgtcacatttcacggcccgatgctgagcacggatgtcgggcttgaagatgctgatcccctgacaaaagcgtcgtatcatcagctttttacagaaacggaattcacctatacggaggacatttctccgctggaggtgctgacaggcggaagggccgagggagagctttcgggcggcaatctgtcgctcattacatccacactcggcacgccgtttgaaattgatacgaaagacaaattgctgtttatcgaggatattgatgaggagccgtatcaaatcgacaggatgctgaatcaattaaagatggccggaaaactgtcagacgcagtcggaatcctggtctgtgattttcaccaatgcgaaccgaagcataaagaaaagtctcttactttagagcaagtgctgaacgattacattgtcaaatcaggaaagccagcgcttaaaggctttaaaatcggccattgttcaccgagcttcgccgttccgatcggggcccgcgcggttatggatacggcggccaaagcggtaacgattgaatcgggggtttccggaagggagtgatcaggtgtgaggattacagatattcaaacgggacggatgtccgtgccgctgaaaaagccgtttaagaccgctttgcgcacggtttacaatgctgaatcggtcattgtgaagctcacatttgacaacggtctgaccggctggggcgaggcgccgccgacggttgtcattacaggcgacagcacggacggtattgaaagcgcagtccgcgatgtgctgaagcctgctctcttggggcggagcctttccggcatggaagctgttttgtatgatatcagccggctgttggaaagaaatcaaagcgcaaaagctgcggtggatatggctgtatatgacggatgggcgcaaatgcacggacagccgctttaccggcttctcggaggctatcggaatacactggaaacagattttaccgtcagcgtcaattctcctgaggagatggcgggggatgcagaccgctatgtgaacaagggatttcatattttaaagataaaagtcggcataggtgacatatcggacgatgttgcccggattcaggcgatcagatcacgtgtcggcggtaacgtcaaactgagattggacgccaaccaaggctggacgccgaaagaagccgtgactgcgatccgaaagatggaagacgccggcctcggcattgagctggtcgagcagcctgttcataaagacgatatcgccgggctgaagcaggtcaccgatgccgtagacacgccgattatggcggatgagagcgtctttaccccccgtcaggccttttgcgtgctgcagacgagaagcgccgatttaatcaatattaagctgatgaaagcgggcggcataaagcaggcggaaacaatcaatgccatggccgaaacatgcggcgtggaatgcatggtcggcagcatgattgagaccaagctcggcatcaccgccgcggctcattttgccgcgggcaaacggaatgtgacaaggtttgattttgatgcgccgcttatgctgaaagatgatttgattaaaggcggcatcacatacagcggcagtcagattacgattcccgatgaaccgggtctcggcattatcggtgtgtcgatacaagaggaggcgaaaagatgagagcagccgttacagcggcggcagccaacgtatggacgctgccgtcatctccccgttcgtatgatgcgccgatgcttgaaaacccgccgcagatcagaaaatggttagcgtctatgggatatgaagagcggctgcaattatgtacagacaaccttgtccaaacgcaagcgcttttcggggaagaggtgatcattctcaaagaggaaggggaatgggcttttgttgccgttcccggccagccttcaaacaaggatgcgcgcggatatccgggctggatgaaaaaaagccagctttcaaaagacggcttttatacatcttcccccgccgtatggattaccaaaccgacagcttttttatatcacacaaacggcgaaccggacttggaagtaagtttcttaacgcgtcttccggcatcaggacgtgagaacggcttttttcgggttgtgacgcctctcggagaacggttcgtaaatgaagctgacgcagacgagtaccggcatacggaaggacgggtagccgatgtcatcgaaacgggcatgatgtttctcgggcttccgtatttatggggaggactgagcggtttcgggtttgactgttccgggtttatgtattcgatatttaaagcaaacggctatacccttccccgtgatgcaaaggaccaagcaaaagccgggtgcggcgcggcggtaaacgatatccggccggctgaccttttgtttttcgcctatgaagaaggaaaaggcgcgatccaccatgtcggtttggcgctgggagacggccgaatgctgcactccccgaaaacgggaaaaacaatcgaagtgctgtctttggaaggaacgatctatgaaaaagaattatgcaccgtacgccgctgtataagcgaaaagggggaatagaaaatgacggcatctccgctccttgaagtcagcgggctgaaaatgcattttgacgcaggaagaaagaaagccgtaaaagcagtcgacggtgtcagttttcacattaaaagaggggaaacattcggacttgtcggagaatcgggatgcggtaaatcgacgctcggaagagttattctccgtctgtatgacccgacggccggttcggtatcatatgaagggacggatatacaccgtgccgcggcagaacagcggtcggtcttcttccgcaagctgcagatgattttccaagacccttacgcctcgttaaatccgcgcctgaccgtaagggaaattattttagagccgatggaaatccacaatctttacaatacaagaaaagcccgtctgatgatggcggatgaactgcttgaagctgtcgggctccacccggatttcggcagccggtatccccacgaattcagcggcggacagaggcagagaatcggaattgccagagcgctctctctgcatcctgaatttatcgtggcggatgagccgatttccgcgctggatgtgtcggtacaggctcaggtcgtcaaccttttaaaaaggcttcagaaagagaaagggctgacatttttatttatcgcccacgatttatcaatggtcaagcatatcagcgaccggatcggcgtgatgtatttgggccgcatgatggaaattacagaaagcgctgcgctttaccgggaaccgcttcacccttatacgaaggcccttttatcctcaatcccgattcctgatccgcttcttgaggacaagcgtgaacggattattctgaaaggggagctgccgagcccccttaacccgccgagcggctgtgtattcaggacgcggtgtcctgaagcgatggagctctgcggtaagataacgcctgagcttgaagaagtgaaggcggggcgttttgtcgcctgccatttatacaaaaaagaaagctgacaatataatgtcagctttctttttgattaaacctgatgcagaaatgacacgcagaccggatacggaaccggaatgtcagattgaagcagagtcaatttgcctgtttccggatcgcgttcaaacaaaaccagatttcccgtttcttcgtttgacgcgacaaggaatgtctcggaagggtcaaacgcgaaatcacgcggccagttgccttctgtcggcacccattcaataagagacaattcaccggaatattggttgatcttaaagatggcgatgctgtcatgtccgcggttggcggcataaagaaatctgccgtctttagatatgcggattgcgctgccttgcgatttgtccgtaaagccttcaggcaaagcggaaatgacctgcagctctctgaattcacctaaggtcgggttgtattcaagcgcgatgacttcattgctgatttccgtcatgacataggcgtatttttccgccggatggaaaacgatgtggcgcggccctgaacccggtgcgaaagaatgagttttcacctctgtgagcgaaccgtttttcatttggtacgtatacagcgtatccgtccctaaatcgacggctgcaatgtagttatgctcaggtgtatagcctgcgaaatgggtatgcggtttctcttgtctttcatgaggacctgttcccgtatgagcggcttcggcagccggctcctgcagacttccgtcctcattgacgggaaaggcgtgcacttttccgctgtggtaattagcggttaacacatattcatgtttatcatcaatgctgacgtggcatggagacgggccttcaatcagctggtggtttacaaacgttaattccccgctgttctgatgaatctgataggctgcgacgccgccttttccgtctgccttttcaatggaatacagcatgctgttatcagaattcggagtgacgtatgtcgggttgccgagctttgctgccagcttcggccggctgagcctcttcgcttctgtatcaagttcaaaacaataaatgccttcgcttccgccttttgtatatgttcccgcgtatcctatgtacttagccattcggtttccccctttagagtcttgtcttctctatattaacgtatcttgaaggaaactgccttgtaaatgtttaagatgttctgacaagcggcaaggtgcagcagcggaaggaaccgcctgacttaataatttcggaaaactcggtttcaatgactgtataacctctttttctgagctcgcggttcgtatggcggtgctgcggcaggctgataattgtctgattcccgatggacaggatattcgggccgagcgtgaattgctcttcttcaggaacttctatcatctcaaaacgttcggcgagaagatcaatttctttctgccgcaagccatttttgcagtatagcgcttccgtttccgagatcatattaaatacacagtccaaatgtaagaaatcctccttgagagggatcggcacaacagtcatctccggcagcgcctcccgcagctcccggacagccgctttatccgtgcgcttgctcagcccggcgtaaacggtgccgtctgcgatcaagatgtcgccgccttcaatgttcgcttttttcagttgcgtataagggattttcttatcgtcaagcaggtcttgaaacactttttcttctccctgccggactgaagccgccatgtttgaaataaacgccgtctcgcctaagacaaatccgatatcccgggtgaatacctgctcaggcaatgcgggatcggcaggcagcaggacgacttcaatctgatgagatcttaaaatgtcaataaactcactatgctgtttgagggcaacgggtatgttaatattttcttgttggaaatgtttctgcgttccgttaataatatccttgatggtcatgtgttccggccggcataagatgactgtctgcaaagcatcaaactcactgcggcaagccggtttccgcgtggatttgggaatggatacgtccatgtgatatcctcctatcggtattcaatgtgcgtttattattcccggatgtgatgaataatgaaacatttctgatagaatatctaaccaacttaatatttaaaattttagacaaaacgagcaaagtattgtttaatagggtacagatgaaatgtcaaaacgaccagacaccaaaggggagtttaaataatatgaagttgccagaatcaagattttgcaaagaaacaagggttgtcaagacaagcagggtttttccgcttgatacgaataatcacaatacgctgtttggcggaaagctgatgagctatattgatgatatcgcttcaatttccgcggcccgccactgccggtgtgaaacagtcacggcctcaatggattctgtagattttttgcgcccgatcggccaacaggattccgtatgccttgaatcctacgtcacatgggtcggcacatcctctatggaggtgtttgtcaaagtcattaaagaacacctgatgacgggtgaacgcgagcttgcggcaacgtcgtttctgacattcgtcgcgctcgattcaaatgggaaatcggtgcgcgttccgcgaatcgtgccggaaaccgaggaagaaatcatgcttcacaatacggccgtacagcgcgccggagaacgaaaaaaccgcttaaaacacagcaaggccctggccgaggcgctcggaacagataagccttggtaatcgtcaaaccgcttttttgaaaagcggtttttttatgctgaaaaaggacttttcctgccggatccataatctattacagggaaaggagacgtggcgtgcatgatgaaacataagtcttccggcaccatcctgacaaccgggcgtatccgtctgcggactatgcgggatgacgatgaagacaatttgtacgggctgtttaccgacagagaggtcatgaaatattatccttctcttaaaagcagacgggaaacgaaggaatggattgcctggaacaaacgattggccgcaggatacggcgtcagtctttggatcgcagaggataaagagacgggcgcatttctcggtcaatgcggaatcgttccgcagacgataagcggaaacactttgatggaaatcggctatatgtttgcccgccgccgctggggctgcggctatgcgacagaggcggcgaacgcctgtctggactacggttttcatacgcagcaatacggacgcatagcggcgctgattgatccggaaaacgctgcctccgtccgcgtcgctgaaaaaatcggcatggtgcccggtgagaccgttaccaaatgggggaggcggctgacggtatttgacatcacatctgacgttgaacgtttcgacgaaatgtagtatgatacgaacagacatgttttctagggttccgcatgttcatacatggcctggtccgagagaaaacacatatgcggacatatcccgcatatgcacacggagggaaaaaagcccgggagagtcaatctcatgtgagacgactattccgggctttttgtattgtccggaaacagaaaggatgaagaacatgaaatggggtttagtggttatagcggccgtatttgaagtggtatgggtcaccggcctgaaacatgctgattcagcactgacgtggagcggtacgattacgggaatcatcatcagtttttatctattaatcaaggcgacggacagcctgcccgtaggaacggtatatgcggtctttaccggactcgggacagcgggcaccgtgctcagtgaaatcctgcttttcaaagaacaggccgatccggtgaaaatcgtgctgatcggcgttttgctgatcggtgtcatcggattaaagctggtcacacaggataagcctgagacgaaggaggagaaggcgtaatgcattggatcagcctgatagccgcgggtctttgtgaaatgctcggggtcattttaatgaatcaatttcaaaaagaaaagaaagtcaagtggattctcttcataatcgtcggatttgcggcttctttttccctgctttcttatgcgatggagacgattgcgatgggcacggcctatgcgatctggaccggtatcggcacggcgggcggcgcactagccggcattcttttctacggcgagcagaaggatgcgaagcgcatctttttcattgcgcttattttgtgcgcagccgtagggctgaaaattctttcgtaaattgatttttatcaaattttcagtataatctataataagttacgaattatgaagatacgagggattaaaacagatgaattcatatatgacacagcggctgaaagaataccgccgcgggaatgaggaaaaagggcgcctgcttgtcagctgccccgatcagccgggaattgtatcggctgtgtccgcgtttttgtttgaacacggcgcgaatattattgaatcaaatcaatatacgactgaccctgaaggcggacgtttttttctcaggatcgaattcgactgcaagggcattcgtgagaaaaaagaggatttaaagcaggcgttcgcctcaatcgcccagacattcaacatgacatggagcctctctctggcaagtgagctgaagcgagtggcgatctttgtatccaaagagctgcactgccttcatgaactcatttgggaatggcaaagcggcaatatgatggccgaaattgcggtcgtcatcagcaaccatgaagaggcgaaagaagtggtcgagccgctgaatattccgttccattacatgaaagctaacaaagacatccgcgccgaagttgagcggcgccagcttgaactgctggagcagtataagattgatgtgatcgttcttgcccgctacatgcagattttgacgtctgattttgtatctgcccatccgaatcggattattaacatccaccattcattcctgccggcctttatcggcgctaatccgtataaacgggcttatgagcgcggagtgaaattaatcggcgcgacctctcactatgtgacggacgatcttgacgaagggccgattattgaacaggatattgaacgcgtcgatcacagagatcacgcagaggatctgaagaatatcggcagaacgattgagcggagcgtgttggcaagagccgtaaaatggcatctggaagaccgcgtcatcgttcacggaaacaaaacgatcgtatttaattaatgacggtccgccggggaggcgggctgttttttatggatgaaaatgtcttgacaagaacctgttttctttgcataatataaaaaaatcattgagcgttgaagaggatcagtacgcagaactttctgtgacagagagcaaaatggcccgctgaaacattttgccgcatgaaacctgccgaacctgccttggagtcctgaggggaaaactcaggcgcgatacctggcgttacaggaaagcgggacgcgtgaaaaacgcgttcaaacaaggtggtaccacggaaagcccatttcgtccttatttttcaggacggaatgggcttttttttattgacgagagccggtttggatttattgccacggaggagaaacgatgaaaaaacaaagaattgttgtgaaaatcgggagcagctcgctcaccaacagtaacggaagtattgatgaagcaaaaatcaaggaacatacggaagccatttctttattaaaagaaaacgggcatgaagtgatcctcattacctcaggcgcggtagcagcgggtttttccgctctcggctatccgtcgcgacccgttacgataaaaggaaaacaggcagctgccgcagtcggccagacgcttttaatgcagcaatatatggaccatttaaaaagatacggtctgacgccggcacaaattttattaacaagaaatgatttctcaaaaagagagcggtacagaaatgcctatgccaccgtaatggaactgttggagcgcggcgtcgtgccgattattaatgagaatgattccacatcagtcgaagagctgacgttcggtgataacgacatgctgtcggcgcttgtaagcggtttgattcatgcagaccaattaatgattctcacagacattaacgggctgtacgatgccaacccgaatgaaaacccggacgcaaagcggtttgactatctgaatgacatcacacctgaattgctcggatatgccgggtcagcaggctcaaaggtcggcaccggaggcatgaagtcaaaacttctcgccgcccagaccgcattgtcgctcggggtgaaggtgtttatcggaaccggctccggacgtgaaaaactgatggtgattttagacggaaaaggcgacggcacttatatcggcgataaagacctgtcctcagtgaataatacacggcaatggatcatgtttcattctccgatatcaggggaaattatcattgatgggggagcggagcaggcgatgatccataacgggtcaagtctactcccggccggcgtcgccgatgtctgcggcagttttccgaaaggagccgtagtggaagtcagagggcccggcggcattatcggcaaagggcagacgcagtactcatccgatgaaattttagaagccaaagggaagcggagcgaccagctttcaggaacgaagcaggtggaagtgattcacagagatgattgggtgaatttatttgacgagggggaacacaaatgagtgaagtattgcaaaaagcggctttggcaaaagaagcggctgccgaaatggtcatgaaaacgacggctgaaaaaaacgaagcgctccaatgtattgcagacggcctcagaaatgaacggcagctgattttaacagagaatcagaaagatattgaagcaggacggaacagaggactgacagctgacattattgacaggctgacgcttgatgaaaaacgcctgctcgatatcgcggacgccgtggaactgctaatcggtcttgaagatcccgtcggtgaatcattggagaccattcaaaaagagaatggattatctattgaaaaaatccgcgtgcccctcggagtagtgggcatgatctatgaggccagaccgaacgttaccgtagacgcggccacactctgtctgaaaaccggaaacgcggttgtgctcagaggaagttcttccgccatccacagcaacatagcgcttgtcagtgtgatgaagcgcgcactgggactgtcaaagcttccgattgatgccgttcagctcatagaagatacaagcaaagaaaccgccaaacagctctttacattaaatgacgggctggatgtattgatcccgcgcggcggtaaaaatttaattgatcttgtggtcagggaatcaaccgtacccgttttagaaaccggagcgggcaattgccacgtgtacatagatgagtcagcagatcctcaaatggcaagcgaggtcgtcatcaatgccaaaacacagcgtccttcggtctgcaatgcaattgaatctcttttgattcatgaaaaatgggccgaagaacacgggcgaaagctgctgaatcagctgacagaaaaaggggtggagctccgaggagaccaggtgatttgcggactggagcctcaagcgaaacaagcagaagaagccgattggggagcggagtacttggcgccgattctcagtgtgaaaacggtgcaggacgtacaggaggcggtccgccacattcagcagtacggcacaaaccattcagaagccattctgacggagaacgccgagcatgcggcttacttccagaccgccgtggacgccgccgccgtgtatcataatgcttcaacccggtttacggacggttttgaattcggatacggagccgagatcggcatcagcacgcaaaagcttcacgcgagagggccgatggggcttccggcgttaacatctacaaaaatcatcatcaaaggaaacggacaaatccgggtataatcttttaagcttatccttcaaaaagggtgagctttttttatgcggaaagattgacggcttctattatattttgtaaaattaagttgtgcacaatataacagaggtgaatttacatgacaaaaccattatttactgcaaccgtttcagccgcaggcggacgtgaagggaaagtcacgtcttctgacggggtgctgaatcttgatgttgccatgccgggaacgccaagagcaaaaaagctcgaacaagctacaaaccctgaacagctgtttgccgcaggatattcagcctgctttgacagcgctcttcaactcgtagcaagaaaagagcgtctgagtattgaaacagaggtcactgcgcatgtcagtctgctgaaagatgaaagcgaccaaggatataaactcggtgttacgcttgaggtcaaagcatccggcattgagaaacaggagcttgaagcccttatccaaaaagcgcacggtgtctgcccgtattcaaaagcgacggcgggaaatattgaagtgaagcttctggcagcagaataaaaataaggatgcccattcggggcatccttattttttgccgtgcagcgttttcaaaacctcataaagcgactgttttacctgctttaattcctcttttgacagtcccgtctgttccagcatggcaatggggatatccgccgctgtattctgcaagacccgtccttcatctgtgagcctgatcgtcacggatcgctcgtcttcagccgaccgctttctcatgatgattccgtgctgctccatccgtttcagcatcggtgtcagcgttccggaatccaagtgcaaaagctcacccatccgtttcacattcagttcttcgtgctcccataataaaagcagcgtcaaatactggggataagttacgttgagcttatcaagcagcggtttgtaccgttttgtcatttcccttgagcttgcgtacagcaaaaaacaaagctgattctccagtttcatatgttcaaaatctttttctgccattacttctttcaccaactcttttttgttaacgttacccctattgtagccgaaaaacggcccatttcctattgcaatcatgtttaaaaatatgagcaggggcaatatatacagtaagtacaatgaggaggctgataataatggcattatttacttcaaaagcgaccgcagtcggcggacgagcaggacatattaaatccgaagacggggtgctggattttgacatcatcatgccgaatgcaaaaaaagacggagaaaccggcacaaaccctgaacagctctttgcggcaggatatgccgcctgcttcgggggagcgcttgagctcgccgcccaaaaacaaaaaatcgacatgacctctgaaattgaaggacaggtcagccttttaaaagatgagagtgacggaggttacaaaatcggtgtaacgctcgtcattgatacaaaagatcttgataaagaaacggcggagaaacttgtgcacgccgctcacgagttctgtccgtattcaaaagcaacaagaggaaatgtagacgtcaaacttgaattgaaataaagaaacgaacgaatatcccggatttcatatccgggatattttattaacgaaaacatcagtaatgatctcttctctcccggaataagaatacgatatagcacttttgcataatgacaccaagagaaaagagggagaaatcgatgtctcttccaaacataccgaacatcacccccgacattacactctccagatgtgagaccctgaacctccttctttcatccgtggctatggaagaaatcggactatcccatattctgcaggcggaagcggaaaggattcaaatgtttctcagcgcttccagcgatccctccttaggggaattatcatcaatcaatagaagcactgaacggctcctgcgcaccgtcatgaaatcacaactccttttgcagacgaagcttgaagacattatctacttacaggatgctgaagcctgtatagaaccggacgatccaagtaatccaagtgatccaggcgatcctgatgacccgtggaatccggatgatccaagtaatccgagtggtccgggtgatcctgatgacccgtggaatccggacgacccaagtaatccgagtgatccgggcgatcctgatgacccgtggaatccggacgatcccagtgatccggaagatccgtgtgacgacctgttttacggccgcattggctgctgtgagtgcggggattgtgaggaatgcgattggaagaaaaaaggcggggagcgttcataaaaaaagacgggtgaagcatatgccgtatccaagcatctcaaaagcgaaacagacatcttttgaagccttgcattgtctcacgatggcgctgttaaatatattatctgtgaccgtggataaaagaaggggttcaaattacaaagaagaaatcaggctgttctccgcattgtgccgctggcagatggaaacaggcggccggctgtttttaatgatcagcttggaagaagaacagaagcagatgtatgagcggcactttcatgaaatgaagacagtgacggaacgaacgaaaaaattcatttttgaaagcccgcgcgaatttcgggcgcatcccattacgaagcgggctgtcaggcagcttcaggaatgggatgcagaatcaactgccgaacctgccgtcagatgggtgcggcctgtcatcataacgatgaacggcactcctgaacggccttggttcaatcaacaactccaaaatcgggaaaggtgagaaaatgagcggaaatgctgaatgtaaactgactctttgcatgattgtgaaaaacgaggagagatacatctcccgttgtttatcaagtgtacaagacatcgctgatgagatcgtcatcgcagacaccggatcacaagataatacaaaagatatatgcaaaagctttcaggcaagagtgtttgatttcgaatgggagaatgatttcgcaaaggccagaaattacgccctgcagcatgccgaaggggattggattttagtgcttgacgcggatgaagagctcgatcaggagacgggccgttttttaacttcgctgcttcatgacggattaccgagccggggacttttgaaaatcatcaattatacggggaagcagctcgatgaaaacgaagcgtttgaaagcatgcagccgaggctgttccgcaatcataaaggccttctgtatcaaggcagaattcacgagaatatctcggctcccaatgaggaagaaaacaatgcttttttcacgctcccatgtgtgattcatcactacggctacttggagcaggaagaaaaaatcaagcaaaaacataaacggaatatcagcatattaaatgaagaactttcagaggaaaatcctgatccgtggctagtctatcatttggcaagtgaatgttacagaataaaagactatgaaaaagcattacatcttgtcaacggctcgatatttcaatttttaagtgagaaacgaatgcctccgtctcttctgtattttctaaaatatacaatattgcttgagctcaagcgatatgaagaagccgaacaagggattgaaaaagtgctcaagctttatcctgattacagcaatcttcattattataaaggccttgtattatatcatttggaaaagtacagagcggcaatcaaagcatttgaagccggaactcaggttgaaggagaaaacgctgatcacttcattttaaaaggtgccggcgatttcagagctttttattatatggcgaaatgccatgctgcattaaaccatgatatgacggccatcgcttacgccaaaaaatccgtgaagttcaatccgcaatttaaacccgcgcaagaacttctgtctcaattaaaaaaggatcagcggacaaacgcctgatccttttttttgcatgttccattaagataatcgaataatgtttaaagctgcgccggcacttcctccaagcaatgtggccgcacccaataatccgaacagctggagctgaatggtgctgcctgctgtcaaagtcacaataaaggagttattgaagtttgccaaagacgcgaccggggcaataatcgaacttgcagccggagtgccgttgattaagatgcgcgaacttactagcaggccggccgttaaattaatatggtaggaaatatagtaccgtcctgccggagcaacggtgaatacagtatttgcggcattagcggtaatatccgctgagaggttttgttcattcggtaaggaaatggccgtgccgccgttaataactgcgacaacaccgccgcccgtattgctcgcatagccggaagtggctgtcagacttgttccggtgcttcccggaggccctgtaatgccggtagccccggtaacaccggtcggtcctgtaacgccagtaattccagttgatccagtaccgccagtaaccccggtaactccggtaggtcctgtggagccagtagcgccggtgcttcccgccgcagctaaaagtgtatagtcagctgaggtttcaggggttcccgacgggctgtttacgtttgcgacataagagctgccgttatacaagacaacctgtccggtcgtgtaagtaggggcggtcagcggattaaaagcaacaatcccttgaagacccgcaccggtgacccctgtcggcccgatcggtccggttggccccgtcgctccggccgggccgattgctcccgtcggccccgtggcaccagtcggccccgccagtgtagggatatttgagatactgtccaattttgaaccgagaagaagctcctgtttcattaagctgtcaagcgtatcccggacgctctcattcagattaagaatatccgcaagacttgacgggggtcctgttaatccgggaatcgttccgagcgcgtactggattttttccccttccgcattcagaatatgtgccattcccagctcttccatagcaattgacgaaagaagaaggttaatggtatcgtctctggaaagtgtaacgacaggggtgatattgggcaaattaggctgtgacacaatgtccctccttatgagttggctgaaaatcattttattacgaacaaagttcccccaaatgagcgtaagcagtactgtatcattatattcactgattctgtccaagtttctgaacgaattctcttcattactttcatcatatatgaaggaaatactttaaatatagagaaaatacatcgcacagcattcgcaaatcggtcaaaatgacagcgggacatgtgatcgtctataaagcgatggctatatatcttgtgcgtttcctgcaaaaacgctctttttcatttcaagttttctgtataaaagggcgagaagcatggacggtatcgtacaaacaatcattccgataaaggcataccggggttcaatttcatataaaaaacctccgaaaatagtaaataccgcagtgctccagctgagagcaagcgctgaatatatgccttgggctttcgggatttgcgcgggtgaaatatttttaattaagtatttcataaatgcatagtgtcccatcgcgaatgaacaggcatgcagcgtctgcgcaatacagaaaatgatgacatgcggaaaggcaaatacgagtatccagcgtacggtagcaccaagcgccgccagggcgagcaaagagcctgccgtaaattgatgaaagtatcggtcagcgattgcaaagaagataatctccgcgataacggcgatgttgatgatgattccgatggcatatgcgggcgcatcgatttcctgcaaaaagagataaccgtaattgtagtaagatgcatgtgccgcctgcagtaagataacgattgcgagcaccagaccgaaatatttaatgcggaataaggcaaacatgccctcttttcttgcacggtctgtttccggccgttttgaaagaacagctggcgcatgcataaagcttagggatgcgaatatcagggtgcccaaaagcagtgcccaaaagcagtgcccataaaatcgcttgatctccgaatatacctgtaaagacggacaggatgacgccggctgaaacaaaacccgcggatccccactgtcggctagtcccataagcctttaattcgttatgctgtacaaggacgccgcaagcgctgtctaaagcaggcattaaagccgggtaaaacacatgcagcactaatgtgacaagaagcaggctttgaaaagaatcagccggaatataacataaaagtgcgagaagcgtcccgattctggcgccgtttaataaggctttgctgctgaattttcctgataaataagggaagaaaaataatgtggaaatccctcttgccgccaggcccagactcataatgaaactggcttcggatacggaaaccccttttatatgcaccatccatcccgtccaatagggcagaaaaacaccccatgtcataaaaaaactaaaaaaatgcagactcatccagcgatatgctttcattcccgttcctcctttaattggcatgttatcatgtaaggacataaagacaatatgagatatctcatatttttggggtggacgatggaaatttataaaggcgagaaaaagcggcatcagttaaaaaaacactcaatcgcgcatttattctctttccccgctgaagagtttatggaagtgcgcgaatatgagcgggacgaatggattattcaagagggcaggagacctgacttcctgttttacgtgattgaaggaaaagcgaaaatatatgtaacccaccaaaacgggaaagtctctttaattaattttatcaacaaaaatgattacatcggagagatggaactattacatgaagggtattacacaaaaggaattcaagcctcagcgaagactgtttgttttgctctgcctatttaccgctgccgcgcgcaattgctgcaggatgcgaaattcctgcgtgagctggctaagtttttaagtgctaaggcaacgcttatggcttcgaaatattcacaaagtctggcgttcccgcttgaaaaccggcttgctgattttattttgcagacggcttataaaggggtttataaagagaagcacgtaacggtctgtgattatttgggtgtatcttaccgtcatctcttgcatgtgctgacgcaattctgccaaaaagggtatttgcaaaaagaagggcggggctatcaaatgaagcagtatgattcattgtacgaacttgcagaagcgctgcataataagtagcacgccagaaaaacagccatccgcaaattacggatggctgttttcattatacaagctgagcttgtttttttcgtgcctgtttcgcggcgtcgaccatattttttaatgccgcaacggtttcttcctgctgtcttgttttcagtccgcagtccgggtttacccagaagcggtcagtcggacacacttcaagcgcgtcatcaataatttgatagatttcttcagttgccggcacacgcgggctgtgaatgtcgtatacaccgagtccgaggcctttcacgtaaggatgttctttcaggtactctaaaaatcctccgtggcttctgctgtgttcgattgtaatgacatccgcgtcaagatcattgatcgtatctacgatatcttcaaagttgctgtaacacatatgcgtatgaatctgtgtctcgtttcgcacagaagatgtcgttaaccggaatgcttctgcggcccaagttaaatattcatcccaatcctgcgtttttaacggcagtccttcgcggagcgcgggttcatccacttggataatctgaataccggcatcttcaagcgcttttacttcttttctgagggcaagcccgatctggaaggcgatttcttttcttgaaatatccacacgcgggaatgaccagtttaagatggtgacaggtcccgtcagcatgcctttcatgtgtttttcagtcagcgattgggcgtagaccgtatcttttaccgtcatcggttcgataaattcgacatctccgaaaatgacaggcggacgtacgcagcgtgaaccgtaagactgcacccatgcatatttcgtaaaggcgaatccggccagtttttcaccgaagtattcgaccatgtccgtccgctcaaattctccgtgaacgagcacgtctaagccgatttcttcctgaatgtcaacccagcgcttcgtttccgcattaataaaggcttggtactgttcatccgtccaatcttttttgcgccatttttgccgtgcgctccgcacctcggcagattgagggaagcttccgattgtcgtcgtcggcagaagaggaagaccgagtgattcattttgcagcgccaatcgttcttcaaagcttgccggacgggagaaatctttttccgtcagctgattcagctcttctttttgagctgagttcgctcctgttgcgaatgcttttaaagccttaagtgccgcttttgattcttcgatctgctcactgacggccgcttttccggacagaagcccttcttttaagacgccgagttccgccagtttttctttagcgtatgacaggccgttcagcaaatccttttcaagatgctcgtcagggtgtttcgccaccggcacgtgcagaagactgcttgaaggctgaatccataactcctcaacatcagcgtggctgaggatatccaaagctgcatcaaggcgttcttcaacatcgattttccaaatgttccggccgtcgaccacaccggctgccagcactttatctttcgggaagccgtgctttttcaattgctcaaggtttctgcctttatcatgcacgaaatcaagtccgattccctgtacgggataagaaacgagttcttcatatgcatcaactgaatcaaagtatgtctgcaggaggacattcagtcctgaaagctcttttgtaatagattcatagaggtcttttgcggcgcggacatcttcagaagaagctgtcacaagggcaggctcatcaatctgaacccatttgacgccttctgcttcaagctctttcagcagctgcacataaagaggaacaaggcgtttttgaatcgctttcgcttctgattcttcgtatcctttcgcaagcgtgacgaatgtatacggaccgacgatgacaggtttcgtttccgctccgaattcttctttgatccggcggtagtcgtcaagctgtttgtttctcgtcagacggaattcaatgctttcatcatattcaggaacgatgtaatggtagttggtattgaaccatttcgtcatttcactggaaacggcgtcttttacaccgcgggcaatcgcaaagtatgtatcaacgggatccgtgatgctgcggaatctttccggaatccagttaaagctgacggcggtatcaagcacatgatcataatgagtgaaatcagagaccggcacgatatcgatatgttggtcaagctgtgttttgacagctgataagaataaaccgtcaagctttttaagaaacgtttctttatcagtgtttcctttccaataagcctcaagtgcttttttccattctctgttcaagccgattctcggaaaaccgaggttcgaagttttgattgttgtcattaagtctcctcctttaagtgagatgtaacaaaaaagcctctttctcatgagagaaagaggctttaacttcaaaatgcaagcctctcttatctctcagatcacgtctgatggaattagcaccgtgccttatgagacaatcgtctcggcgcaaaaatcacgcgccccatttcacaatggaattacggtcggttgctgttggggtcaaaaggccaatccctcgcccaactctcgataagagaaagtatttcaatttttttgaaaagttacatcatttgttggttatcttatcagcttattcagatcactgtcaatagaaaatctcacaatttaaaaattggtgatgtgacaaactgatcaatcattatacgagaaaaatatcagaaagacagcagctgtgcctgttcggctctttccatcagtacttcaggcgcgtctaaatacagaaatccgttcccggccaatgttttggcgatgtccaaaggaagggtccgccgcacgagctgggcgtagacttcagcctcagaaagcgtccgctgaaacgcgtcctgttcaagcccttttattaaggcaagcgctccgctcacatgcggggcggccattgaagtgcccgtcagcttcccgtatttatggttgggaagggtggagagaatattttctcccggagccaccaggtcaatctctttattagcgtttgaaaattcagacgatttacgggcgattgagactgatccgactgcgatcacttcgttgtaagcggccggatacgacagttcctctgtacgctcgtctccgtcgccttcgtttcctgccgcgcaaacgaccagaacaccgctttttaccgcatttgtgaccgcttctttcagttcaggcacatcgcttggcccgccgagtgacatggaaataatgtccgccttttgttcaacggcgtagttgatgccgttaataatccattcgtatttgccgctgccgtttttcccgccgagaactttaacgattaaaaggcttgcttccggcgcgacacccgaaattccgccgtttgaatcattggctgcaatcgttccggaaacgtgtgtcccgtgtccgttgtaatcggaaatcacgtcttctttgcctccgtcatcatcggtgaagtttttcccgccgacaatccggtctttcaaatcaggatgattgatgtcgcagcctgtgtcaagcaccgcgattttaatatccttgcctttaaacccttttgcccacaactctggcgccttaatcactttaatcccctcaggaagctcgttcacatccatgatctgttcatccgtgacataaggaatcaaatgcatttcaccattcataaaaaagccctccttttttatgcttgcgagtggatacaagggtgttgctactattttatggcagagcatgccggccggaaagagtcatttgaagcattttcataaaaaaggcgtaatctatcggactaaaaaatttcaaataaatggatagtttgacagctttcattttcattcatgacccgctgacgctataattggaaatgggaaaggagaagagagatgaagataaatgaagcgttatacagctatttttcagaacaagtggatcaaattgcgaaagagtggatcgaaacgatggaagattcggatccgaattcgatttattctttgacaaatcccgtcatcacagaagaactgacggagcaggataaagaattttaccggcatattaataaaatgtatatcatgccggaaaaagaatttttagaagagttcgagcggtgggtgattgagcttgcgaaagaccagaagcatctggatactcccgtccagtatgtggtccgtgaattcatgagaaaccggagactatacatcagttattatgatgcgtttgccgataaacatgaatcttcgtttgctcagggagaaaggaagaaatgggagaatttaattacgcaagtatttgattttacgatttacacgtttgtcgatcatgctgagcataactcaaaaatgcagctgaatgcgcaaagagaaatgattttggagttaagctcgccggttatcacgctgagcaaacggacggcgctgctgccgcttgtcggcgatattgacacggagcgcgccaaattcattcttgaaaatacgctgagcacatgtgcaaaacggctgattgaacatctgttaattgacctgtcgggtgtagtggttgtcgatacgatggtggcgcatcagatttttaaattaattgaggcgctgaaattgatcggcgtcacgtccactttatccggaatcaggccggaaatcgctcaaaccgccgtacagctcggcattaatttctcagatattacggtcaagtccaatctcgctcaggctctcaattatcatcaataacatacataacaaaacaggctgccgaatcactccggcggcctgtttttatataaacaacaatgaaatgagccagcttgccccgaataacagaagcacgagcaggaaaaagcaccagtcggcgcggcgcacagtaacagttctgtaaaacgtgcggtttcggctccccgtaaagcctttagattccatcgcgatcgccgtgcgttccgcctttctgattgcgcctgccaatagcggaatggtgaagcgcctgaaggcggagagcttccctttcagcccggaatcagacgccgcacccctgattctgtgcgcctgccggatgatcaggatttcatctttcagaagagggagaaaccggaatcccgcgataacgccgtatgcaagcttgggcggcagcttacactgctgaatcagactgagcatgaacagaatcggatcggttgtaaaaagaaacatcatcgacaaagcggaaaaacatagaatacgaaacgcgatagaaatcccgagcgccgcgttatcactgttgacggcaatcggcccgagcttaaacagcagattgcttccggttgtcgggacgtttccgaatacggcggctgtccataaagaaccgaaggccagaatgacaaacggaatcgtgaacagcagccattttttcagcggcacacgccccgccgagaggacgcctcccgcaatgatgatataaaacaaagcaggggtgtacggattataaataaatgacagcataatgacgcataacaatacagccgccgcctttattgacgggttaacagcctccagccgcaagttcatttctccgcctcctgtcgtgtttcatccattcataccgcagcggcaaagccaaatgtgcctgctcggcgatcccgatgttatcagaaaacaaagcgtcgggagttccccggaataccagtttcgtgccgcagagcacaaggatcgtgtcggcataatccgagacgagttccatatcgtgtgtcaccatcaaaacagccgttccttccttttgaatctcacggagcatttgcatacactcccgcgccgttttggcatcctgtccgaaagtcggttcatcaagcatcaaaacgttcacattgtgcataagcatcgtcgcgacgctgagccggcgtttttgtccttggcttaaagaaaacggatgctgtgaggcatggcgtctcaggccgaatcgggttaacagctgaagagctttctcctttgcggctctgttgctttcaaaactgaacatcagctcttgaatgacggaatctgtgacaaactggtgttcaggattctggaaaacatatccgatctgccgccgcagctctttttcagaataggaatcaatcggtctgccgtctattttgatgtctccgcccagcggacggatgagcttggccgcagcagaaaggagcgtggattttcctgttccgttagggccggcaatcgcggtgattgatcctttttttacggaaaagctcacatcctgaaaaatgacgtctgctcctcttgagaatgacagcccgtgaacgctcagcgcgtcttctgccgaaagcgcaacgggcctgggttcaggcagagatggtacaggttcgtgaaacagattttctttacacaatgtaaaaggaatgctgacgtgctcctgcaatgagatcacacgcggaatcggaatgccgagctgcatcagctcttcaatcttggtttcaaagataacatccgtctctccgtccatcaccttctgacccgtttcgtcaagcacaatcgtcctgtccatccacggcgcccagtgatcaagctgatgttcgataacgagaaggccgaagcctttttttgcttgaagatctttgatcagccgcactaattcacgtgcggaatatggatcaagctgtgccgtcggttcgtccaaaataatgagttccggttccattgcaatgatacaggcaagcgccactttttgttttgaaccgcctgacagcgaagcgatcgttcgcgttttcagatgagtgatctctaatttttctaaaacgtcatcgatgattgcgtccatatcttcttttgtatattgcaaattttccaggccgaaggcgatttcatcttcaaccgtcagcatgcaaaactgctggtccggatcttgaaacacgacgccgatggatctggcggcgggttctgtcagatgtgaaagaggtgttccgtataaagaaacggttcccgattgaaccccatcgcatgcttccgggtacagaccgtttaaacagagagcgagcgagcttttgccgcatccgctcggcccgagcaacaaagcccgctctcctttgcggagctgaaaggacacgttttgaaaaatcggcttttcatcctgatcataagaaaaggtaagacagctggccgatagaaggggttcagatgcctgcatcttggttcacctgtttctttttcttcttgaattgttttccgagcgccatgccgttcagcactcctgtgtaagccagcgcatcactgattgctttgccgagaaggccggcaagaagcgcacctgagaccagacggatgagaagcatgacggctaataaacccggattcaaaacagagtatccggaaacgaacaagtcataaatgaagcttgtcacagaagaccccataccggataaaagaagcacgggcagggtatacacccgccagcgtgtcgctaaaaagaccgcttccgcaccgattccctgtgcgatcccgatcagaatcaccatcggtcctgacggatttccgagtaagcactccacaaacgcggcgatgatttcagaaacgagagccgctcccggtttttgaataatgtacgcggcaatcaccgagacgataaaccagataccgtaaatcggttcataactcatccggccgaaaaatcctgccgctatattgcttgcatgagttgatactaaataaatgacagcaaatacaacactgatgacggacatgacgacaatttctctcattttccaatttttcattgtgatctcctgctttcttatcggatagttgtttgtatgaaagagttgattttacgaaagacgattgatcgtaagtttcatattgcggtgtcctcccccgttttttaatgaaaaataaaaaactgcatatccgagggaatatgcagcagcagaacgaaaacgcatggggaaaaaccctgcgctccggtcaatctgcacttccccacgctggtattatccagatcgggttataagggatcaaaacacgcttgccgcatgttttatctcagccgataacagcacccctagtgcgtttcctatacagttttttatgatgacatcatcatagttgatcatgtctgatttgtaaacagcctttctccgaacagagtttggaatcggaccggaggatcattcataaagataagaagaccccttttgatcaaaaggaaacggaggacatctatgtttgttcatacagtgcagtctggcgactcgttattttccatcagcagaaagtacggatatcctgttgacagcatcagaagcgtcaacgggcttgaggaaacgaatatcgtgccgggacaggcgcttttaatcccccttaatgaatatacggttcagccgaatgatacgtatgccgttatcgcaggtaaggcttatgtgccgcagatgcagctgatgcaggcaaacccggatattccgccgaaccggctgcggacgggtatgaaagtgaagatccctgatatctctaactatcttgcgggaaccctgcaattttatgtcattcggacgcctgaagcggatagagagctcattaatgattttgcaccctattcatcggcgatttctttgtttgaatatcatttcggcccgaacggagatatcatgaatgatttaaacgacagaaccgcaatagaaaccacatggcagaacagagtgcgcccgcttgccgtcattacgaatctgacagaagggggattcagtccggaattagcccatcaagtgctgcaaaatccggcggcaagaacgaatctcgtcaacaatatcgtctccttaaccgtaagaaaggggtacggcggtgtaaatatcgattttgaacgggtcagagaagctgacagggatctcttcacaggatttctccggcagttaaaaacccggctttcagagcatcagctcgcgttaacgatatcggttccggcgaaaacaagtgatgcagtgccgtggctgaggggatatgattacggcggaatcggagccgtcgtcgattacatgttcattatggcgtacgactggcaccacgccggcagtgagccgggacccgtggcacctttaacagaggtcaggcaaacgatcaattttgccatcagcagggtgccgagaagaaaagtgattctcggtgttccgctgtacgggtatgattgggtgattccgtaccgtccgggaacgatcggatccgccatctccaatcagcgcgccatggaaacggcgatgaagcatcaatcaatgatccgttattcccagcaggagcgttccccttacttccggtatactgatgaaaatggaagaacgcatgaagtgtggtttgaggatgtacggagcatgagtgaaaaaatggttctcgttcgggagttcggactgcaggcgatcggcgcgtggcaattaacgctcggtttcaaaccgggcccgtggctgcttaggaactttttcacgatccgaaaaatatagctgcatgtccttctccgcaagtgattttttctttcctatgataacggagcttcttttggacaatctaaaattgaaaaggaggtctgtcatatgaagaaaagggaagagcagtatatcaacgaggctgagtatgtaccgcacccgacgaaagaaggggaatacgcgctcatgctgcatgaatcctatcatttcctttcagaagaggatgaaagcgatttgccggaataagggttttatgcctttattccgtttattttataggcatgtgctgaaatcacaaatttaaggttgacacattccttttttttctgtaatctcagtgtgtcaattcaaataagaacttcgttaggtgaggctcctgtatggagatacgctgctgcccaaaaatgtccaaagacgccaatgggtcaacaggaatcatcgacataaggtgattcttaacgcagctggatggctgtcctatgccatacagtgctaaagctctacgattggaggccccgcacgtttatttgccgtgcttgttttcgccttcatatcggaaggttttttttatgcctcaaaacgtacacgactgagcatgataaggaggtgcggagtatggattctccccattcgagtatgtcagaagaagtacccatatacagccagataaccagtgacgacatgatgaggagacaaaccgccgcacttcccttgacggacggcgcgtctccgtaaaggaggtacgagtcccgatggtccaaaacatgacctatgacgaactcatattacgcattatcattttattgcgggacggaaaaataaaagaattccgaaacatgatagatgagcttcagccctatgacatggcatttttatttaaagaaatgccggaaaagcaccgggcccgctatctgtcatatatgacggttgatgacatcaccgacatgatcggagagctggagcgggaatttcagcttgccgttttgcataaagtcggtaaaacgaaagccactctcgcaatgaataaaatggataacgacgatctcgccgctttgctggaagagatggatgaagaactgaaagaacagcttttatccagcatggaggctgaggaatcaaaggccgtacagcttttgatgaactatccgcaagaatcggcgggccggatgatgacgaaccgcttcgtctggattccgcagcattatacagtaaaagatgcggtcgtgaagctgaaaagctttgcggaaatcgcagaatcaattaactacttgtacgtgattaatgacagcaagcagcttgtcggggtgctctcttacagagatttaattctcggcgagcctgacgataaagtgcaggatctcatgtttacgcgtgtcatctcggccggggtgctccaagaccaggaagaagtcgcccggctgatccagcggtatgactttttagccattcccatcgtggaagaaaataatgtgcttgtcggtattgtcactgtcgatgatattatcgacgtcgtgatcaaagaagccgatgaagattacgaaaaattcgcagcctccggtaaggcgattacatttgatacgaaagcatacgtggcggcgtacagacgtttgccgtggctcattctgcttttgtttatcggattgatttccggaagcattctgaattattttgaagatacattgcaaaaagtagtcgccctcgcgtttttcatgccgatgatcgcgggaacgacgggtaatacaggcacacagtcactcgccgtcgtcatcagaggactggctaaagaagaaatgaataaaaaaaccatctttaaactgattttccgtgaattaagaaccggtatctacatcggcatcgtctgtgcgatcgcgataacgattgtcgcaaccgtctggcagaaagacttaacgctcggttttgtcgtcggttcatcgctgcttgcaacgttgattatcggtacgatggccggaacgatcgtccctattattcttcataaactgaacattgacccggcgattgcgtcaggcccgctgattacgacactgaacgatattttgtccttattaatttatttcggcattgcaactgcatttcttcatgctttataaaaaaagtccgtctcacaggaggcggacttttttgatcagcggtttttatacttaaaatgagcattaagctgtccttccagcatttttttgcggagctgtgggtcgtttttgagagcctgttctttttttcgcatgtcttttaaaatctcggccgtctgcacgccgtcttcccgtttgttggcaatatccatcagccgctcaacgtccgcgaaggaatactttctcgttccccgtgatgatcgctgcgggtagattaatttccgttcttcatagtatctgatctgtctgactgacaatccggttaattcgcttacaatgccgatcgagattacttttttatctttgtaagattgttcgtctgtcgtcatttttccacccctggatgtcttttactcatattatataagaaaaaaagagaaaaaacctgacgcttgtcaggttttctgacgcggaatagaaaattttagaaaaaaagcggcagaaaaattgacaaggttaatgcatggtcctgtgccccgttttattctgtattatacagacacaatgaggaggaaggataggaatggagaaagaaaaagcggtttcactggcaaaagaaatcattgaattagatatgaaacgcgatgaaatgctggaggcgttcatgcagcttgccggggaacacgcttttccgctgctcagagccgtccagaacggtctttaccgaaaaacatcataatctacagaagttttacaatggctttatacatccttgatataaaagcgttattctgatcatagaataacggaaaacaaaggaggccgtcatgagtcgtttgcttcaaaatgcattggataaagagagaaaccattattccaaaaagcttctgcagatcggagtctatacgaaagaaatacttaattccatgacaattacggagctgagaaaggaatacgcgtatttttttcggaacattccctataaagaacggaacccttatacaaattaaatgatgtataagggtatttttttatataaaaaagaaggaattctgaaaaacggcacgaatagaatataaaacaaagaacgactcttatgaattgtaagggtttacattatttttttataaaaatcttaaatacggggtagatatgatgagattatcatttaacgaagaagaagtgatgcgttcgatgaatttgtacaaagtttttgcaagggctttcaagagtgtgtctgaacacagcatccgcgacagtaaagaacacggttttaatccgactgaatttgccgttttggagctgctctatacgagaggaccgcaaaagcttcagcaaatcgggtcgcgtcttttgcttgtcagcgggaatgtcacctatgtcatcgacaagcttgaaagaaacgggtttttggtcagagaacaagacccgaaggacaaacggtctgtttacgcccatttaactgataaaggaaacgagtatttggataaaatttatccgattcattcattgagaattgcgagagcgttttcaggacttatgcctgaggaacaggaacagctgatagccttactgaaaaaagcgggaattcacagccagcatttgcttttccgttaaaagaaagcggatacagacactcttcttcatgaagagtgtttttttctgtttcggacagtagagcctgacgcggtttttgcataagctgatacagggcggcatcattatttaccaatcataatgtgacatgccccatgccaaaatatgagggtgctttgaatataaagaaggtgaacatgtgagaagctgtctgctgtctatatggtacttacttgatccgctttatttcttctttacccggctgacgctgattgataaacggcaatcgaatgtattccgcgtccgtttgactagatataaaggaaaagaagtcatcctgagcgacggaaccagaattaaaaaaaacgacgtgttagttaagattcatcttcataatgtcaaactcctgaaagagctgcagcctattgaaagcgcggtcagaagggggattatgctatatcagaaggtatatcaatccatgcctcatttagcggattatattaaccggcataaacggaaagacgagattaagggagtcgtcggcattacaatgcttcataaaggagcggcgagactcggttttgatgtgataaaaccgtccagcggctgctacaggctgtttaagaaagcggcccatcttccgattttatactttactgcaaaacagctcaccctcaaaaacattccttactcctgctatttatttatttccaaagaaaaattgatgtgcacgtatcagactgaaaagagctgacaaaaagcgtcagctctttctcttgatttgctcaagcacgattgaaagcgggccgtcctgcggattccggtaaaaatcataaaacggatctccctctgtcctgacgcggttcactactgtatcgatcgtataatcatcaggtgttaaagaggagttgacttcgctccaataaaggggagccgcaaccgttcccaattcgttgccccgggtcgaatagggggcgataatggttttcccttcggcatgctgcaaataatctaggtagagcctgccgtttcggtttttgataaaccgctctgtcgtaaaaagatccgggcgcgtcctgacgcaataatcggcgatgagcattgtgaaggcacgggtttcttcataggtgaatgcttccggtgaaagcgggatgtagagctgaatgcctttatttccggagagcttcgggaatgacgtcatgctgaatgagtcaaacagctgtttcagcacatgcgcagcctctactgccatgggaaaatcattccttgacggaggatcaagatcaatgacgatttctgcgggcctttcagaatgaactttctgaaacggaacgtgaaattcaagcgccagctgattagccagccatagaagtgacggtatgctgctgcatacgatgtgctcgtggctcccgtcaaacacgcttgagacaaagtccggcgtgtagtccggtttgtttttttgaaaaaaagattcgccaggcgcgccgtgcggataacggatcaccgtgacggcccgatctttaagaaagggcatcagaaaatcgctcatttttaccatataactaaggaaatctgctttcgttttttcacgttttttaaaaacgatcttatccaggcttgtgaactgcagcttcggcggcagcgttttagagcggaggataagctgctgatacgtgcattccgtccaatccatttcaaactgaaaggacacaaaagatacttcacgcagcgtgtcctgcaatatggttaaatactgcacggtcatgcagatagaaggctcaagtgtatactcgccgcttttttgtttttttccgtgggtctccataatggttctgacggcgtttttttcttccgcctgcatgccgtgggaaacggaagcgatcgggacgacgatgccgtctttcaaaacagaggccgtcacatacccgttcttcggattgaatccggttaatagcacgtgagccgttttcatatgtttatacttctgccagtcgggagaccgtttattttccgaccagccgctggaagcccttttggctacgataccttctccgtcatggcggacgaccttgtcccaaagcgcattaaagtcagtgtgctccggaatgtattgaatcgcttcttccgctaagtgatgagggcaggcgggaagatttgcttctttaagcagcttggaaagggcgcgcttccgtttcacatacggtaatgagacggtgccggcgccttccagaacgaggagatcaaatgccagaaagcggcacggccgtctatcagcggtgctttcaattgcttccgtccgttttaaacgtccgcggatttgaagatgctcaaagtccgctctgtacggattgattaaatagacaagctctccgtcaagcgtaatggggaacctgtctttcatgtgctgaaaacaccgggccgcaaaagccgtgatttccggaaattgattcgtcagcgtctgtccgtttctgctggttaatgtaacaccgctttcgtctatgcggagaagacagcggaatccgtcatactttacctcatagcgccactcgctgccttcaggcggtacagaggtcaaaatcggctgcatcgtcagcaccatgattaagacgttccggctttttgtctggtcgtcttctgctttttgcctccgccgcctgctgacgctgtgtcttttgtccgtgccggtgcagcctgttcgcgattcggccgcttcgtccggtcgatgcttgcctgaagcgcgctgacaagatcaatgacatcttcgcgagggccggcaggagcaggtgtcacgcccgcttcttcatgttcgagcttatcgttaattttggcgagaagggctttccggtatgtgtcttcatattgttctgggtcaaactcggttgtcagctcattaattaacgtgatcgccgtctgcagctctttttcattaacggctgtctgctcaggaacgcccggcacatgtccggcatttctgacttcatccggataatgaatggattccatcacgatgcagttgtcatacacgcgaagaatcgcaagctgctgtttagagcggatcgtaatggaagcaatcccgattttacccgtcgtcctcagcgcttcccgcagaagtgtataggcttttgtaccgttgtctcccggcccgacataatatgaccggttaaaataaatcggatcgatttcctgcagctggacaaagtcaacaatctcaaccgctttttcttcatgttcctgttttacgtctttcaagtcttcgtcagtcataatgacgtatttcccttttacatactcatagcctttcacgatttcatcaggctccagactcttttcacatccggtgcagattttttcgtatttaatcggcgcatggtcttctttatgaagactgcggaattttatatctttatcttcagtggccgcaaagagcttgaccgggatattgacgaggccgaaactgatcgaacccttccacatcgtgtgcatgaataaaaactcctttttgtctttattgtggataaacgggtccgttccatgtgtagcaacttatgggtgatgcggcgcttcatggagctgctgttccatttcctcatgcggtaatggccggctgaaaaggaaatcgcattcttattcatctatttacaatcagtgaatcggtaagttctttaaagcgctgaagtccccgaaaatcatcaatggttgatcaaaaagattatacagaatcattccccgggaaatgcccacacatttccatgtagtgactgagagtttcccgctcccataaaacagattcggtggcaaagatcccggcaaaaacgcattgcccatatgaactgaattcgcggtcagccgccgcttaccgcgaagggtaacttttccggagatcttaagtgatgtaaccgccgccagacgagcaatcaggagacaggcgggacgttgtattgcgcatgtcattccctcccgctataccgatctgaaacgactcacatttataacgggcatgtctaaaagatatttcagcctcaaggttttgtgttaaaatcattcttaaatttcagaatataggtgtaagccgggagtgatagatcatcgaagatttcatcatatcaataattgaagcgtttaaaagcttatcttacgccggaatttttttggcgctcagtatagaattcatcccggcggaaattgttcttccgcttgcgggctattgggtctcaaaaggggatatgacgcttgccggtgccgtgtttgccggttcactcggcggtgtttcaggtccgcttgtcttatatgggatcggcaggctgggcggtcggccgtttttgctgaaatatggaaagtatatatggataaaacccgaatccctggagaaaacagatgatttctttcagaagcacggaggtttggtagcgttcatcggccgttttataccgggggtcaggacgctgatttctttgccgtgcggcattgcaaagatgaatatctgggtgttctctctctatacatatgcagcgatgctgccgattacatttgcttacgtatacctcggaatgaaactcggggaaaattggaaaagcgtcggttccattctcgatcaatatatgctgccgctaggtatattcattgtgttgcttctcgttctttggatgttatggaagagaagaaaacagcggatcaaaacagaaaaaatttctcaatttgttaaaaaagttaagcgttgacaaatgatgaaacaggctttattatgagcgtataaacaaatatttcttgaaatcccaaaggggagtagcgtccggatattccggaaacaaagtcgtcaattcatggatcatatccatcggctttgttggcatgccaatcattcatgtctagcaagacctttgccttatatcggcaaaggtcttttttgcgtaaaaaaaccgccggtataagctcggatgatagaaaaaagaaacggagggaatggattggactttgcattattattggagtatggatgggtttttctcgttttaatcgggctggaagggattttggcggcggataacgcgctggtgatggctgtgatggtgaagcatcttcctgaaaaacaaaggaagaaggctttattttacggattggcgggcgcatttattttgcgtttcgggtcgctgttcgctatttcttttctggtgaatgtttggcaggtccaggccatcggcgctttatatctgttttacattgcggtcagccatttgctgaagcggtatgtatttaaagataacgccggtcagaaaaagcagaaagaaagcgggttttggcagactgtcttgaaagtggagctcgcggacatcgcttttgccgttgactccattttagcggcggtcgcgcttgccgtaacgcttccgggaacacggcttcctgccatcggcggtttggacggcggtcagtttctcgttattttagccggcggcgtaatcggtttaatcattatgcgttttgcggcatcaatgttcgtatccttactgaaaaccaggccgggccttgaaacggcggcatttgtgattgtcggatgggtaggcgtgaagctcgctctttatacgttggcccatgaggaactcggtataattccggcagatgtcatccattcggcggcctggaaaatcattttctgggcggttctggctgccattgcggtttgcggatggtttatgtcaggagcaaaacaaacagagtccggcgcggcatcggaaaaaagagaacacgcgtaaaatgatcaaaaagggagtctggctttttaaaaagcaggttcccttttttgtttgaaacgcttacatttaagacatatgataacaattttataacagcattgttacaaaaaacacagagaaaacccccttaattctgcatgggggcacgaaatcatgtatagtacgtcttattggcttgtcataattgagacaaatgaaatcgatttctctttttcttcctttgcgaatccctactaaattagctatgattatgagtagttatagggaggaactgaggtgaaaccagtgcttagccttttgtttaaattgggaaaaaagaagcaaacgcttgaaacatctgttgaaaaaatacaaaaaggcgacaaagatctgcagaacgatttaatacagcaatataagccttttatcgcgaagacggtttcatccgtttgtaaacgatatatagatgaaaaagacgacgaattcagcatcgggctgatcgcgtttaacgaagccattgaaaagtattcggctgaaaaaggtaattcgctgcttgcatttgcagagctgattataaaaagaaaagtgatagactatatcagaaaagaagcaagaaccgctcagcatatcaatatggatgtgcaggaaggcgacgaccaggaatcttcgcagagccttatcgaagcggagctttccattgatgaataccgcaaacagatagagcaggaacagcgccgggaagaaattcttttttttcagaagcagctgaaagaatacggcctgtcttttaaagagctgctggaacaatcgccgaagcatacagatgcgaggcagaatgcgattaaggtagcctacacgcttgttgaaaatgaagagctggcgtccattttgcaccagaaaaaacagcttcctgtcaaacagctggagcagctcgtctcggtcagcagaaaaacgatcgaacggaaccgaaaatatatcatcgccatgagtattattattacaggtgattatatttatttaaaagattatcttaaaggggtgttgcactcatgagaagagggatcatagtagagaaaaataaaaaattcgtcacgttgctaacccctgacggacaatttttaaaaacaaaaaatgatcaccgcacttgtgaaatcggagaggaaattacgttcgaaggcgaaacgcgtatgggaagaagggccagcttttttgattttctgaaactgcgcccttttaaattgggagtgtttacgatgactgctattattttgtttattttaattttactcccggttttttctgataacaaagcttacgcgtatatgacgcttgacattaatcccagcattgaaatggctttaaacagcaaatatgaagtcattgaactgacaccgctgaaccatgacgccaaacaggtcatcagtgacatcggagattggaaaagcagcgattttaaggaagtcatcagtaatattattaccgattgcagcaagcatggatatgtaaaggaatcaaaagagattttaatttccacggtttatgaaaatacagatgacaatacatataaaaaaggcgttaaaaaacagctggctgacatgactgaaaaatataagggcacctaccaggtccaatcgcttgaatctgatatggaaacaagagaaaaagcaaaacaggaagggatgtcaacaggcagctacataagaagaaacgaaaagaaaacagaagaaaaacagtctgaaaagcaaaccgacggcaatgaaacagatcagaaagataccgaaacagacgctgatcaaagcaagcagccggacacagaaaagccggcggctgatgaaaagacagctcctgatgaagaaaaggcagcagagaagccggaaaacaatgaaacagcgcccggcacggaagaagcgaagccggacagtcaggacggcagtcagcaaaccgacaaaaatgcagcttccggatcagaagaaaacacacagaaggaacaagatggggaaacagagcagcccccaacacaaaatcctcaggaaaacggaaatgacaaagagcctaagcaaaagtattacaatcattactggaatcagcggaatcatgatcgcaatgaacattgggactcctatcggcatcatgaagattcgtcagaccgcaggaatccgaacggctaccggcacggaaaggagaatgccgataaatatcaaaattcgccgagaagtcccggcgaataagctgcattattgatttttcccgtttaattgtgattgagcctgctgtacaagacgttttgtcatttccccgcctacagagccgtttgcgcgtgctgctgtatcagagctaaggttcacgccgaattcttgagccacttcgtatttaaattggtcaagtgcctgctcagcccctggaactaagagtttatttctgctcgccatctttttcatctccttttctctggcaagatgtgtttacgcattttagtttcaaacggaacggtattgattatgctggcaattgttgtacagcaaaaaaaccccggcgcagacaccggggcgaagaagcgttatgaattataataaatggctggtcattttgtaggctgaggcttgaatatggaaagtcaaaacggagagcaccgtgaccgcgatgatggatctgatatcgttccattgtccgcttccgagttctttaaagcagcctttgagcttgtccgtctgctcttcaacgagctcctgcaggctcgtttccttcatcggcgggtttgccttatgatgaagataatcaatcacttgggcgcagctttcatagtagctgatcgggctgatgacgtcgtctgatctgtctgtgatcgtgttaaaagcgatttttaatatgccgcgtatatgttcgaagtcataaattgattttaaatcacgtacaatgagaaggatgacagcttgttcaattgtatattttttgccgagtaaggggtggccgattaaatctttaatatcgcgcttcacccagttttggacggcggttgattttaaagacgtcagctcgcacagatttcccagctcgacaatctcgttagttgaaagcccgtattcctttttctctttttttcgttcgaatctcgtcagaaattcagggatatgcagacggctttccgcttcatccaatgtcatatccgctgattgcaataagatttggagaggagttgcgtctccttggccttttaacgcgtaaagaagccggaccatatcagttcgggtcagtttaaacgtgttcatggttcacctctgattgattacgtgttcactttctaatattactgagaattacattaacatcatacgtcgaaattgttgcattttcaaacagatcatttataatttaattaaataagttcttttgatcttaaaaaagacggaggtaattatggcgaaaagaatatttctgtttattttaacgaaccttttggtcattacgacaatcggaattgtgcttacgattattacaagcgttaccggtgtcggctcgtatatacaaaatggccgcattgatctgatggcattgctcgtgttcagtcttgtcgtcggttttgtcggttcttttatttctctcggaatgtcaagatggatggccaaaacgatgatgggcgtccgggtactaaatccgaagaaacagtcactcagctatgaagaacagcaattggttgaccgtgtgcacagattgtcccgtgccgcagggatgacgaaaatgcctgaagtcggcatttatcattccccggaagtcaatgcttttgcgaccggaccttctaagcgccgttcgcttgtcgcggtttcttcaggtttattgcagcagatggatgatgctgcggtggaaggggttcttgcccatgaagtcgcacacatcacaaacggtgatatggtcacgatgacgctgctgcagggaatcgtcaatacgttcgtcgtattcctttcccgaatcgcggcatgggttgcaagccgctttgtcaaagaagacctcgcaccggtcgtgcattttatcgcgatgatcgtgtttcagattatcttttccattctcggcagtcttgtcgtcttcgcctactcgcgccacagagagtttcacgctgaccgcggcggtgcagaccttgccggcaaggataaaatgattcacgccctgcgtacgctgaagtcttatacaggacatgtgaatgaagaagaccagacggcagtgcagacgttaaaaattaacggcaaaaagcattcgtcactgttctccacacaccctgatctcgatgagcgtatccgcaggctggaagcaaaataataaacaaaacctctgacaatcgtttcagaggtttttttgtttaaagatcggcaaattacataaggtaatgaaaaatctttctaaaaagacctttaaaaattctcccaatatcattagaataattacgtactacatttgagaggcagaaggaactatcttatgaaattaaaactgaaaaaattcatacagatcttgtcgcctgcacagctgattgcattatattattttcttgctgtgacggtggcatttattttgctaagtctgccggccgcccacaaacaaggggccagctggtcgtttatagacgcgctgtttacggctgtcagctcagtcagtgtcaccggtttaacggtcgtcaacacggctgatacattcagcacggccgggattgtcattttggctttcgtgcttcaattcggcggaatcggcattatgacgctcggaacattcgtctggctcattatgggcaaacggatcggtctgcgggaacggaagctcattatggtggatcagaatcaatcgcagttttccggtatcgtcaacctgatgaaacaagtgctgtttttgattttattaatcgagtttttaggcggcatcatcttaggaacatattttttaacgtattatgattcgtttgaacaggcgtacttgcacggattctttgcgagcgtcagcgccacgacaaacggcggttttgatattacgggaaattcactcgtcccgttcagacatgactatttcgtgcagtttattacgatgcttctgattattttcggtgcgatcggttttccggtgctcgtagaagtaaaagactttttgttttcaaaacagcgcagatactcattcacgctgtttacgaaaattacgaccgttacgttcggaatgctcgttttgttcggagccgtgggcatttacgcgcttgaaggaagccatgttatgaaggggaaaagctggcatgatgttttatttttatgtctctttcaatcaaccgctacacgaagcggcgggcttgcaacaattgatatcagccagctgtcggcgccgacattatttttcatctgtgccctcatgtttatcggcgcatcaccgagctcggtcggcggcggaatccgtacgacgacgtttgcgcttaaccttcttgctctgtttcattttgccagagggaataaagcggtcaaggtctttaaacgcgagcttcatcaggctgatgtcatgaagtcgctggtcgttacgatgatggcgattctgctcgtgttcgggtcgacgctgattctttccgtgacggagacaaatcagacgctgctcgggctgctttttgaagtgtgttccgctttcggaacgaccggcctgtcgctcgggattactccgcatttaagcgacatcggaaaatgtgtgatcatgattgtgatgtttatcggccggatcggcattttgacgttcctttatttgatcggacgaaaagaaatcgaagcaaattatcattatccgaaggaaagaataattatcggctgacaccgcttttcagaaagcggtgtttttttattgccgtaaaatggatgagtggaaacagtttctttggagattctacttgtaaagaggtgacgtcattgtttgccgtattttggaagtcggtagttatgatagcggtcggtacctttttattgcggatcgccggacggaaatcaatcagccagctgtcggtgacccaaacagtcatcatgatttcgatcggctcgattattattcagccgtttattgaacataatttatgggaaaccattttcgcggcggcgatttttattgcggtactgatcctgatggaatatttagaaatcaaatcaagcttttttgagtttttattttcaggaaaaaccgtcgccgttgtcagaaacggaaaaatcatcccggaaaacttaaaaaaaatgcgttttaccgaagaccagctgtcaatgaggatcaggcaggaaggcctcggagacattcaagattttaaatatgtgctgcttgagccgaacggacagatcggctatgaactcattgatgaggccaaacacgtgacagtgcgcgactttaaaaaaatgcttaatgaattcaaaacagatttgctgacagaaggaggaaatcaaatgaaacgcaaagcagcaaagaatgaagctttgaccaacaacaacacaccgactgagagcatggacaaagatgcatacaaaacacaatacgacggtgatcccggactgagaggcgcaaaccgcaaatcaaaacacggcaaacaaggaggcgagtaacatgacgaaaaaaaaccgccacagcaaagacatgcaaaaccataaaaagccgatggaccctaaattgcttgaagaagagttttcaagcgagctcggtgattataacgccggaaaatggattgaaacgcttgaacagacgaagccgaagaaaaaagaagacggcaaaaaataaaaaatacctcttaagcgataacgcttaagaggtattttattatttcgaataagcaccgtttcttgttcctttcaccgcttcaagcaagcctgttatccgcagctcaataaacggctgtgcagccgttttcaccgcattgctggagagaatggacgtaagagcggccgttaacattaagagtatgactaaattctgataatcagacaagtgatcttcaagcccgatctgccgcagcatttttataatgaatccatgcagcagatacacgtaaaacgttctcgtaccccatttcgtaaagaaataacgcttttgcggaacgagcgccaaaaagctgaaagtggcggcaaaggccaaaacataccagccgatccgtgacagaccgctcaacagcgacactgtgccgaatgtagaataaggctccgatccgaacagccacgagtaatcaaaatcaatgcaccagcataagaggaaaacaatccccagtacgcccgcggcaatctgcctgccccttttagcccgaagtaaatcaaagtgctgttttttcaaataaaacccgacgaggaacatcggaagaaagacaaacgtccgtgaaagactcagcgtgctgctgataaaatcaagatacccaatcatgacggcaagcccgcagctcacaccaagcgcccacattttcggcagcttcgtaaagggataaagcagcagattccaaaagaataagctgactaaaaaccagagagaccattgcggatcaatcggattgacgcttgtcatgctttcatcctgaatcaagtagtaaaaaaccgagtaaatgccctgaaaaatcaggtacggaataatcagcttcacagccagcttcttcacataacctttccgcttaaagttttttgcgaaatagccggaaaccaggataaaggccggcatatgaaaagtataaatgaatttgtagagatggagcataaactcatttccgttaataaatgaccggaggatatggccgaacactaccagaaaaatcaagataaacttggcgttgtcaaagtaactgtctcgcgattttgtcatagcatcaccttctcttcaaaaatcatccactgcatgattatttcctgttggtgttcattttaaaataaaaaacaaaaaattgaaggaggaaaaaagggattgttaggatgatgtaacggggaggtaaggatcgtagaaaaagactttaacttgtcatatcattgaaattttctgaaatgtatagggcgattgaaggaagatgaggtattttgtagaaatattgaaggataggtttttgaagaaggagtgtactgaatggctgaaactctggatttgcaaacaaacgagtcgctgaaagagcagctgaagcggatgaaagaggaaaatgaccgcctgaagagtgaattgaaccggtatcatgtgattatgaataacacgcttgatgccatttttatatgccgtaaggaaatgaaaatcgtccaggcgaacgaggctgcggcccggatgatgcagattgaggcagagagccttattaaccgctccgtcctggactttttatattccgtgcctcaggaagaactgaataaggccgtgaaaaggtttttaaaaaaaggccatctgtggaaagaggtgccgattaagcttgacagcggcgcgacgaaatacattgaattcctcgccagagacggaattggggaggattatttttttgtggtgatgagggacatctcctctaaaaaaatattagagcgcgaattctccatgaacgagcagctgtttaaagatttgtttgacagggctgtcgacggcatcgtgctgtttgataaggacggcgggtttattgatgcgaacctctctttttgcaaaagctttgagatcggccagaatgaattgtcccatctgtcgctccgccattttaccgacggagaaaacaaaaagcatctgaaagaaatctgggaaaccctccgcagaaaaggaaacgccaaaggagaactgcccgtcaagcttcggtccggcgaagagaagctgtttgaatttacgattacgtccaacttaatcagcgggttctacatgtccattatgagagacataacagagaaacggttgatggaattgaaactctttaaaagcgaagagcgattccgcgaaatttttgaaaacgccatggacgcgattgtcatttggtctgatgacggaaagattgccaaagcaaacgaatcggcgtgccgcattttcgaactgccgatggataagctggtggagacgaatttatgtacgtttatcgttgatccgcagaaaaaatacaagcagattaagaagaaatatgaaaaatacggggaaatccgtgaagagatgctgtttcagatggcaaacggccaatttaaagagcttgagttcacatcaaaacgaaccatacttgaaggtcagcatttaaccattttaagaaatgtcagcgatcgtaagcggatggaaaaagaattgcgggaaagcgagctgaaattcagaaaagtattcaacggctcaatggacggcaaggtcttatttgacaaccaattccgtattattgacgcgaatcctctcgcaagccgtatactcggcatgccggatgaggagctgagagcgtacaccgttccggatattctttctttatttgatattgaaaacgcgggtgttcccgccagaaagattgatttagaaggaatggataatgaaatccccttcctgttaagcagcagtgacagccgcaaactggaattctccttcaaaagaaatatcattcaaaatatgaatctggccatctttaaagatgtcacagaggccaaagagcttgaagagaggctgcggaaatccgacactcttcatgttgtaggggagctggcggcgggcatcgcccacgaaatcagaaacccgatgacggcgctgaaagggttcattcagcttcttcaaggaagcattgaaggcgaatattctctgtactttaacgtcattacctcagaattaaaacgcatcgagtctatcatcactgaatttttaattttagcgaaacctcaggcgatattatatgaagaaaaagacgtgacgcagattatgaaagacacggctgatcttttgaatgcccaggccaatcttgtcaatgtgcagattcatctgaacctgaccggaaacatcccgccgatttactgtgaaccgaatcaattaaaacaggtgtttatcaatattttaaaaaacgccattgaagtcatgccgggcggcggcaatatctatgtgaccatccagccttctgatcaagaccacattttgatttcttttcaagatgaaggaacaggtatttccgaagacaaattaaaacgtctgggcgagccattttacacgacaaaagacaggggaacgggcctcggtctgatggtcagctataaaatcatcgaagaacatcagggacgcattcatgtggaaagtgaagaagggaagggcacggtttttcatttgacgcttccgatccggcagaataccgaagaaagaaggagcggggaatgatctgttttacaagtgtaaaagcgccgtttggaaccgttatcgtaacagaggaagagggctttattaccggcctgtttctcaccggggaagattttcaggaatggcaaaaagacgcgcccggcgtaaagccgtgcgaaaccgctttgctgtcggaggcgaaacagcagctggcatcatatttttcaggagaaagaaagcaattctctctgcctctgagacaaaaaggcacaccctttcaggaaagggtatggaacgcgctgacgatgattccttacggagaatcccgaagctacggcgatatggctgaagcgatcggaaaaccgaaagcggtgcgcgccatcggacaagccaataaacgaaaccggctgccgatttttgtcccgtgccatcgggtaatcggcaaaaacagcgccttaacgggatacgcgggcacgaagacggatgtaaaagcggtgctgctgaacatcgaacaaatatcctataaagaaaaataaaacatatggcacgttccgtattttcgcgtccgacatatcattttattaagtgaaaaaagttggtctgatgaaaaaggaggacgaagcctgatgaaaatgagccgtccgcaaaagatagccggttatgcagagctgttttttaaaatgcatctgatttcagctgcccaaaaagatgaagtgattacattatgcagacaaaaaaaccgctgacattgcctgaggcaacatcatcagcggtttttcagctcagctggcagtcagcgaataattgttcaatttcttccgtgtaagaaccggtcacaattcctttctcggtgataatgcctgaaatcaggctgcccggtgtgatgtcaaaggccggattgaagaccggcacatcttcgggagcggtgcgtatgcctgagatctgtctgacttcatccggatctctttcttcaatcggaatctgatcgccgttttcaatctgcaagtcaaaggtcgaaagcggtgcggccacaaaaaacggaatctgaaaggcgtttgccaaaatagcgaggccgtacgttccgattttgttggccgtatctccgtttttagcaattctgtcagcgccgacaatgactgctgaaatatgtttttccttcattgtatgggcggccatgctgtccgtaatgagtgtgacatcaattccgccctgcatcagctcccacgccgtcagccgtgatccttggagaacgggtcttgtttcacatgcgtagatatgaaggccgaggtctttttgtttcgctaagtaaaagggagcaagcgccgtaccgtaccggcttgtagcaatcgagcccgcattgcagatggtcatgatctggtcgccttttttaaaaaggtgcagcgcattttggccgatcattcggcaggtttcttcatcctcaatctgaatttgaatggcttcatgaacgagcgttgtcttcgcttcattgattgagattgcatccctgatggaatccgtcagtctgtcaagcgcccacgcgaggttgacggcagtgggcctcgaactgtttaaatacgctttgacatccgcgaactgacgtcggaaatctgaaaggtcgcgggcttcaaacgacttggcggagagcgcgagtccgaatgccgcggttataccgatggccggggcgccccttactttcagcgtgacaatcgcgtcgaatacatcttcctttgtttcaagttccacatattcagtgacgtcgggaagcttttgctgatttaaaatgcggatgtaggtttctttccattccacagaacgggggatggcaaattcattggtcatgctgcatcattcctttacacggagcttaaattgggccagaacttcggtgatatgcttcagttcttttctgttttcgatataataggcgccgatctcaagcgccagcttcttccgttcgattcgtttgtcaaacggagtgatttcatctaagtcagccacatgggcgagtccgatcgtgcgccggatcaattcgcatcccgcaaaaccgaccgcttcttcaaacgcgtttttcagtgtgtcttccagcaggtgtctgcgggaaggcaggcagtctttctcccatgcttcactgaatgttttcacaaatgtatcccatacggcggcagtatggtcatataacggctgtctgtcgtcaccgtcgcggctgagggcgtttaacagcagattggcgataaattggccgatgtcaaacccgatcggtccgaagaaagcaaactcgggatcaatcacctttgtttcatgttcatcggcgaagatgcttcccgtgtgcagatcgccgtgaaccaatgtttccgcggaattcagaaagatggctttcaattcgtcagcgccttctttcagccgggaattgttccaaactttttctgcgtatgggcgcagctcctcttcaaaatcgtttgtctcatggtcgagaaacggttctgtaaacacaagcctttctgtaatattgcaaagctcaggatttgtaaactgctttgcgagctgctgctttactttcgcatcgagcgcataatcggatgagtaaaaaagcgttttccctaaaaattcaccgatatgaaccgataagttcggataatgctgcccttccagcagcccttttcttgaaatctgcaaatgtgagaggtcttccattaccgtgacggccatttcagtatcggaatagtaaacggccggaacgaggtgcggcacgtgttcgccctggcggatgagggcgctgctttcgattctcgcccgatcaattgtaagcggccagctttcaccgacgactttcgcgtaaggaatcgcctgtttgataatcagtcctttttggttttctttatcgtaaacatggaagacgtaatttaaattgccgtcgccgatttcacggcatgtcagagtgcttttgctttggaataagccgagcttgacagctaacgcggcggcggagctttctgttaattgttcataaagacttgttttagttgctgacatggatttaccctccaattatgtagtggtagtaagagatcgtgacggagaatacgcccgaaaaaaaagcctccttctctgaaagagaaggaggctgaaacagtgcagtccgcctcttatctctcagataacatctgatggaattagcaccgtgccttatgagacaatcgtctcggcgcaaaatgtacgcgccccatttcacaatggaattacggtcggttgctgttggggtcaaaaggccaattccctcgcccaactctcgataagagaaaatatattgatttgtatcacaattcggattaatcagttgatgaaaatattagcaggtgccggatattcttgtcaacgtttttttgaaaattaatataaatcacgccgcaagtcttggaaaaccggaatggttccgcggacggccgcgctttctgacacatcaatttccgcccggactgagccttccgtccggtctccttcggctaaaatccggccccacgggtcaataatcaggctgtggccggcaaattcattatcgggattggaccccgtgcagttagaggctgcgacaaaacattggttttcaattgctctggcgataagcaggcttcgccaatgatcaaggcggggcagaggccattccgcagagataaacaggacattcgcgccctgggacgtatgctttctgatccattcggggaaacggatatcatagcagatcagcccggcgcacttgacaccgtcaagctcaaaggaaccgtcgctgtttcctgctgacaagtaaaggtgttcatccatcagctgaaacagatgggctttctgataccgcttcacgatctgtccgctgttatcggcgatgtacatggtgttatagacatcttcgccttctttgaccgcaaaagatccggcaacgaggtgtacgttgtatgtttttgccgtttctttaagccactgtttcgaaactttgccgttttcatccgccagctggtctagccgtgtgagatcatagccggtcgtccacaactcaggaagcacgattacatccgcatggcggctttcttgctcaatcaaagattctgcttttttaaaattttctgaaggatttccgtatgaaatatcaaattgcaaacaggaaacggtccatttcattttttaacacctcaagtttctctttactttttttatttaaccatatatgatgatggactatcatttcaagacatttttagaaggtgaaaaatatgaactttgaaatctcagatgtactcaaacagctgccggaacaatttttcgcatcattggtgcaaaaagtgaatcaaaagctgaaagaaggcagagacgtcatcaatttagggcagggaaaccctgatcagccgacgcctcagcatatcgttgaagaaatgaagcgtgccgtcgaaaggccggaaaatcataaatactcctcattccggggcgcttacagcttcaaaaaagcagccgctgcattttatgaaagggagtacggggtcacgcttgatccggaaacggaagtcgccgtgctgttcggaggcaaggcgggacttgttgagcttccgcaatgtcttttaaacccgggagataccattctggtgcctgatcccggatatcctgattactggtcgggcgtcgcccttgcgaaagcgaaaatggaaatgatgccgctgacggaagaaagagggtttctccctgattacagcgtaattcctgaaaaggtgcggagcgaggcgaagatgctgtatctcaattatccgaataatccgaccggcgctgtggcgacagaggcgttttttgaggagacggtcggttttgcggaacaaaacggcatttgtgtcgttcatgatttcgcttacggagccgtcggttttgacgggcataaaccgctgagctttttgcagacggaaggcgcaaaagagaccggaatcgaaatctataccttgtccaaaacgtataatatggcgggctggcgggtcggatttgccgtcggaaacgcttctgttatcgaagcgatcaacctttatcaggatcatatgtttgtcagcctgtttcccgcggcgcagcaggcggcggcagccgctcttttagcggatcaggcatgcgtcgcagcgcaaaatgacagatatgaatcgagacgcaatgcatggattgaagcctgccgcggtatcggctgggatgtgacggctccggcgggctccttttttgcatggctccctgtgcccgacggttatacgtcacagtcgttttcagatctgctgctcgagaaagcggatgtcgccgtcgctgccggaaacgggttcggaaaatggggggaaggctatataagagtcggtcttctgacaagtgaagaaagacttaaagaagctgcggaacggatcgggaaactgaatcttttcacctgaaaaagcattgacatatcaggataacaatgcgataattcaaaatactttataaaatcattattcttatcaagagcaggcagagggacgagcccgatgaagcccggcaaccgactgataaagcacggtgctaattcttgcagcaggagctgagagataagattcggacataacacgaagcctctttctgctcatacggaagaggtttttttatgttttgtgaaagaaagagaggcgttcacgcatgagcgaagtattggcaacatatcttctgacagacacaacggacagtgaaaagcgggcggaacagattgcggcgggactgacggtaggctcctggactgacctgcccctggtgaagcaggaacagctcagaaaacataaaggccgggtcgtaaaagttgaggagaaagaaggaacctcagaaaacgaaacacaatccgtcatcaccatcgcctatcctgaggcgaacttttcaagagatattccggccgtcctgacgacggtattcggaaagctgtcactggacggaaaaataaaattgactgatcttgaattttccgaagggtttaaacgctcccttcccgggccgaaattcggtatatacggcatccgcaaactgctgggcgaatttgaaagaccgcttctgatgagcatatttaaaggcgtgatcggacgggatctcgccgacattaaagagcagctcagacagcaggcgctcggcggcgtggatctgattaaagatgacgaaattttctttgaaaatgaactggctccgtttgaaacccgcattatcgcaggaaaacaagtcctgaaggaaacccgggaggagacggggcataaaacgctgtatgccgtaaaccttacgggaaggaccgctgaactgcgggataaagcgaggcgcgcggcagaactcggggcggacgcgcttttattgaatgtgttcgcttacggtttagatgtgatgcagagccttgccgaagacagggaaatcccgcttccgatcatggcgcatccggcagtcagcggcgcgttcacatcatctcccgtttacggcttgtcgcatgcgcttttgctcggcaagctgaaccgctattgcggcgctgatttcagcttatttccgtcaccttacggatccgttgctcttccgaaggagtccgcgcttgcaatccatgatgaatgtgtaaaagacgatgtctttcatccgtcgtttgccgtcccgtcagcaggcattcaccccggtatggtgccattgttgatgcgcgatttcggtatcgatcacatcatcaatgccggcggtggcattcacggccatccgaaaggagccgagggcggcggaaaagcgttccgcgccatcattgatgcggtgcttgaagcgcagccgattgaagaaaaagccgcgtcgtgcaaagatcttcagctcgcattagacaaatggggaagggtggaagccgtatgacccgcacaccgctgattatttgtgatttcgacggcacggtcaccatgaacgacaacattgtcagcatgatgaaagaattcgcgcctcctgagtggcttgaattaaaagacggtgttctgtctaaaagcatatcaatccaagaaggggtcggccggatgttcggactgctgccgagcagcttaaaagaagaactgaccggctttattctgaaggatgcgaaaatacgggacggctttttggattttgtctcgtttgtccggtcaaacggcctcccgttttatatcgtaagcggaggaatggacttttttgtgcatccgcttttggaagggatcgtagaaaaggagctgattttctgcaatcatgcatcctttgacaatgaatatattcatatagactggccgcacgcctgtgacggaggctgcaccaatcaatgcggctgctgcaaaccgtcagtcatccggaagctgtccgatcagcagaaatttctcattatgatcggtgattcggtcacggatgtcgaggctgcaaagttatccgatatgtgttttgcgagagattatcttttgactgaatgcaaagaactcggcctccggcatttgccttttcaagattttcatgaggtgagaacaggcattgaaaacatcggggaggtgcaggcatggctgcaaaagaagaacgctggcgagaacttgccgaggtaaagcgcgagctggccgaaagagactggttcccggcaacgagcgggaatctttccatcaaagtatccgacgcgccgctgactttcctcgttacggcgagcggaaaagacaaacgaaaagaaacagacgaagattttctcttaatcgatgagaacgggaagcccgctgagaccggccattctttaaaaccttcagcggaaacgcttctccatacttacttataccaaaagacagacgcgggctgctgtctgcatgtccataccgtcaataataatgtcatctcagagctttacggggatgaaaaacaaatcacttttcaggggcaggagatgattaaggcgctcggattatgggaggaaaacgcgtccgtgaccgttccgatcattgacaacccggcgcacatcccggcattggccgaaagcttcgcgcaccatgcggacgccggctcaggcgcggtgttaatccgcaatcacggcattacggcatgggggcggaccgcatttgaagcgaaaagggtgctggaagcctatgaatttttattcagctgccacctcaagcttctgtcactgcggccgcagcttgtaaaataaaaggaggaatagaaaatggcgaccatcagaattcatgacgaaaagaatacgctcattgaaaaacaggaagaagtagcgcgcttcttagacgaacaagaggtgatctatgagcagtggaacattgaaaaacttccgtctgagctttcggagaaatacaatctgacagaagatgaaaaagaaaggattctcgcagtgtttgacaaggagattcaggatatttcagcccggcgcggatatcagtctcaggatgtcatttctttatcagataccacgccgaatcttgatgaattattaaaaaatttccaaagagaacatcaccacacagatgatgaagtccgctttatcgtcagcggacacggcatcttcgtcattcaaggcaaagacggcacatttttcgacgtccgtttaaatccgggagatttgatttcagttccggagaacatccgccactactttacgcttcaggaagaccgccgggtcgtcgcaatccgaattttcgtgacgactgagggctgggtgccgatttacgaaaatgaaagtgtgcaaaactgatagacgcccgaacctctcatgcccccgccggcatgagaggttttttattgtaatataaagtcagctgtggctgttttttaaatcttgaatatgccgcattctgtttatatcattacctgaatgggtattattctcgtattcatgctaaagattccaatatgaaatgaaaaaataagttatttagtaaaaaaatgtttacaaataaagtataatctgtaataatgctcaataacccaatcaaacttgtttcctattcttttagcggtgaggggtgaagtgaatgggcagttattctgaacaagaaaaattgcttgtatctattgataaaaaaagaaaaatgatgatagatgcggctaacagacaagggtttaccggatatgacacgatcaggcacagccaggaactggactgtctgatgaacgcgtatcagcagctggtaaaccgtgatcgcacacatcaccaaggaatacagggccttgtgaagaaaataggcttgttctcccgcggtgacgtcatgcctgcatatgaagcaaacaaatgattgatgataaaacagataacgaagactgaatgcgcttcctgatcaagcgccgcatccgaaagatgaccgcgtacagtcagcagatttttccgctggcacggctcacgaagcgcctcgtactatctgccggctatgatgccgttcctctggtatatcctcttacacatattcttctttaaataaaaaacaccccgatccagggtgtttttttcatcgtgaagcggcagggagggtaatggtgacctctgtccccttatcgacttcgctttgaatgtcaatcgaaccgccgtacatcagcatgattcgtttacatacgacaaggccgaggccggtgcctttttcctttgacgtgacaaacggaagaaaaatgtgttcaagcatatcttcagaaatgcccattccgttgtcggccaccttaatgactgctttatggtcgcgggcttctaaatagatggacagccggccgccttcctgcatggattccagtgcgttttttgcgacatttaaaatcacctgtttaatatggtctttcgtacagttgaccttgagcggccgattgacgagaatctccacattcacttccacattatacagattcccttcagaataaataatcggcataatctcatcaagaatatcctgcagcgagttcacttccaaccgttcagcagtcggttttccaagcactaaaaactcactgacaatctgattgatccgcttaatctcctgctcaataattgagaaatacagctgatcttcctccgatttgtattttttctgcaaaagctgaatgaagccgctgatccctgtaagcgggttgcggatttcatgggcggtgctggcggcaagcgttccgatcagctccaatttctgcgcttcattttgagcgcgctccagctgggtcttgcgcttaagcagataatattgaacgaggatgaacagaatattcagcagcacggcaatactggacatcggcagcagcacgcttttggtcagctcgttcagctcaaccggtttcggataaacattgatattccaattaatatcatccagatagccgctgaccggttgcaccccttctgattgatcagcccgtccgctggcaaatatcactttattctgattggttgccttgacataaacgtcagggctcagcatattgatcatatttctcaaataatcgacttggatggcggctactaaataatccgtgacttcccgttttgcgtctaacaccggcacgcagatcgtgaagatgcgctggcctgtaattctgctggagtagtcatttgtgataaccgtttttttcgtctttttcgccttcgtaaaatacggtctgtcggccaaattcacctttgatttcagatcagtcgtgcttgcgatgacatcacctttggaattcagcatatacagaccgctgaatctgggttcatcctcaaaagcctgatcgagaatatcaatgatcttttcttcattgacaggcttatcgacagcgatcgcaagtgttgtcatccgggcttttgtttcaccgattaaataattgagcttattgcggtgaaggttgagcatcatactggcttcctgtatgtgtttatcggctattttctgcttttctttttcataaatgaaaaagctgataataagtgccgggatgatcaccaatatgagataaagtttgatctttcccgggcacctttaaatgtattcactctgcatcgctccaacatcacacttgaatagaggtattatatcatttttatacttctttaataagaaaaaataaccaaaatgatagaaaaacaaattattttattaaggccagacaaaaagaagagaaattttggaaacatttttgttgacatttttcattttgtttattaatgtttctctgtaacggtttcttttgtaaaaggatgattgaatgtatgacggataaaacagaaaactcattgaaattatttattgtactgtcacgtgcgtaccgatctattaacgaccatatgaataaacatattcataagcacggtctgaacccgacggaatttgcggtgcttgagctgctgtaccacaaaggcaaccagccgcttcagcagatcggcgacaaaattttattagcgagcggaagtattacatacgttgttgacaaattagagaaaaaagaacttctcatcagaaaagcctcgccgactgacagaagagtgactttcgcacaaatttccgaaaagggaatccgtcttttggacgatattttccccgatcatgctgaagaaattaaagaaatgatcagtgtgctgagtgatgaagagatagaaatgtgtacggaaatgctgaaaagagtggggttaaacgctaaacattttcatcagaaataaaaaaggaagccgtttgaaaggcttccttttttatattactgattttggtcagtcgcggcgtttctaggctgtatcaatacctcgacgcgcctgtttttgctgcgcccttcagcggttttattcgacacggccggtttatactctccgaaacctttggcgctgaatacttttgcgtcaagtttcgggttttccgtgagaatagccatgaagttgacggcccgcatgacgcttaaatgccagttagattgatattgtgagtttttaatcggcacattgtccgtatgtccgctgatgataatgttcctcggcggattcagcacaaggagattcgagatttccttcgcaagcggaatatcttcctgacggatatccgcccgtccggaatcaaaaaagatactgtctttaatggtaattaagagtccttctttagtcagctttgtttccagctgagtttcaagctttttgttttttataaattgattgacttgcttttgcacgccttcaagttcttcgcggtcggctgcttctctttctttctttttctgttctttatctttttccttttccttgtctttttttaactgatcaatgccgtctttttcgttttcaggaggggtgacgcttgaatattcaagaacacccgtgcctccggtaaacacggcgttaaatgatttagacagcatttggaatttcgccgcatcgaccgagctcatggcgaacaatacaatgaacagagccaaaagaagggtgagcaaatccgcgtacgggatcagccaagactcatccacatgctcgtcatcatgcttcttcttcttttttctcgccattgtttgcctctccttcttgttcagcgacttttgcgcgttcattcgcaggaagatacatgagaagtttttgttcgatcactttcggggcctgtccttcaagcactgacagaacgccttcgatcatgatttcacgcagtttgacttcctgctttgatttgcgtttcagtttgttggcgaagggatgccaaagtacataccctgtgaaaatcccgagaagggtggcgacaaacgccgcactgatggcatgtccgagcgcctcggtattgttcatgttggaaagagcggcgataaggccgatgaccgcacccaaaacgccgagtgtcggcgcatatgtgccggcttgtgtaaagatggctgcgccggcctggtgtctgtcttccatcgcttcaacttcctcagtcataatatctctgataaattctgcgctttgtccgtcaaccgccatgctcaggccgtttttcaaaaatgcgtcatccacgtcttcaatgcttgcttctaatgcgagcagaccttcacgtctggcgatttgcgcccattgagagaacataggaattaattgcgcaattgtcagctgtttgttttctttaaacagcactttaaaaagggcaggcacttttttgatttcttttccggggaatgcgatgatcaccgcagaaatcgtaccgaacaaaataatcagaatagctgccgggttagcgagtgcgcttaagctgacccctttcagcaccatgcccacgcttaaagcaatcacggcgaggatgataccgataatcgatgttttatccatagttttcaccaaatcctttatactagctttctatggttaatatcggtggcagtgcatggaactttagggtgattgagaaattgttcccgaattcttcacagtttctcccttccggcatggagaaataacaaaaaagcggctccccgcgaggagggaaccgcttttttgttattgtgcccggactttgatgccgtcctcttccattacgacatggaaggctttgatttcgttgtcatccaatagaagatctgtcatttcgtcctcgatcaattcttggatggttcttctgagcgggcgtgctccgaaagcggggtggtagccgatttcagcgattttttctttcgcatcatcggtgacgctcaggctgatgccgcgctcttttaatgtgtcttcaagctctgtgagaagcaggctgacgattttcacgagatgttctttttttagggattggaattcaataatgctgtcaaaccggtttaaaaactccggtttgaagaacgcgctcagtgaatcaatcagcgtttgttcttccatgacgctctcttcagattggaatccgactttcacctgtttttcgccggttccagcgttgctagtcataatcaaaacggtatctttgaagctgaccgttctgccctggctgtctgtcagacggccgtcctccataatctgcagaaacatatgctggacatcagggtgggctttttcaatctcatcgagcagcacgatgctgtacggattgcggcgcactttttccgttaattgaccggcttcatcgtgtccgacatatcccggcggtgaaccgataatttttgatacggcgtgtttttccatgtattcactcatatcgagacggataatggaatcttttgtaccgaacagttcatctgcgagtgtctttgataactcagtttttccgactccggtcggtccgacaaagaggaaggagccgacaggtctgtttttggattttaagccggcgcggcttcgtctgaccgctttcgccacttttttcacggctttttcctgaccgatgacacgctgatgaagatgctcttcaagttccttcattttgacttgttcatcagcctggagttttccgaccggaatgcctgttttctgttcaatgatggcttgaatatgctccgcaccgatttcaggtgaagaggccggtgtttcatgcgccagctgcttttccaaagccgcttcttcatcacgcagtttcgcggcaagctcataattttcttcatgaagcgcttttgttttctccgcgtcaattgctttgagtctctcagccgcatcttcttcatttacggtatcaagctccaggttcgccttagagccggcttcatctaataagtcgatcgctttatccggcaggtggcggtcctgaatgtaacgggatgaaagcgtaacacaggcgtttattgcttcattgctgaatgtgacgccgtggtatttctcgtatttatctttaatgccttccagaatgctgatggcttgttctattgtaggctcgtgaaccatgacaggctggaagcgtctttcaagcgccgcatctttttcaatctggcggtactctttcagcgttgtcgccccgatgacctgcagctcgcctctggcaagcgccggtttcaggatgttcccggcatccattgatccctcggcagagccggcgcctacgagaaggtgaatctcatcaatgaacaagatgacgtttttccgttcttttaattcgttcattaattgtttcattctttcttcaaactggcctctgatccctgtattggcgacgagagaagcgacgtcaagcaggtaaagctctttgtttttcaatttgttcggcacatcgccctcagcgattttaagcgcgaggccttctgcaatagccgttttaccgacgcccggctcaccgatcagcaccggattgtttttattccggcggttcaaaatttcaattacgcgcgccacttcattatcgcggccgatcacagggtcaatcagacctgcttttgcgccgtttgtgacgttttgagcgagctcgtcgagcaggcctttttcagggccggactgctgtttattttgattgggagcgaaaccttgctcaaacgggaatccgaatgattgcggccccatgctcatagacggttttcgggttaattctgtataacatgtttcacataaaacgaattgtttttgaatggaattgacttgcatgttcaggcgaatcgtcgcctcgtttttctgacaatgttgacaacgcatttgccaaaacctcctcgaaaaatgtttgatcatctttgaccaaatggattagaaaataaggccgaaactttgaccttctttgattattagtatactctgaccttctttgactttcaagtattttgtttcaaaccccgaaaaataaatgtttacagcatgataagtgatattcgtgaggtttgattatttttgaccaatatagtcggaaaggaaatggaatgatttgacctttcttgatgaagagtatacgccggccctttttttctttcaatatttttgcttagaggagagagctgaatctgttttttccggggaaggacgatttgttcgtcttttcgggagacttgtctcataagcatatataaaggcctggacaaatctgcgtttagccggagggtgaaatgggacaaacaaaaggttctgcaagtcagcttgcatttgtatacgtaggcacggttgtaggagccggttttgccacgggacgggaaatcgttgagttttttctgaagttcggctggatcggtctgttcggtatcgtggtaagcggtctgatgtttacatatttaggcgccaaaatcatgatcatttccaaacggattcatgcagcatcttatcaggaattgaacacatatttattcggccagtccatcggccgcgccgtgaacatgtttatgatgtttatattgctgggagtgacctctgtcatgctgtccggagctggagcgctgtttcatgaacagcttggatggcccgcacaagcggggatccttctgacgatcgtactgagctttgccgtcatgacaagcggtgttaaaggtgtggtcggcgtcaatatattggttgtgccgcttttaatttctttctcttttatcgtgacagctgattcatttgtatttacaagcacgagaaacgcggacgaatgggtatggcctgataagtggaactggcttttgtccgccgtctcttacggcgcgttaaatttatcgctcgcccaagccgtccttgtgccgcttgcgaacgaaatgtcttcagagaaggtgatcagaaggggagcttatttaggtggcgttctgttgacactggtgcttgccgcgagcttcttatcattatcggtgctgccggatgtgctggagtttgacattccgatggctcaagtcgtctattcgtattcgcgttcgcttcatatcatttatttgtttattattttcggggaagtgtttacgtcggttatcggcaatttatacggattggaaaaacaattaaacagttttcttcatataaaaagtacatatatttacggcggcattttggcgtttgctttcattatcagccaaatcggttacgggcagctgatttccaccgtttatccggtgtttgggtatgtgagtctcgctttcatcggcgcattgatttgcaaaaaaatcccgaaagaaaaataaggatataaggaaaatgtctgtattttttgggaattccccttcttttttactgccatttctgtataatgaattgggaaatgatggggaggagtaagagatgaaggatcgacgtgtattattgggatttatttttatttgtatcggcattgcgttttttttacagaaggcgggagttatacatatatccgcaggttcggcgtggccgtttcttttcattataatgtccgcagggtttcacgccggatttatttttgcgaaaaaaacgcctgaacaggcgggactgctcgttcccggcggtatgtttcttgtgctgggctgcctgttttgttttgagaccgcaacgggatggacgtattcaggcgtgacgtggcctgtttatatatgggcgcctgctctcggtctgtttgagctgtggtatttcggcgggagaaagatcggcgtattgattcctgctttcatcctgacagccgcgggagcactatgctttgccggaatgctgatgacggggctgtggccgcttttgatcatcgcagccgggcttttgtttcacgccgctgcctttatgcagccgaaaaaaagatcgggccttcttattccgggcggcattttgcttgtgacgggcggcttgttatggtttgaaacgctgacggattggacatacgcaaatgtgacatcgcctgtctacctctttgccgttgcgttcggcctgtttgaagcctggctgttcggcagaaggcaaagagggcttttgactgctgcggcggttctgtgcgccgcgggcattttcggcatattcaccaatgcaaatgaagtcatcagcgaacgcggctggcccgttctcattcttttgctgggcgccgcttttcacattccgattttcggcccgaaacctgtcaaaaacgcggggcttctcgtaccgggcggcatcttattgattacggggttcttgtttgtctttgaaacggcaaccaattggtcttactccgatgtgacatggcctgtttacctgttggcaacggcattcggtttatttgagctgtggctgttcggcgggaaacagaaggcgctgctcatcccggttgcggtgctgaccttgacagcactttgctttatgatgacgtatcagccgatcattccggtttctgttttctggcctgctctatttgttctgatcgggattgcgctgatggtatttccggggaagaaacgcggggcttaaacccgcttttgcagcctgacacaggtttcaggctgtttttttattgtcacgggaaacaatattatggtatgatagcaaaagtgaaaaaagaagaaaatccgtattgatgcgggagaggttctagctacaccctctataaaaaactaaggacgagctgtatccttggatacggtttttttatgttttttagggcgccttctccgaaaaaggcgctttttttatggaatgatagataagggagagaaagacatgaaaaaagaaaaagcagttgtggtgttcagcggaggccaagacagcacgacttgtttattatgggctttgcaaaactttgaagaagtggaaactgttacattccattataatcagcgtcaccaagaagaaatcgatgtggcaaaatcgattgccgaaaagctcggtgtcaaaaaccacttgcttgatatgtctcttttaaatcagcttgcgccgaatgcgctgacaagagatgatatcgaaattgaagcgaaggacggggaattgccgacaacctttgtgccgggacgcaaccttgtatttttatcctttgcatcgattcttgcatatcaaatcggtgcgcgccacattattaccggtgtttgcgagactgatttcagcggctacccggactgccgtgacgagtttgtcaaatcctgcaatgtcaccgtcaacttggcgatggaaaagccgttcgtcattcatacgccgcttatgtggctgaacaaagcagaaacgtggaaacttgcggatgagctcggcgcgcttgattttgtaaagaataacacactgacttgctataacggcatcattgcggacggatgcggcgaatgcccggcatgcctgctccgcaataaaggatatgatgaatatatgaaaatgaaaggagagcggaactaattgctttctcaaatttacccgcaggttcagcatccttattcgtttgagttgaataaggacatgcacatttcagccgcgcactttattccccgcgaaagcgccggagcgtgcagcagagtccacgggcacacgtatacagtaaatattacagttgcgggggatgaactggacgattcaggctttctcgtgaatttcagcgtgctgaagaaattggtgcacggcgcttatgaccatacattgctgaatgaccatgaggaattttctgaagatgacagatattcactgccgacgaccgaggtcgtggccaaaacgatttatgataaggtgcagtcctacctcgaaacactggagaatcagccggtctgcgtgcaggtttttgtcagggaaaccccgacaagctattgcgtataccgcccgaaaaaaggtgataggaatggctaaaggaattccggtattagaaattttcggaccgacgatacaaggggagggcatggttatcggccagaaaaccatgttcgtccgcacggcgggctgcgactactcctgcagctggtgcgactccgcttttacatgggacggctcagccaaaaaagatatccgctggatgacagcggaagacatttaccgcgagctgagagaaatcggcggagacgccttttctcatgtcaccatctcaggaggaaacccggcgctgttaaagcagcttgacgcgctgattctgctgctgaaagagcacggggtgcgcgccgctttagaaacgcagggaacggtctatcaggattggttcacaatgattaacgacctgacgatttcaccgaagccgccaagttcggggatgacaaccgattttgcaaagctcgatcacattgtgtcttcgcttgatgcggcagaaaggcttaacgcggtcagcttaaaggtcgtcatttttaatgatgaagatctccaattcgcgaaaaccgtgcacaagcgatatccgaatattccgttttatcttcaggtcggaaacgataacgtccatacgacggacgaccgggcattgatcgcacatctgctcggaaaatacgaaacactcgttgataaggtttctgccgattcggatctgaatctcgtcagagtcctgcctcagctgcatacattgctttggggcaataaacggggagtttaatagaaagggagatttatatgacaagaaaagaatcagaattagaaggagttacgctcctgggtaatcaagggacaaactatttatttgaatatgcgccggaggttttggaatcatttccgaataaacacgtgaaccgtgattatttcgttaaattcaactgcccggaatttacgtcgctttgcccgaaaacgggacagccggattttgcaaccatctacatcagctatattccggacgaaaaaatggtggaaagcaaatcgctgaagctgtatcttttcagcttccgcaaccacggagatttccacgaggactgcatgaacatcatcatgaatgatttgatcgaattaatggacccccgctacattgaagtatggggcaaattcacgccaagaggcggaatctccattgacccgtatacaaactacggcagaccgggaacaaaatatgaaaaaatggccgaacatcggatgatgaatcatgatatgtatccggagacgattgacaaccgttaatttcagacggagtacggactcggaatataacctaaatacccccggttgcggtccgaagtgtgaaacggagtgaggtcacggtaaaacccgaacatttagcgtcagttttagacggaaatgtgagcgagtcacagcgaagtgtgacccgactgtgacccgaagaagccatagtgtgaccacgatccctgtctttctaggcggggatttttcaatacgttctatttattcagcgtcctcaatttcgaatagctcatcgacttctacgtcgagcgctttcgcaatcgaaaaaacgtgccagtcttagtggcgactattcttatcgaagcgcgatatcgaaccttgtggcacaccagatgcttccgaaagtcttacctgcgtccaccctttcgccttcataacggcgtttaggcgcggcgctgcatttagtttcattttgaccacctctgcgaccattataagtctttttaaaagagcaagtatagtctattcagtttatttctaaggttgcttacgctcaggtataaaaatatataaaatgctccacctaaatgttgaaaacgaaagcaattgcaataagagcagttgctttttttagccgggcagcattcctgtaataaataaaaatttaattttggaagaaacatggcagttagcacaacagaaaattataaaaaagatataatagttctaaataacattaacttggagggaaaaaatgaatttagaaatacgattagcaagtgcagaagaatatcagattgtgcataaaattatgttagaggcatttgaagaatatagatttcttgaagttccctctagtgcattaaatgaaccgttagatcatctattaaatgcaatgaaacaaggattagaaaaagcattgttgtgctttgtagatggggaaccagttgcttcttctagaatcacattaaaagatacctcgatatatttttcaagattatccgttacatcacacgcaagaggaaaagggatagcgaaagcaatattattatggattgagaattatgctattgaaaataaaaaaaagaaaatagaatgccgtgttcgtgcatcattaccaaaaaatataagcttgtacgaaagaatgggttacatagtttataaagaagaaacggttaccaaccctaatggttatgaagttaaaacagtagtaatggaaaaacctatactttagaaactaggtgaacttcttgtaacaaatgaactgcaaattggataatttgtgaagtaatacacttaacaatcgggtgcatttgcatattatatatgtctaatatgtatgaccccttattttaaatgtagtcttgattacagcaggacgatgtgataactgcgactatatgctattcaaaagttcggtgaagaatgggaagtttcctcgggagtgccggcggtctcggaatataacctaaatacccccggcttttaagcgggggtatttttcgtctctgccacgcagccaaaaaggtgcatgatattcgcacagaacttctataagggaaagagagatcatttggagaaaagaaaaagacgagtaaacccggggggagtgtactcgccgcttcaatacgtgacgggtgctggatggcagctcgtctgtttcattataaaatagggaacgtatgtttgtaaagacctgcgctgttttttcttattcggagcggatcaattgtaaaggaatggccagcatggtagcatgtcctgtaaaaagaaggagtgttcgttatggagccgttagagttaaacggtgtaaggctgaaaatgtatgattgtaaagaaagtgcgggtaaagacggccgtatgatttcattcgtattgaaggtgacctctgaaacgtatcatgatattgccgtccttttgtacgaaaaaacatttgacatcaaggcgcccgagcgtgggcttgaattccgcggtaaaataaccaactactatacatccgtcacaaatctttacaataaagatgagaccggtgatttttttgtggaaatgaccgagatctgaattcatttgaaaaagctgccgggcggcagcttttgtgcgggatatgtaaatggttcggattgttcggggggtttaataggagtctctgatgattttataattcttatggttgacgacagtgagggaatctaattcaaggtcacgataattatccatgatggttacatcaacgatgacggagttttcatttactttttcaacaataccggttaatccgtttttaaattcaatgacgtttccaaccttagcaattttcacgagcttcctctcctttatcataaatcctgtttgaaaatattttgcagtattttctttaagaagtaaagcgatatgggtatcagcccgctcaatcattgtcccggcgggggaaagatggtatattgtttttcgggaaaaagccgagaaaaggaggctgtattcgttgctgcctgaggaaatttcagaacgtatcaaccaaatgcgcaccggtgaaatcaaagaattcagggtgcagaaagaacattttcttgcatttcgagcagttttatcgaagcaggaagattttaagcatttccgcggtattgcccagcagggcggagatgttatcttccagtatttagaacatccaagaagctgacggctcctcgcccttgaggagtctttttttggtttcagtttctcatttcatctggctgtaacagatgtaaacaaaatgtaaaatccctccgatggatacttttactgctatttggttaatgttgtgaaaatgacggctgttttcctgccaataacaaggctgttaacaaacttcttccattataaaagctgattgggagcactggaaaatctttaaacgtgaatttgcgcacagctcttgttaaggtagtgaagtatttaaggaggaaatcgtatgacgacaaaatttgctgccttggctgtcttttttctatgttttatgcctgcatcaaaaattgaacatacagaagctctgtttacttttgcgaagaagccaaagcaagaacccagcaccctggttgctgatttaaataaaaaaagcccggttccgaagctttcaaaaacggatcataagcattctatccaaccgataaagctttcatctcaccaagagaagaaagcaaaaccggaagagacggcttatcagccgccgaaaaaaacgtattcccgcgctgacagacaactcctgtcacgtctcgttcacgcagaagcgaaaggtgaatcttataaagggaaggttgcggtagccagcgtagtgctgaaccgcactgaaaaaaacggtttcccggataccattcggggcgtgatctatcaaaggaatgcatttgaaccggtagcaaacggaagcattaatcaaaagccggataaggattccatcgccgccgcaaatgaggcgcttgaccatccgggcagagaaacgaacgcgttgtttttctacaatccgaaaacggcatctgaccactggatccgttcccgaaaaattatcgaacggatcggcagacacgtatttgcgatgtaagcatagcgggatcaaaaatatccccgctatgcttttttcaattttgagaaatcgaaaatattttcagaacttgtctcatatgatgatggaagaacgtgagacaaggagagacaccatgaatcgatttgtgaaagggatcattcttttatccatcgccgcctttttcgcggaatgtctggaatttgtcgtgaatatgatactggcgcgggagcttggcgagcatgggatggggctttacatgagcattctgcccaccatctttttaattatcgtaatcgccagtctggagcttccgatctctatttcaaaattcatcgcggaatccaatcagaagctgcatgaaagcatgctccggcatgccttcagaatgaccgccgtttttaccgcgttttcaaccgcggccgcaagcatcgcgctgccgttcattcctgtattcgatacgtatcacccctttattaaagggattgtcatcgggctgattccagttgtcgcttttacatccatcgccagaggttattttatgggtgtgcagcaaatgggaaaaatcgcggttgcgaatgtcttgaaaaaaatcattcaagtgctttgtctgtttatcttttttcaatggtactcttttgaaattgatatggccgtgcttatttcgttatttgtgctggtcgcaagcgatgttgtggtgttcgtttatttgtatacgcagtttattttggcgcggagggcgctttccggccatcagcacattcatcttcgcgggaaagacgtgcggaaacgcctcctggccgtatccatcccgacaacgggacttcgtatatttcatgcggtgacaaacgcagttgaacccttcttggttaaaggagcgctgctggcgtccggggttgccgggacagctgcgattgatcaatacggcatgcttgccggtgtagcgatgacaatcggttcgtttcccgcatttatcgcccattcgctgatggtcgtcatgattcccagcatttcagaagcatatgcgctgtcccaatatgatattgtgctgaaacggctgagacaagcgatttttattacattcggctacggcattccggcagtctgggtcatgtttcagttcgcaggcccgctgacccatttgttttttcagtctccggaagcgcagtattatttgcagcttttgtggccgttttttctttttcatctgtttgtgatgccgcttcaagcctgtctgatcggcatcggccacgtgaaaacggcgttttatcataacgtatggagcagcattgtagggctttcgatgatgtatgtgctcggttctatgccggaattgcaaatgctcggcattatactcggtatgaataccggcatgatccttctgacaagtttacattacgcgacgatctgcaaagacctcggtgtctccgtgtttttgacgggcggcggaagaacagcgccccggatcgaaagctgaaaaggctgatacatttcaataaggaagggcaagctatccgaaacgcgtgaaaggaagatcatatgcataaaacccgcctaattgtatgtgcagtccttttgatagctgccgccgtctggatgcctgaagcaaaagcctcatcagaaaaacaggcagttcccgccgtgtttctgatgaagacgattgaaggagacgaaatatcgattccgaataaagggcagaaaacgattttacatttttggacatcgtggtgtccgccgtgcaaaaaagaacttccgcaattccaaacgtattttgaacagcatcagtccgatgatgtaagccttgtaacggtaaatttgatgaatgccgagcgaaataaaaataccgttcaaaactttgtcactcagcaccatctcacattcccgattgttcttgacacgaaaggcgagcttatgaaggaatacgatgtcatgacgattcccacgtcatttctgctgaatgaaaaaggagaaatcgaaaaaaagatcgtcggtccgatgaccgcctcacaattaaaagaatggtcagagaattaaaaaggtgcgggaggaattcctcccgcacctttttttgcatataatgaacagctgaagaaacgctaatgataattattatcaaaaagaaattaaaacaattataattgaaatcttccgccggcatgctataataaagaaaacactgcgataacactgtgaaaatgctgcctgtcaggcggctgttttacttttatcggggaattgaagatgatttgcgttctcaattagagaggagaattcataatgaatgaacaagtgatgacacaaacccattcacaacagcagatacaagaagagcgggccggaaaaaaatggctccagcatgcagaactcattgcggcgctcgtatccggcgtccttattcttgcggcctggttttttagcgaaacaaaaggcctgtccgtcactttgtatatccttgccttcctgatcgggggatttgcaaaagcgaaagagggaattgaggataccattgagacgaaggcgttaaatgtagaactgctgatgatttttgcggctgtcggctccgccctgatcggttattgggcggaaggcgctgttcttatctttattttttcgttaagcggcgcgctcgaaacatatacgatgaataaaagcagccgtgatttaacatctttgatgaaactggaaccggaggaagcgaccctgcttgcggacggacgggaaaagcgggtgccggctgctgaacttaagatcggtgacatgatcgtcattaagccgggcgaacgcgtagcggcagacgggattattgagtctggcgtgacgagcctcgatgaatcggcgctgacgggtgaggcgatgccggcggaaaaaacagcaggagattctgtgtttacaggaacggtaaacggaaacggctccttaacggtccgtgtgacgaaaacaaatgaacagtctttattcagaaaaatcatccggctggtggaatcagcccaaaacagcgtgtcaccggctcaggcatttattgagcgattcgaaagtgtctatgtcaaaggcgtgctgttagccgtggctgtgcttttattcgttcctcatttcgctttaggctggagctggagtgaaaccttttaccgggcgatggtgtttatggtggtcgcctccccgtgcgcgcttgtcgcttctattatgcccgctgcgctttcccttatctcaaatggggcccgcaacggattattggttaaaggaagtgtgtttttagagcagctgggaagcgtacggatgatcgcatttgacaaaaccggcacggtcacaaagggacagccggcagtcgcggcatttcaagcagcggaacatgtgagtgaagatgagatcatgcaggcggtgtatgcgatagaaaagcaatcaagccacccgcttgcaaaagcgatagctgaatttgccgaaagccggggcgccgcgcccgcaggccatctatcgattgacgagacgtcgggattcggcgttcaggctgaaatagaaggcgtcaaatggatggtcggaaaagcgggatttgcaggtgaacatgcggcagatgcttttttgcagacatcgggaaaagaattaaaggataaaggctttacactggtctttgttaaaaaagatgaccggattgcaggctgcttcgccttaaaggatcaaatccgccctgaagccaaagccgtgatggctgagcttgaatcactgggcattcaaacagccatgctcactggcgatcagtctgaaactgcggctgccatcgcgaaagaggcgggcatgacgacggttgttgccgattgtctgccggaccaaaaggcaaaagaagtgaagaagctgaaagaaacgtacggcacaatcgccatggtcggagacggcattaatgacgcgcccgctctgaaaaccgctgacgtcggtattgcgatgggcgggggaacggacgtggctctagaaacggctgacttagtccttatgaaaaatgatcttcacaagcttgtgaaaatgtgcagactctcaaggaaaatgaaccggattattaagcagaatattgttttctcgctctcggtcatctgccttttgatctgcgccaactttctgcaggtgatggaactgccgtttggcgtaatcgggcatgaggggagcacgattctggtcatactgaacggactgagattattaaaataaacatgacagccgcacacgggcggctgtttttttaatgttcgttcacagcataaacgccggaaaactgatagaatgaataaagagtcactttggtaaggaggaaaagcaaaaaatgaacagattagaacgtgtttcatcttggctgaaaaaagaaggacatgatgcggcgtttatacatacaaaggaaaacgtattttatttaactgatttttacacagatccgcatgagcggttaatgggattgttcctgtttcaggaacaggagccgtttttcgtttgtccgggaatggaagccggacaagcccgaagcgccggatgggagcatggtattatcggctacggcgatcacgaagatccgtgggagctgatcaaagccgagctcacaaaacgaaatgtgccgcttgattccatcgcggttgaaaaggattcgatctctctttcccgctcagaacagctcaaacaagcttcagggggcgcagcatttgtttcggcagaagaaacgctcaaccaattccgcctcgtaaaagatgagaaggaaatcagcattctcagggaagcggcaaaactcgcggattacggagttgaagtcggtgtcgcggcgcttaaagagggtgtgagtgaaaccgaagtactcgcacagattgagtttgagctgaagaaaaaaggtgtgcagggcatgtcattttcaacgatggtgctgttcggggaaaaatcaggccagccccatgggaatccgggtgcagacaggttgaaaaaaggcgattttgtcctgtttgatctgggcgttattcttgacggctactgttcagacattacgagaacattcgcataccaatcaatcagcccgaaacaggaagagatttacgaaacggtgcttaaagctgaacaggcggcgcttcaattaagcaaacccggcgtcagaatcggcgatcttgatttaaaagcccgcggcattattgaaaaagccggatacggagactatttcccgcaccgcctcggccacggactcgggatttcggttcacgaatatccatcaatgagcagcgcgaacgacacactcctcaaagaaggcatggtgtacacgatagaaccggggatttacgtgccggatgtcggcggcgtgcgcatagaagacgatgtgtttgtcacaaaagacggcgccgaagcattaacgcagtatccgaaagaattaacgattctgaaatagaaagctttgtgataaaaaaggacggttctggaacgcagcgtccttttttatcaccttttaaatgaaaaaatcatcaaaatgctgaaatggtttgatatcatgcttttcattcaggggccgcagggcaaggtaactgccgccgagtatggccagacacaaaccgattaagcaaagaatccccatcgctgttcttctcctttcaaacgaataggatgtatctgtttctagcttactgtatgaaacgcattccagatcaagggaaaaaaagaaaggggggacgccatggctacgatcagagacattgccggcgctgccggggtttccgttacaacggtatcaagagttttaaacgatcatccttatgtaagtaaggacaaaagagaaagagtgaaaaaagcgatgcaatcgctcggatacacgcgcaacattcatgctgtgcatttatccaaaggtttttccgatatgatcggcgttgtgcttccgtcggtgaatcttccgtattttgcagaccttgttgcaggtattgccgaggctgccgaagcgtcaggcgtgcatctttctttataccagacagattatcagcagaaaaaagaacgttttgccttatcgcaattacaggagcgccaagtggacggcctgattatctgctccaaagcaattcctgatgggcatctgcttaccgtgaaagaaccgctcatcctctgccagtacactgatgcggcagggctttcctccatcagtaatccgcatcgggaagcatttcggcacggtctggattatctgatagaaaagggacaccggaaaatagcgatcagcctggccagaaaaaagggaaaaaacagtcaagtccgcatcgccgcatataaagaggcactgaagaagatcgggcagccttacagggaagagctggttgtggaaaaggtgctgacgctgcttgacgggaaagccctttttcatagatggaagagctgggatgacaaaccgactgcgctgtttgcggcgaatgatcaagtatccgcaggtctttaccttgaagccaaggcaaacgggacgcgcatcccggaagagcttgcgattttgagcatcgacaatcatgatatcagcaagatgttaggtatttccacaatagatatacaaacgaaagaaatgggaaagcaggcttttcacatgcttgagaaccggatcagcggcgggcctccgggaaggaaagttcttgattaccgccttattgaacgatcaaccgtctaaaaaaagaattgacgcgctttccgttcgttttgtacgatatgaggtattgaatgacaaaggagctgaggatcatgaaggggtcctttacagttgaaaaggtattaaataacaatgtgctcatcgcaacacatgatagatacagtgaggtcgtcttaatcggaaaagggatcggctttggaaaaaaacaagcggatgtcattgaagataaagggtatgacaagatgttcatcttaaaggatgaaaaagaacaaaaacaatttaaaaagctcctcggttatgtggacgagacacttgtcgacatctccaatgacgtcatttatcatatcaagaagcggacaagccaaccgttaaatgagcatatccatattgcgctgactgaccatatcgcctttgcggtaaagcggctgcagcaggggtttgacattaaaaacccgtttctcatggaaaccgaaacgctttatccggaagaattccaaattgcccgtgaagtcgtcggcatgattaatgaaaagacgggaatctgccttcctgaaggagagatcggctttatcgctctgcatatccattccgccctgacgaatcggcccctttcagaggtcaatcagcattcacagctgatgtcccgcctcgttcaggtgattgaggaatctttccagatgaaagtgaataaagaaagcgtccactatttgcggctgatccggcatatcagatttaccatagacaggattaatcgggaagagcagacaaaagaaccagaaaagttaatgttattattgaaaaatgaatacccgctatgctacaatactgcttggaaactgataaaaatcttgcagcaaatactgaaaaaaccagttcatgaggcggaagcggtttatctcacgcttcatttgtaccgattaaccaataaaatttcataatttcagttgaaaccttaaaaacgtgtcactgattcgatcaggcatgagtgattgagggtaaaaaacgggaagaacgatcccgttattttgcacaccctttttactcatgccttttttgttgtgtaaaagggcaaatgtaaacggttaaactgaagacttgcgccagtgaattcgttgtcatgaattttcgctgtaaggtcacactagctaacagaggaggtacatcttttatgtttaaagcattattcggcgttctccagaaaatcggccgtgctcttatgcttccggttgcgattttaccggctgcggggatcttgcttgcgttagggaatgccatgcagaacaaagatatgattcaagtcatgcatttcttaagcaatgataacgttcagcttgtggcgaacgtcatggaaagcgccggccaaatcgtatttgacaacctgccgcttctttttgcagtaggggttgcgatcggtcttgccaacggagacggtgttgccggaatcgcggccattatcggatacctggtcatgaacgtatccatgagcgccgtgcttatggcgaacggcagtattccgtctgacaaaattgaacgggcaaagttttttgcggaaaaccatccggcctatattaacatgctggggatacccactttggcgacgggcgtgttcggcggtattatcgtcggggttctggccgcgttattgttcaacaagttttataaaattgaacttccgcagtacctcggattctttgcgggtaagcggttcgtcccgattatcacatcaatttccgcattaattctcggacttattatgttagtgatctggcctccgatccagcacggtctgaattccttctccacgggtcttgtggaagcgaatccaaccttggcggcctttattttcgggatgattgagcggtcgttgattccgttcggtcttcatcacattttctactcgccgttctggtatgaatttttcagctataaagatgcggccggagacatcatccgcggagatcagcggattttcatggctcagatcaaagacggcgtacagctgacggcgggaacatttatgacggggaaatatccgtttatgatgttcggtcttccggcggcagcgcttgcaatctatcatgaagcgaagcctgaaaagaaaaaacttgtagccggaatcatgggttctgccgctctgacaagttgcttaacgggaattaccgagccgcttgaattctcattcttatttgtggctcctatcctgtttgcgattcattgcgtattcgcgggactttcctttatggttatgcagctgctgcatgtaaaaatcggtatgacgttctcaggcggtctgattgactacttcctgttcggaattctgcctaaccggacggcttggtggcttgtcattccggtcggcttaggactagcactcatttactacttcggtttccggtttgcgatcagaaagttcaatctgaaaacgccgggccgtgaagaagaggctgcggatgaaggtgcgggcgcctcaggcgaagccggcgaccttccttatgaaatcctgcaggcaatgggtgaccaggaaaacattaagcaccttgacgcttgtatcacgagactccgcgttacggtcaacgaccagaagaaagtggataagactcgtttgaaacagcttggcgcctcaggcgttcttgaagtcggaaacaacattcaggccattttcggcccgcgttctgacggtttaaaaacacagatgcaggatattatcgccggacgcacgccgcgacctgaaccgaaagtatccgcgcaagaagaagtcagccagcaggttgaagaggttatcgcagatccgctccgaaacgagcagggtgaagaagtgttcgcttctccgatcaccggcgaaatccatccgattaccgatgtgcctgaccaggtgttctcaggaaaaatgatgggtgacggttttgcgattcttcctgaagaaggaatcgtcgtatcgcctgtccgcggaaaagtgctgaatgttttcccgacaaaacatgcgatcggtcttcagtctgacggcggaagagagatcctgattcatttcggaatcgacacagtcagtctgaaaggcgaaggattcacttcttttgtttctgagggtgaccgggttgaaccggggcaaaagctgcttgaagttgatcttgaagcggttaaacctcatgttccttcattaatgacaccgattgtctttacaaatcttgccgagggtgaagcgatttccctttcggccgaaggtaccgtaaaacgggaacaaaaagatattgtgaaaatcggaaaataagcatataaatacgccgtgcttgtcagatgacaagtacggctgtatgatataatattgtgtagtaaaatagctttaatttaaaggagaatgataatcatggcacaaaaaacatttaaagtaacagcagattccggaatccacgctcgtcctgcgacagttcttgtacagactgcaagcaaatacgatgctgacgtaaacttagaatataacggcaaaacagtaaaccttaagtcaatcatgggcgttatgtctctaggtatcgctaaaggcgctgaaatcacaatttccgcttcaggcgctgacgaaaacgatgctcttaacgctttagaagaaacaatgaaaagcgaaggactcggcgagtaatgcaagaattaaaaggaataggcgcttcagccggaattgcgattgcgaaagcataccggcttgaagagccggacttaacggttgaaaagaaaaacattgctgatgctgcggctgaagtaagccgttttgatgaagcgattgtacgttctaaagaagagcttgaaaaaattaaagagcatgctttaaaagaactgggacaagacaaagctgacattttctccgcgcaccttttagttctgagtgatcctgagctgttgaacccggtaaaggagaaaatcagcacagattcagtcaatgctgaattcgctttgaaagaaacagcttccatgttcgttactatgtttgaatcaatggataacgaatacatgaaagagcgtgcggcggatatccgtgacgtaacaaaacgtgtgacggggcacctgctgggcgtggaaattccgaacccgagcatgatctcagaagaggttgttatcgtggctgaagatttgacaccgtctgatacggcgcaattaaaccgccagtttgtaaaaggttttacaactgatatcggcggacgcacttcacactccgcgatcatggcccgttcgcttgaaattccggctgttgtcggcacaaaagcggctacagggacaattgaaaacggtgttacggtgatcgtagacggcatcgatggtgatgtgatcatcgatccttccagtgaaacgttaaagaaatatgaagaaaagcacagtgcttacctggcgcaaaaagctgagtgggcgaagctcgtcaatgaaccgactgtttcaaaagacggccatcatgtagagcttgccgcaaacatcggcacacctgacgatgtaaaaggcgttcttgaaaacggaggagaagctgtagggctttaccgtacggaattcctttacatgggacgcgaccagcttccgacagaagacgagcagtttgacgcttataaaacggttcttgagcgtatggaaggaaaatcagttgtcgtgcggacattggatatcggcggcgacaaagagcttccttacctgcagctccctaaagaaatgaacccgttcttaggctacagagccatccgcctttgccttgaagagcaagaaatcttcagaactcagcttcgtgcgctgcttcgtgcaagtacatacggaaacttaaaaatcatgttcccgatgattgcgacagtaaacgagtttaaacaggcgaaagcgattcttctcgaagaaaaagaaaaactcgtcgaagccggcgtagcggtttctgacgatattgaagtcggtatgatggtagagattccgtctacagccgttatcgcagatcagtttgctacagaagttgacttcttcagtatcggaacaaatgacttgatccaatacacgatggctgctgaccgcatgaacgagcgcgtagcttatctgtatcagccatacaatccggcgattctccgtctgatcacccttgttattgaagccgctcacaaagagggcaaatgggtcggcatgtgcggagaaatggcgggagacgaaattgcgattccgattcttctcggtttaggcttagatgagttctcaatgagcgctacatccatccttccggcaagaacgcagatcagcaagctttctaaaaaagaagctgaatcattcaaagaaacaatcttgtctatgagcacgacagaagaggttgtcgcattcgttaaagaaacattcaataagtaatacaacagccagacggtataagccgtctggtttttttcatattcggaaaaaaggggggaacaataacgttcaacaggagggattatcatgacaaaatcatttgcagcgggggatacggtctatgtgatttaccgcaatccgcatgccgccaatgttgcccatattaaagaggcggagatcgtccatcacccgtaccatgagggagaactgtctctgtttttatacgaaacctatcatccgctggccgaagatgacgcggtcttttcgacatatgaggaagcggaagcgctttacagcgagctttttgaagaagaccggtaccattgatcaaaggaaatgtttacaacgcatattcactctcttttaaacggaaagtaacaacatgagaaaatgtaaaaagggagtgtcagttcatgctgaagccgtttgtgccccagcttgtttatatagaaccgagagcgctcgaatacccgttaggacaagagctgaagaataagtttgaaaacatggggcttgagatcagagaaacaacatcgcataatcaagtccggaatattccggggaaaaatcacttgcagcaataccggaacgcgaaatcaacattggtaatcggcgtccggaaaacactgaaattcgattcttcaaagccgtccgccgaatatgccattccatttgcgacgggctgtatggggcattgccactattgctacctgcagacgacgatgggatcaaagccttacatccggacatatgtcaatgtggaagagattctggatcaggctgatgagtatatgaaagaacgggcgccggaatttacaagatttgaagcctcttgtacgtctgatatcgtaggaatcgatcatctgacacatacattaaaaagagccattgaacatttcggacaaagcgaattgggacagctcagattcgtgactaaatttcaccacgtcgatcatttgcttgatgcaaaacataacggaaagactaggttcagattcagcatcaatgccgattatgtcattaagaactttgaaccgggaacttctccgctcgacaaacggatcgaagccgccgtcaaagtcgctaaagcgggctatccgctcggtttcatcgtggcgccgatttatattcacgatggctgggaggaaggctataaggagctgtttgagaaattggatgcggcgcttgatgaagacgttcggcatgacatcacatttgaactgatccagcatcgttttacaaaaccggccaaacgggtgattgagaagaactatccgaaaacaaagcttgagcttgatgaagaaaagcgcaggtacaaatggggacgctacggaatcggcaaatatatataccaaaaagacgaagaacatgccttaagggaaacactcgaatcttatatcgaaacctattttccgaaagcgaaaatcgaatattttacgtaaggcagagctgtcggcatgacggctcttttttttgctgcgccaaatgacggaaatgtttgatatttatttcaagatttattcattttcttggccgaaagaccgatataactctcaggaggggatggttatgtttaaaaaaatgcatatcaaaattgctgtgtttgtctcggcaatgcttattgtaacggttgtttttttaacggtttcttcatatttgacattaaagccgatgatgacggaggaagcaaaacgtacgacagagaatgtcaccaattcactcggtcagaacattgagcttcagctgaaaaatgatgagaccgtattaatgagattagcagacggtgaattgtcccggtcttttctatcagatgggaagaaagaaaccgcgcggctttttaacgatgagttaaaacagatcggacagaatgacaaatatgtcgcgcttgcgtacgtcggaaccgcaaacaaacaaatgtttacatatccaaaggccgattttgccaaagactatgatccgacaaatcgaacgtggtataagatggcggctgaaaaacccgataaggttgtctggactgacccttataaagatgcagtgacgggagacatgatcgtgacggcgtcaaaagccattcaaaacagcggaaccgtcgtcggagtggcgagcttagatttgaagctgtcctctattcagagcatggtcaacgagcaaaaggttccgtataaaggatttgcctttttagcggatgaaaacggctctcttctggcccatccggcaaaacagggaaaaaatatttcggaagatcagacgttaaaagacatcactgcggacaaagaaggcatcaaagagctgcaggggaacatggtcgtctaccaaacggtaaaagaaacagggtggaaagtcggaacgcagtttgaaaaagatcagctgatgggagtagccgacaaaatgaacacggtgagcatttttatgtcactgatcgcccttgtgattacgatcggactcagctatttcctcgcaaaaacgataaccgggccgattcagcagctgatcgcaaaaacaaattcagtctcagcgggagatttaaccgtccgcgctcagacgaaatcaaaagatgaagtaggcgagttaacaaaagactttaaccaaatggttgaaaatatgaaagagatggtcgaacaggtcaaggcctcctcagaaaatgtgtctgatacatctgaccagctaaccgtcatttcacaagaaacaaatgaaacgagcggacaaatcgcaaaagcgatagaggaagtcgccgccggagcgacagagcaagcgtcagaggttgagacgatcaacgaaaaatcggaaaatctctcagtcaaaataaaaggaatcgcagatcgcgcaggcagcataaaacaactctcaaagtcttcagaggatgccagctacaaaggactggacgcgctcgggcagctgctgatgaagtcaaacgaagccaattcagaaacgaaaaaagtagaggcaatgctgaatgacctggaagaacaaacgaaaaacatagaagaagtcgtgacggcaatatctgctatttcagaccagacgaatctcttggcgctgaatgcgagcatagaagccgcaagagcgggagaaagcggacggggctttgccgtcgtcgcggaagaagtccgcaagcttgctgaacaatcagctctttcttccggccatatcagtgagacggtccgtctgattcaatctgagacaaaagaagcgtcacacgcgatgattgaggcaagcagaatgaatgatgaacaaaacagcgccattcatgaaacgggtgaggttctcaatctgatcacgacggaaatgcagtctctcgttcaaggtatagatcatatttacaatgacattcaaaaaatgagtgaagaacaagccgcgattcaagaagcgattcaaagcatctccgccatttctcaagaatcagcggcagccgcggaagaagtgaatgcttccactgatgaacagctcgttacgcttgaaaaagtgaagcaatcgactgatatgttaaagagcgcaagcgaagatctgatcagcgccatttctaaattcaccttgtaacgcggactctatcagcctataatatggtaatatagacatgaaagagtgatatatgaatcgcatcaggggaggaaagcgcagtgaacaaaacggtcggatttatcggtttgggcgtcatgggaaacagtatggcatcgcacattttagaagcgggctatcctgttttagtctacacgcggacgaaacaaaaagcggaagagattctgaataagggagcggtctggcaggagacggtcaaagacctttcagagaaagctgacatcattattaccatggtcggctatccgagtgatgtcgaggaaatctatctcggcgaaaacggcattctccggcaagcaaaagaaggggcgtttgtcattgatatgacgacatcaaaaccatctctggcgaagaaaatagcggagaaagccaaagaaaagtccattcacgccctggatgcacccgtttccggcggagacatcggcgcgaggaacggaacgcttgccattatggccggaggagaaaaagaagcgtttgaagcatgcctgccgcttttctctgttatgggggaaaacattcagtatcaagggccggccggcagcggccagcatacgaaaatgtgtaatcagatcgcgattgcagcaggaatggtcggagtggctgaagcgatggcttacgcggaaaaatccggtctgaacccggaacaagtgctgaaaagcattacaaccggagcggctggcagctggtcattgtcaaacctcgctccccgtatgctgaaaggcgattttgcgcccggattttacgtgaaacactttattaaagacatgggcattgcccttgaagaagcggagctgatgggagaagaaatgcccggattggcgcttgccaaatcattgtacgacaagctttccgcgcaaggtgaagaaaacagcggaactcaaagtatttataagctttgggtgaaataaaaaaaagattgcccgcaggggcaatcttttttattatttattttccgataaattgctgtgtccagatgtttcctgattctacataaccgacaccgatttgagtgaactcaggattcatgatgttctttctgtggccttcactgttcatccaagctttaacgacggcttcaggagtcgtctgccctttggcgatattttcaccggcagttttataagtgattccgaaagacttcatcatatcgaaaggtgagccgtaagtcggactttggtgatcgaaatagtttttgtctttcatatcttgtgattttgcgtgagctgatttgcttaatttttcatcaatctgcagaggttttaagccttgcttttgtctctctgcatttgtcaattcaacgactttcttttcgtacgcactgactgatgaaggagttttctcgctgctgttgtttgtgttatctgtctgctttgcattgtcagccgtctggttttgatcggctttcggtttttcggcagctgtcggggccgtttttgccggtgtttctttttgaacgtctttaactgtcatatcagaatgctttgcgtgtttttgcagcagctgagtcagttctttctcatttttaacgttcagctttttcacgctcgttttcatatgtagtttttcaacagcctcttgaagagtcagatgctgtacagtgtttccttttttcacggtaacgacgtgctggcatgacagctctttggcagatgcctgctgaatgcctccgaatgtaatcaaactgactgccgcggcggcagataagagaaatgcttttttcatagttaatagcctcccagagaagtttttttctacatgaaaaatcttatcacagcttttttgtcataatgcagccagccatttcctttgacaacaaactcttgtcataattgtaattgagcgcagaaaaatggctctataccgggaaaaacgatctgtatttattttttaaaatccgttacatctcttcaaattatttgaagtgttagatatattttaagataatttgatcttgacagttttttttacccgttttcgctgtaacaacttttacaaaaatgttacaattaaaatctgtttatgtaaatatattcaatgatttgagaggtgtaacagaaagtggctgaagttgcgcgcgaaccaaagaaaaaaacgaaacgttacagagcgctgagaatgaatctctattttttgattgtttttcttctctttacggcactgatttttaaactcggcatcgtccagattgtcgaaggggataaacaccgccaggatgcggagaaggcaaatgcaaaaaccgcctattatccgacaccgcggggaaagatgtatgacaagcggaacagggtggcggttgataaccaggctgtgcctgaaattgtatatgtatccacctcaaaaacctcggcaaaggacaaattgaaaacggcaaaaaatctcgccgcactgattcatattgatactgaatttatgaaggatcgaaatatcattgattactggcttgccgcacatccgaagaaggcggaaaagcttatgaaggattcagaaaacagcctgaagccgcaagaagtgtacaaacgccagattgaacgcgtcccaaagcaggagattgatgcgatcaaacaaaataaaaaagagctggaaatcgcggcgatttatacgcgtttttcaagcggcaacgcctatcagccgcaagtcgtcaaatcaatggacccgaataagctgaacggaaacggaaacagcgggtcactgcttgacgaacatgaaaacaacaaacagaaaccgaaaagcgacctgacatatgaagaagtttctgtcgtatccgagcacctgaaagagctccccggcattgacgtaattaatgactggacgcgtaaatatccgtacgacaaaacactgtactctctgttcggcggtgtgacgacaccggaacagggattgttgggcgaacggaaagattattatgttacaagaggatactcactgaatgaccgggtgggaaaaagctacattgaatatcagtatgaagactatttaaacgcacataaagaaaaagtagagtatgtggaaaacagcaaaggtgaagtcgtcagccaaaagcccgtcgatgaaggcagcagaggctacgatctgcagctctcgctcgatatggaattgcagtcgaaagttgaaaaagtcattgaaaaagagctgagaagaagccgcgccgcaggcaactatatggttgacagaggatttgccgtcatgatggacccgaacaacggggatattctctcaatggcggggaaacgcatcgatctcgaaacaaataaaatacaggattttgcgatcggatcatttacgacacaatatgagatgggctctgctgttaaaggagcgactgttctcgcgggttaccaaagcggcctcccgcattataaaacatttgtcgatgcaccgcttgtatttaaaggcaacacgagaaaacaatcgtggacacaaatgggagccattactgagctgaccgcgctgcaaagaagttcaaacgtatatatgtttcatgtggccatgcatatcgccggcattaactacaggccgtacggtacactgccggccggattagacgatattaaaaaaatgcgcaactactacgcccaattcggtttgggtgtgaagaccggaattgatcttccacaggaatcagcgggcatgcagtcaaatccgcaaatggtcggggggttgctgcttgactttgcgatcggacagtttgatacgtatacgccgcttcaaatggctcaatatatttcagccatcgcaaacggcgggtatcgcgtccagccgaggatcgtcacaagcattcatgaaccggacagcaaaaacaagattggaaaagcgattgaacagcgggatattaaaattttgaacaaagtaaataacagcccgagcgattttgatcaagttcataaaggaatgaaactggtcacaagctcacctcaaggaacggcttattcaacattccaggggtccggcgccgatgtttccggaaaaacgggaaccgcggagacccactattacggcacgaacaaaaactggtgggggaaagacacgtataacctaacctttgtcggctattatccgtcagaacatccacgagtggcattcagcgtcgtcgtaccgtctgttcgagatgatcacgatcccgtcagcaaaaacattgccaagggagcaattgacgcttacaaagaacttgaaaagaaatacaataaaaaataacaaatgaaagggcggccgaacatctcgtgcgccctttctttcattcaggaaaattgacgttcacaataagaatagaaggagaatgctcattttttagcgaatcaatctagtggaatttctttttatatcagtccgtgtccagcctgcagtgcgagtataatgcaaaggagggattctgtggaacaggatactcagcatgtcaaacagtttcaatcgaaaaccgatcttcatgccgttttgacgtctaacgggcgtattatgtatatttctgcaaactgcaaatcgtacttcagttattctcaggaagagatgatcgggtcatttctcaaaacattcctgcatgaagaagatcaatttttggttgaaagttacttctataatgagcatcatttgatgccttgcacctttcgtcttattaaaaaagatcataccatcgtatggcttgaagcgggtgtggaaattgtcacaccgcaaatggaggggacggatcgggaaatcatcctcaaaatcaaggtgcttgaggagaagacaccccgccggccttatatgtatgaacaaaagaagcaaaaggcagaacaacagtcggaagatgcggctggaaacggcgaattcgagcgtcttgtcgaaatgctgccgaatcctttatatgtcagcatcaacggcacaatcgcctacgccaacaacgcgatgcttgccatgctgggagccgaaagcaaagacgaggtaatcggcaggcgctcttatgagtttattgaagaagagtatcacgacattgtgaaaaaccgaattgtgcggatgcaaaaaggaatggaagtcggaatgatcgaacagacgtggagaaggctcgacggcacgcccgttcatttagaagtgaaggcggcaccgacgacatataaaaatcagcgggcggaattgctgcttctgattgatatttcttcacggaaaaaattccaaacgattctgcaaaaaagcagagaacgttatcagctcctcattcagaattcaattgacacgatcgccgtgattcacaatgataaatgggtattcatgaatgaatcgggcatttcgctgtttgaggctgaaacatatgaagatttaatcgggaaaaacgtctatgatcagcttcatccctgtgatcatgacggcgtgaaacagcggatccaaaatattatcaaccgaaagaccgagtcagaaatcattaagcaatcgtggtttacctttaaaaaccggctgatctacacggaaatggtctgcattccgacgacgtttttcggagaaacggccgtgcaggtcattctgcgtgacatttctgagcggaagcagacggaggaattaatgctgaagtcggaaaagctgtctatcgcagggcagctggcagcggggatcgctcacgaaatccgcaatccgctgacggcgatcaaaggatttttacagctcatgaagccgacgatggaggaaaacgaacattactttgaaattgtgttttctgaactgagcagaatcgaattaattttaagtgagcttttaatgcttgccaaacctcagcaaaacgccgtgaaagagcgtgtaaacttaaagaaaattataagtgaagtaaccgctcttttagagacgcaggcgaatcttaaagggatttttatcaaaacggattacgaacatgacagcatgtatattaacggtgatcaaaatcagctgaaacaggtgtttatcaatctgattaaaaatgccgttgagtcgatgccggatgggggaacggttcacatcatcatgacagaagatgagtattccgttaatgtgacggtgaaagacgagggtgacgggataccggaaaacgtgctgaaacgaataggcgaaccgtttttgacaacgaaagaaaaaggaaccggcctggggctgatggtcacattcaaccttattaaaaaccatcagggagccatccaagtagacagcaaaccggacagaggcacggcctttcacattacattcccgaaacaataaaaaaacaacggcgttatgccgttgtttaaatagtctgcatggattctctcgtttttaaaataaatgcttccagccggtccaagccttctctcaatgtatccagtgaatatgcgaatgacagcctcacatacccttcacccaattttgaaaacgagctgccgggcacaagagccacacctgcatcctctaaaagagccatactaaaatcaaacgatgacattccgaatgacttaatggaagggaagatataaaatgcgcctgacggctttacgacgtcaagccccattgagacaagacggtcatatacatagtcaagccgctttttatactgttctctcataataagcgcatcatcaacaccgtttgtcaccgcttcaagagccgctttctgagagattgaagacgcgcatgtcacactgtattggtgaacttttaagatgtgcttggcaatttctttcggtgcgaaaatgaaaccgattctccagcccgtcatgctgtgtgattttgacaggccgttgatgacgatcgtctggtctctcaaataagacgcgatcgaataatgcggtctgtcataggttaattcgctgtaaatctcatcagacaggacaaaaacatttctgcccttcaggacggctgcgatgttttgcagctcttcctcagacaatgtcactccggtcggatttgacggataaggaagaatgacgcattttgtttttggtgtcagcgattcttcaatgagccgcgccgtcagcttaaatccgtgagtcgtcgtatctacatggaccggaacggcgcccgacatgcggatgatcggttcgtagcccggatatatcggcccggggagaattacttcatcgcctggagataaaatcgtccgcaaagacgcgtcaatcgcttggcttgccccggttgtgacgatgatttcagtttcagcttcataattcaaatcagcttttttcttcatataaagctgtacggcctgtctcagctcaaggccgcccgcgttcggagtatatgccgttgcgttctcgtcgattgcctttttggcagccgctttgacatggtgcggcgtgaagaaatccggctggccgatcgtaagcgaaatgacattgtcgtgctgagctacaagatttgagaatttgcgaattcctgaaatttcaatttcttttacattcggattaagcaaatgttccataattcatcaccttatactatatattgagtttatcctattttaccactagctgagcatttgtcatctttttattgaactatcccgagtatatgtccgatatgtgaaaacataccttctttcagaaaaaaataagacaaccagctgaaatgattgtcttcattgtatcatgatctatctattgtgatatgtggcgaatgtcattaatacccgtattcaaagctgacgtcttcccgccataagatgtatggagcaggcttgtcgggacgatctttcgcctcttttttcatttgcaggtaagccgttttgctgatatcttctaacaccatcatttgatcttggtcgaatatgactactgtacccatttattacacccttcttcctgaaaaatccttgactattttaccactcgatgtcaaaaagtcaatgggatatcagaaaaaagcatctttttataaagagttcatggccagttggcccgaatacattcactttttccgtttacagccgatatatacagtacaatactgaatgcggatagcgagggattgaattgtctttacaacaatacgatattttattggattcaggcacaaacgaattagaaatcgtcaaatttgaagtaggcgtcaatacatttggcataaatgtgatgaaagtccgggaaatcattcagccggtagatgtcacatctgtgcctcagtctcataaagacgtagaagggatgattaagctgagaggcgaaattcttcccgtcatcagtctgtatacctttttcggcgttgatgccgaaggagcaaaagacgataaatatatcgtaacggaattcaacaagcggaaaatcgtctttcacgtcggttccgtttcacaaatccacagggtgtcctgggaggcgattgaaaagccgacttccctgaaccagggcatggagcggcacttaacgggaatcatcaaactggaagacacgatgatctttctgcctgattatgaaaagatcatttacgatattgaatcagcatccggtgttgagacttatcatgtccatcaggaaggatttgatgaaagacgggcgggtaaaaaactgattatcgttgaagactcgccgcttctgatgcgtcttttgacggatgagctgactgaggcggggtacagtgaaatcgttgcgtttgaaaacggaaaagaagcgtatgattacgtcgtggaactgacggataacggagcaaacctgtcagatcatattgacatgattatcagtgacattgagatgccgaaaatggacgggcatcgtttgacgaagctccttaaggataacccgcaaagctctgatgtgccgattatgattttctcgtccctcataacggacgacctgcgccaccggggcgaagtagtcggagcggatgaacagatcagcaagcctgaaatcagcgagctcattaaaaaagtggatacgtacgtgattgaatagaaaaaagccgatgcatgacgcatcggcttttttgcggcggaattaaaaataactctcaccaagttttttaaatacgggtttatgataagcgggctgctgcctgttggcggcaagcggtttttcctttaagcccacatatttttgcaatacgtttttcgcttttgtcaaagacatttgtgctttaggattgcggtacgattgatttaacgtacctaaatgcggaagatgctggaagtcttcttttgttggaggcatgtgaaaatagtagtctccgatagagataagtacgtctgactgctgttggctaaacctgggattatttgaaaagtgaagccctatttttttccctttgccttctttcacaagcttttgtaatgcccgttttttcagcagataaaggtatttagggttgggggcggtttttgcatggcggttcacagtataaacagcttttgaaagattctcgatggttggctgcagctctttcgaataagcgtggtcgtccattatttctctcctttgcattgatcaagttcatatatagattatacttttttagcgttgaaatgcaaatattgattataaaaatacgcctttttctgatgaaaagggcgcatttttttcctttattagacaggtttcgcatgtttttcggaatcagcctttaatgattgctgtacatcgacctctgctgcctcggcgctgtatttcggaagagcgataaaatagaacacaaataccgctaaaatcacgattcccatgccgtaataaaggtaatcaatattggcaacgaatttcggaaataacagggcaaccagtccgagtgtaatcgattgggcaaacatcataaaagggtcctgccagccgctgacccggcccattattttcgggtgaacgattttcggcatccagccgccgatggcgatattgacggggccgatgcacatgccgaggatgaaagccgccgcataataaatccacagcttatccgtatagccgaggacaaaaatgagcagtccggctgccaaaataggaatcgacatcaaatgatgcggtttgactttttttgcgatcatcgttccgatcacacttcctgcaagcaggccgaagccgagtgcgacggtgaagatggaagtatgtgattcataatggtccggcgcaagtccgtatttcatcgtaaacatcggcagtacggcaaagccgccgttgacaaaaccaaagataaaaaagccgaaaataagggaagcaagcaatttgtttttaacaatatatacgatcccttccttaaaatcagcgaccgagtctttcagaaacgaatctccccatttaaaagggccgttcggctgacgggcttctttcggaatgcggcaggcgcggatcagaaagcctgatacaataaagctgacaaaatcaaggataatggctccgtgcataccgatcgttttatacataaacgcgcccataccgacgccgaataccataaagatgctgaacaggatctggttaagtcccgccgctttcgcataatgctccttaggcagaatagcttgtacaaggctggcttccgccgggaaaaagaacttggtcacggcgcttctgatgaacaaaatacagaacacgagagggatgctcccagtgtataatgcggcaaacaatatgatcgtcagtccggctctgatccagtcacaattctctgcgacctttttcctgtcaagccggtcagctgcgacaccgacaatcagaaatacgaaaactgtcggcagtgaatacatcagctcagccaaagttgtgtatgccggctggtttgaaaaatggtccagcaagtaaaaagcgaaagccatattacctacagtcgttcccatttgagaagcgagtgctgcgaaaaagagacggacaaaattgcgatttttaaatatatccataaacacgctccttaccctaaaggtcccactgtaatatattatcatcagctcgttccattaacaaataagatctttctatcttataatggtcacccttgttccattaggcacggtagcggcaagttcagtgacgtcctgattatacatccggatgcatccttttgataccgctttgccgatggaggaaggattatttgttccgtgaatgccgtaatgaattttagagaggctgagccaataagcgccgaacgggccgccgggcttaggctggcggttcacaatgtaaaattctccggtcggcgtggtcgtcaatatttttccgactgcgatggggtacgtacggatgagcctgccaaggcggtataactccagtttcttcgctccgatatacacgacaatggaataggggatggtggatgggtcgggaagattcggtatgataatatgctgtcccgcgtatatgaccgattggattgagggatttgcctgaaggagagcagcagtgcttattctgaagtcttgcgcaatgcttgagatggtttctccttgtttcacttgatatgtcagcagtttcatcaccctcctttttgctcttttccatatacatattacggagggggtgtctgtgcatcgggataaaagtcttatttttgtacggttttcaatgtgaacagcgtgatttccggtctggctaaaaatcgatacggcagtcttgtcgtaccgagcccgcgattaacgtaaacggttgtgtcatgcagcgtatacatgccgtcggtatacgtttttccgtatggaggcgtaatgagagggccgaaaaacgggagctggacctggccgccgtgagtgtgtcccgacagctggaggtttacgggatatccgccgatcttgagagcggcatcaggctcgtggacgattaaaatggaaaacgcatcttcggaaaggcgggacagggtgccttcataatcgggttttccgagcattacatcatccaaaaacgcgagttcaatccggcttccgtctgtcagctgcacctgatggcagccatttcgaagcacttgaaaatcagccgcttccatcagagccttgtacgtgttcgtaccgtagcctccgtggtcatggtttccgtaaacacaaagtttgccgaagggagcttccagattttgcagcacggcgagtgcttgctggtgatcattaaataaatgcggcttatcaattaaatctcccgtaaagatgagcagatcgggtttcagctgattgatcttttccgctgctttattcaagtcaccggatgtaaacacatcactgagatgcgtatcgctgaattgaacgattttaaaattgtcaaagccgcgggggatcaggcggttggtgattgtatgacgggtgatctcaatcatgcgcggttcaatataccgggcatagccgtaacctccgcaagccgttgcaagagttgcacccaaaatgccgaatcctctttttaaaaatgttcttctcgtcattttctccatctgtaaaaccaacctttgtcagagttgttctattatatcatcagcctggctgaaaaatcccttctcagcatgtaatgacgcggaaagacatctatgataagattatgaatgattattcattcaatataagggggtttgttatggataagaaagcggtaatcattacaggcggttcaagcggcatgggaaaagcaatggcgaaaaaacaggctgaattaggatggcacgtcatggtgacagggaggaaccgtgaagcacttgaggaaacaaaaaaagaaattgagacctttgaggggcaggtcgcctgttttcaaatggatgtccgttctgattccgccgcttcagacatgattacagaagcgaaaaaagtctttggccggctcgatgcgctgattaacaatgcggccggcaattttatttgcccggcagagaagctgacgcccaatggatggaaagctgttattgagattgttttaaacggcacatttttctgcagccaagccgcggcaaggcattggatcgagcaggagcagaagggcgtcatcttaaatatggccgctacatacgcatggggagcgggagcgggtgtcgttcattccgctgcagccaaagcgggggtattgtcactgacaagaacgctggccgttgaatgggggagcaaatacggcatccgcacaaacgcgatagcccccggcccgattgaacggacaggcggtgcggagaagctgtttgaatcggaaaaagcggtgtcccgcactatgaacagtgtgccgctcggccgtctggggacaccggaggaaatcgccgctttggcagcgtttttgctatccgatgaagcatcctatataaacggggattgtatcacaatggacggggggcaatggctgaatccttacccgttttaatttacatgacatattttgcgaagcaagcgaacgttaaaggtgaacgttcgcttgttttatttttctattcaaaattatgatataatttttaaagattaagaggtgaataagtgaagaaattattaaaatggttcgttgtactatttttaagcagttgcgttatcatctttaatatttggtactttatcatttgcgcttttactccggagtattatcaaaataccaatcttacatctgatgaaataatcagatttgaaaagctatatcatatagattttcctgatgaaacgaaatttattaaagccagggagtatttgagtgggctcggaggcgatacatcggctgtatgatatgtgtctctgccaaccaagctggcggaaacaattttatctgattatacgtatatgccaataaatcatactgatcatgccggttcaatgtatggagttgacgtttccaagagtgctggcgggttaacaactcttacatttggcactttagataaaaaaggaactttctttcagttgaaacatgatgatgattggatatttaacagtactgattggagccattatttttggacagccgccggttataatgctcttatatttatccttttatttgtgatggtgaaacaaatgaataacgtccttaattaaccggtctgaagagtgatcttaaaaagttttccccttttattttaaactgctgccatactgcctcctttttcccctaatctaaacatttgtggtgctgatataattgtgtataatcagacaaagatagagaagcaggtgataacatgttggacccacttgatatactgacgaatattgatgatgtcattccgtattaccaagcgatttttaacgctgaggaacaaagagtcgtaggctacgaagtgcttgggcggattttggcagatgcggagattgagagcctcgggccgtttttcttagattccggcattccggaagaatataagcttgaggtcgatgacagagtcatcaggcaggcgctggagcggtttaaagaagctgatcgcgatctgttgatttttatcaatcaggatgcgaatgtattgatgcttgaccacggagaaagctttcttgagcttttgaaagaatacgaagagcagggcattgaattgaaccgtattgtgcttgagatcaccgagcacaatttcgaaggcgacattgaacagctgtaccatatgcttgcctactatcgtacatacggcattaaaatcgcggtggacaatataggtaaggagagcagcaacctggacagaatcgcgctcctttcaccggaccttctgaaaatagatttgcaggcgctgaaagtatctcagccgtcaccttcgtatgagcatgtgctgtacagcatttcattgctggcgagaaaaatcggcgccgcgctgctgtatgaagatatagaagctgattttcagctccagtacgcatggagaaacggaggccgattttttcaaggctattatctgcaggcgccgagcggcgattttatagaccggagcctgttaaaagcacgcttgaaaacggagtttcagcaatttatcacgagagaaaaaaagaagctggagacagtatacgaacactctgagaatttttataagcgggtcaatcaggcagtttccgagctgaagaaaacccatcaggcggacgatgagtttattaaaaaactggcggaaaacctgaccgactgctgtttcagaatttatatgtgtgatgaagaaggctatcagctgacgggaaatgtgttcaagcagtccggcgaatggctttatcagcctgaatacgtggagaaaaactggagctggcgtccgtactttttagaaaacattatgaagatgcggaattcaagaaaaggctttttcagtgacctgtacagtgatattgagacgggtgagatgatcagaaccttttcatacccgatggatgacaatatgtatttatttatcgatctgccttactcttatttatatgaacaggacgggttactttaaagcggctgctgtatgccgcttttttttataaatgtgaaaaagttttaaaaaacgattgacaatgatagtgataatcattatcatttagttatagagagaagttactctctgttccccaacccctctatcagatcaagatccgaaaaagcttggcgctacccccgccaagtttttttatgctgtctcctcataaaaaggcttctcctcacatacatctgacaatggcggctcaaaaagcgaaaaattatttttgaaaggtgtatgacattccgaaaaaagcttcaaactattcgaaaacacagttttcccgtttattttcttattgaaaatccagcgggaaaatgccatcccggtctactttatggtatgatgctctgtaggacttgtattataataaatacttgttgatttgaagttgttttttgaaaggagtctttttttagaatgtcacaattaatgggtatcatcacgcggctgcaaagtctgcaagaaacagcggaagcggctaacgagccgatgcagcgttattttgaagttaacggcgaaaaaatttgcagtgttaaatatttcgaaaaaaatcaaacgtttgaactgacggttttccaaaaaggtgaaaaacctaacacgtatccgtttgataacattgacatgatttctattgaaatttttgagctccttcagtaatgtgatttgatttttcaggctgaccaagcttccggtcttccgcaagcggagctttattaaatcatgcaaaggaacgtgcttgttcgtttggttgtagactctggaaagaggagtgtccgtacatggctgattcttttctgttttataatctttctgaggcacagatgacctttcaagacgtgacggagcggctgaaacgctttgtcaataaagacccccgttcagcatacgtgctgtctgtagggacggattcacaagtttaccgcgacttcacaaagtttattacggctatacacttgcaccgtacaggcaagggagcttggggctgtttgaaaaatcacgatcttgcaagaccgatacatagccttcgcgaaaaaatctcgctggaaaccgcgttcagccaggagatggctgcgcatatcctcgacggccgtcttatggaactgacagatttgctcttgccttttgcggatgaaggggcggatctttcatttgaagtgcatctggatatcggtcaaaaagggctgacaaaagaattgatacaagaaatgaccggccgcattacctcgatgggcattgaagcgaaaatcaagcccgattcctgcacagcattcagttatgccaatcgttacacaaaataatatttcatacagaatccgcaaaatgtcgaattatgcggttgacgatttttttctgtttacttattctagcggtagagctgaaagcaaatttcaccttgctttcggaggtattcagttaaaaatagggggcctgattacgtatgagtcttatcggtgaacgatttacggaagaagaacagaaacttctgctgaatatcctgatcaatcaagaatatgccattgagcttttgaccagcgaaatcaacgatatagaagcagggtcaaaaagcgttgatggaaccacttataaaaaactcgtaacgctctatgaccgttttcggaacgaaaattaatcagcggcctataaattgatactcgattgcaaagagtatcttttttattgacggaaacttttcgacaaaaaatgataatgtttatattattgcaatatagggaatacatgctttgatgaaaaatgtaaaggggtcgaagtgacatgattagcttacaatcagatcagcttcttgatgcaacagtcggacaatttatgatcgaggcggataaagtggcgcacgttcaagtcggaaacaaccttgagcatgctctattagtgctgacgaaaaccggctataccgctattcccgtccttgacgcttcgtaccgtctgcacggtttgatcgggacaaatatgattatgaacagcattttcggacttgaacggatcgagtttgagaagctggatcaaattacggttgaggaagtcatgctgaaagacattccccgtctccacatcaatgatccgattatcaaagggttcagcatggtcattaacaacggctttgtctgcgttgaaaatgatgaaggcgtctttgaaggcattttcacgagaagagtcgtattaaagcagttgagcagtcatatcagatcattgaataagtaggctcgcacgatcagcctatttgttctttcgcatgccagaaaaagaaaacgcatacatatgagtggcgcttgcctcggcagcctttatttgattagaatggtagataagaaatatgaaaaggcattgaaaaggaggacgacatgcagcttcaagagcttcatatgctcgtagttttagctgaggaattaaacatgaggaaggctgccgaacggttattcgtgtcacagccggctctgtcccagcgattgcagaccattgaaaaagcctggggaacaaagatctttcttaggtctcaaaaaggacttacggtaacgccggcaggagaaaaaatcatacaatttgcaaatgacgtcacggatcggcaagaaagaatcagagaaaacattgatgaacttgagggtgagattcacggcacattaaagcttgccgtcgcctcgattatcgggcagcactggcttccgaaagtgttaaaaacatatgtggaacgatatccgaatgcaaaggtctctctcattacagggtggagcagcgaaatgctgaaaagtctgtatgaagatcaggtacatatcggcattatccggggaaatccggaatggaaaggccggaaagattatttaatgaccgatcatttatatttggtcgatacggaaatttcctgtattgatgatattgcccataccgatcggccgtttattcaattcaaaagtgacagtacatattttcaggaaattcagcattggtggcatcaaaaattcaaaacttcgccgaaacagaccatccttgtcgatcagattgaaacgtgcaagcagatggcgctgcacgggatcggttatgccattctgccgtcagtcaccttagaagaggaagacaaagtaaataaaatgcccctgcttgatacaaaggatcatcccatcggccgtgacacatggctgctcggttatgagccggcatttgaattaaaacaggtgcaggcttttgtttctgtcattaaagatatgctgaaacaggaacgcccattttagaaagacagcaatcatgctgtctttttttattttttattgacaatgaaaatcattatcatttaaagtgttatatatgttaatgaaaatcattatcaattacgaggtgatcatatgcagaaagcattaatgatatacgcaagcatgtcggggaatacagaggatattgccggcattataaaagaaacactgagcgggcatcagatagcggttgactgtcttgatatggacgaagcagatgcggattctctcaaagcatatgattatgtttttgtcggcacatacacatggggggatggtgatcttccttacgaagcggaagatttttacgaagatattctgcacagccagctcaacggactgaaaacggcctgtttcggttcaggcgatcacgcctacccgaagttttgcgaagcggtcacgctgttttgcgatgcgtttgaacaggccggagccaatttatacccggaaacgctgaaaattgagctggcgcccgagacggctgaagatcaagaatgctgcaaagaatttgtccgcggttttcttgcatgggccgctcaccacggagaccggtaccatgtttcataaaggcgcgacggctgtcatggcatcagtatcttcgggattttttgtcgctgtgaaagacgaaggtatttttcatttttcggcggaagaaggctggaaaagactattccgagtgaaaagcaggattcatgtgctgacttatatagggccctacatattcgcagctggagaaaaaggcgccgtcctcagatcggccgatcaaggaaagacttggacggcctcccgatttccgaccagcgcctccgtatgggccgttgccggacggaatgacggatttgtctgtgcgcacggcacatactgcctctacttatctgatgatttcggcgtcacttggcatgtggctaagcccttttcacaattaaaggagccgcctgtcatccgttcgctttgtttacacggtcagacgatttatatcggcacccggattcatatgaatcatggcggcatttgggcgtatgatctgacggaaggccgcatccggcgtataagccgtgaaaggcagcgcatgacggcttcaatgatgatgtatcagaatgactggctcattgcagcaaagggcgcggcaaagggagaacggggggaggttgccgttcgaaacgtgcggacgcaagaggagtttgccattacagccggggacgctgtaagggaaaagtcatttctcgacgtttctgaggataacgggactatttatgtcacatcgtcacagggcgaaagcggattttcgcgtatttatcaagctgatcttgccgccggtgaattaaagtggtttgatacgatccgcggtcacggatggcgggtggccaaccgggaagaaaactttttttgcgcgggcctttacgaaagtaagtttgtcagaccgtatgaggcggttcggctcgcacattagtttttatgcataaaggagagacgaagatggggaatgtattgcttgtttacgctacaatgtcaggaaacaccgaggcgatggcggatttaattgaaaaagggctgatcgaagcacaagcctccgtagacagatatgaagcgatggatattcatgccgaactttttaatgattacgagtatattttattaggcacatatacgtggggagacggggatcttcctgatgaaatgctcgatattgctgaagatatggaaaacctggagcttacgggaaaaacatttgctttgttcggttccggagatacgtcctatgagtttttttgcggagcggttgacgaattggaaaaagtaatcacggcccgcggcgggcgggtggtgctgccgccggtcaaaattgaaaacaatcctgagggcagtgaggaagaagagctccgggaattcggaagacagtttgccgcgctgtgcagccagccggcagaataaaggcttgttcctttttttcttgtctttgtatccttcctttgttacagtaatgaggtagaaaatcagaggaggacaatacatatgaaaatgatggatgcaaatgaaattatttcatttattcaaaatagtacaaaatcaacgcctgtaaaagtgtatgtaaaaggcgatcttgaaggaatcagctttggcgattccgctaaaacattcctgaacggccaatccggcgtcgtttttggcgagtgggctgaaattaaaagcgcaatcgaagaaaacaaagacaaaattgaggattacgtcattgagaatgaccgccgcaactctgcgatcccgatgcttgatttaaaagatgtgaaagcgagaatcgagcccggcgctattatccgcgaccaagtcgaaatcggcgacaatgccgttatcatgatgggtgcatctattaatatcggttcagtcatcggcgaaggtacgatgattgatatgaacgttgttctcggaggacgcgcgactgtcggcaaaaactgccacatcggagcgggttctgtattagcgggcgttattgagccgcctagcgctaagcctgttgtcgtagaagacgacgttgtgatcggcgcaaatgcggttgtgcttgaaggcgtaacaatcggtaaaggcgcggttgtcgccgccggagccatcgttgtaaatgacgtcgagccgtataccgttgtagcgggaacaccagcgaaaaaaatcaaagatatcgatgaaaaaacaaaaggaaaaacagaaatcaaacaggaattacgccagctgtaaggaatggtttgatagaatgggcgtggatgataaaatccacgccttattcttatctcaaggaggaatacatatggaaaaagagcggctcattgccatccgaagagatctgcaccgcattccggagatcggctttcaggaatataaaacccagcagtacctgctgaatctattaaaccaatatccggaagaaagaattgaaatcgaaacttggagaaccggcatctttgtcaaagtcaacggcacggctccggaaaaaatgctcgcctacagagcggatatagacgctctgtcgattgaagagcagacggggcttccgtttgcatctgagcaccccggttttatgcacgcatgcggacacgatatgcacatgaccatcgcgctcggcattattgatcattttgtccatcatcccgtcaaacatgatctgctctttttattccagccggctgaagaaggaccgggcggggcggcaccgatgcttgaaagcgatgtgctgaaaaaatggacgccggatttgatcaccgccctccatatagcacctgagctgccggtcggcaccatttccaccaaaagcggattgctgtttgccaatacgagcgagcttgtcatcgatcttgaggggaaaggcggacatgcggcatatccgcatacagcagacgacatggtcattgccgcgagcacgcttgtcacgcagctccaaacagtcatatccagaaatacggatccgcttgacagcgctgtaattactgtcggaacgattaccgggggcacggcgcaaaatatcatcgcagagcatgctcatttggagggaaccatccggacgctttccgaggaatcaatgcgtatggtgaaaaagcggattgaagagcttgtcaaaggaattgaaatcggcttccgatgcaaaggaaaagtcacgtatccgtccgtttatcatcaagtttataatacaagcggcctgaccgaagaatttatgcaatttgtcagcgatcatcagcttgctgacgtgaaaacggcgaaagaagcgatgaccggagaagatttcggatatatgctgaaaaaatatcccggctttatgttctggctgggggccgattcatcccacgggcttcatcacgccaagctgaacccggatgaagatgcgatggaaaccgcggtaaatgtcatggttggatatttttcgaagtatgccaattaaatccgaaaagaagaataatctaacaaaaattgagcattctacataacggaggtgttcaatatgacgaaaaaaattggaattgaacaatctttatcggatgtagaacaggcgttaaaacaaaaaggatatgacgtagtgatgatgaagactcctgaggatgcgaagaattgtgactgctgtgtcgtaaccggacttgacagcaatgttcaaggaattgccgatacatcaactcaggctcccgtcattacggcttccggaatgaccgccgacgaaatctgcagcgaagtggaaaaaaaatttcattaaaaagaaaaaaccgaagcttacgcttcggtttttctattcggcggaagcggcgtttttaaaacggtcaagcgcgatttttatttctctccgcagtacgcgttcaacccgccattgctccatattttctgttttggcaatgattctgatcaccatttctgacgtgcttaaatcttgaaccccgatgacgtccggcccttccttaatctgcgggagctcagcggctgctttgtcacacgcggtttgcaggatttgaatggtttcatcaagatttttttcaagcggcactttaatatcgacaagcgcctgcatcgttccgcgggaatggttgctcacattcgtgatgccccggttgggaagatagtgaagcgtgccgtcaaagctccggatttgcgttgtacggagaccgacctgctcgacaatgccgctgtagccggcaaccgtaatataatcaccgacgtcaatctgtttttccaaaaggataaaaaatccggtgacgatgtcactgacaagcccctgagccccgaagccgactgcgagaccgaccacgccggcgccggcaatgagagcgctcggattgtagtgaaataaatccaaaatcatcacgataaaaacgaatatcaggatgtatccatacacattgagcgcgaggcttcgcaaagtataagcgcggcccgtggagaggttgttttgttgctcgaatttctgaaacagatgcttgatcagcttttttcctgccgtccggaaaataaagtacgctaaaataatgagagccagctttatgatgaaaatcccggcagatgtgagaagcccggcccaatcaaagtgttttaaatcaatcatagtgatgtcttcctttcaagtctattgcagaaaaagctaaaagtgatatacccgttttttaaataagataaaccttttcatagaaaccagttattacatttatgatttgttcatattgccccggtttcaatatcttcatttttgtgaagatatgtactaaagaatctccacactcattttaacatggtgattcagccaaatcatatcctttggagagaaaacaggaggacgttgcccggcggactgaaagccccggcaaaaaactttttcataaggagggaaatgagatgaaattacatcagcaaatgcctgaattgtccggcgctaaagcatggattaacagagaagtcacgaaggaacagctggtcggcggaaagccggcactgattcacttctggtccgccagctgccgcatgtgtaaagaagcgatgcctgaggtgaacgggtttcgtgataaatataaagatcagctgaatgtgttggccgtccacacgccccgttccgaagacgatcttgatcttgagaaaatcaagaaaacagcggctgagcacgatatctctcagccgatttacgtcgacagcgatcatacgctgactgacgtatttgaaaatgaatatgtgccggcttattacgtttttgataaaaacggacagctccgccattttcaagcgggagagagcgggatgaaaatgcttgaaaaacgcatcagccgggtactttcagaaacggagcaggcttctgagtaatcgggacaatctccgtcggactattgtctcggttctgcaaaccctttgccgttaggtaacagggtttttttgtgtctattggataaaaaattccaatatgacatgtgtggcttaaaaaataagagaaacagcggtaaacacgctgtaccgcttgttttatccatatcattatcttttacatattatagtcgaaaattgtagatatcacgctaattttcattaaacaagtaatttcaagttatattttgaaatggttgaataaattggaactttgtccagaatcccctatatgataagggatttttgtatataaagtaccattttcagaaaataagcaatttttcatagagtaaataaaatagtaaaatgataaaataatagttgataaaattacttttgtaatctaatatcttaataaaagcgtttaaatttttgacagggggttttacacatgtttaatgaaagagaagcgctgcgcttacgtttagaacaattgaacgaagcagaggtaaaagtcattcgtgaatatcaaatagaacgtgataaaatatatgcaaaactgagagaattagacaatacgggcagcctgtccgatacaaaaaaagagtttcgtccggagaaaaaaaatgactccctcccggtacttgcagagcttgcagcacaggaaatgagaagctatcaaaagccgcagacacagcctcaatcctcccagcagcagatgcagtctattacgtctcttcccgcaggcattccagacggttctacaagaagaagaagagggacggcgagaccgggatcgaaagcggcaaaactgcgcgaagcagcgattaaaacattgaaacgccacaatgcagcgatcaaaagttccgaactgcaaaaggaaattgaaaaggaaagcggccttgaaattcctaatatgacaacatttatgcaaagcttaattaaaatgtatccggaagtgaaaaaaccataccgcggccaatatattcttgagggagaaatttctcaggaaacagcagaaacggcaaatgatacggctgctgaataaaacagtaaaaactgcttgcgttactcaagcagtttttttgcgctttcccgcttattctgcggaagtgacgcatcttttccaggctttttttcaagcttgacaacatatttttggaaaggcttttcgccgtcagcgcgttctttcaacgcatccagtttttcatcaaacgactgatcgcgggactctgattgtacaaattgtttttgcagggagatgacttgttcggtaacggctgtaagcaagtcttctgcctgaacagtctctttggaaacggaagggatttccagagtttgttccgccggttccgccgtgcggctgtcaatatcagcaaaatggccggcaatccaagcatcactttcgtccagctgccgtttatacgaaagaatggtttcttgaaataacttttctttcgttttttctatttctacaagccgttcttttgtttctagtattcgatctctcatatgattaatttctattttaatatgtttgagctggtattctttttctatcatttgtgtttggagccgggtattttcgtctgcagcggcatgataacgctgtttcatatcttcgtgagaagtccgttcggtttgaatggcggtctcaagtgagcggatgcgggtatgtaagtttttattttcttcttcaaattttatatttgtaagatgcagacgatgcttttcttccatctcatttttccgacgaaacgtttcctgctgaagcagttcttgcagaatgacgattttatcgagcagcccggctctgatttcatgcaaagaacgctccgtgtcacttgtctgtttgtgtttttgagccatggcttccaattcgtcagaaagcttgtgaagccgctctttaatattggcgttttcctcctgaagcttattatttttttgatggaagtagcttgcttcaaattctgaaattatttttctgcatctggaaagttcggatttcaagtaaaggttctcttgagaagtgtcgtggaaaaacggacctgatattttcataagaaccatctccctcatgatgttaacactacaatatgggaaaggaacaacggctattcctcttaattaaacagacaagcaacgtaatattgtatttcggctgaggcgtttgctatgcttttatatagaatgggagagagatgacatgaaacgggtgaatgtaatattagcggggggagcttcccgaagattcggagaaccgaaagcttttgcaaagtggaagggcggcatgttttatgaacaggcgaaaaaagccttcggcggcggagaaacggtaattatcagccgccctgagcatataaaaaagttcttatcaaacagggagcggcatgtttttgccgatgagccgcggtttcggggaatgggcccgcttgccggcatatatacggcaatggaacaaacggaaggcgaaacatatacggtcatatcctgtgacacgccgctcgtgacaagaaaaacgatggctgcgcttgaaatgaagctgaccggaaacctggacgctgtcataccggtttgtgaaaacagagagcagcccctcttggcggtttaccataaacgggtgcaggatgtgctttttgatcagctgacacaaaacaaactgaaaatgacagacacgctgaaacggctgtctgtctgttatgtgcaggctgaagacatcggcgccgggccggaggagttcgctaatgtcaacacacgggatgattacaccagacttttggcgcatgtcgagtcttcaaatcaggactgatcgggaagaaacatggtatgatggaaataaaaatgcaaggggacaacacagatggaagagcgctattcgcggcagacaagatttaagccgataggggaaaaagggcagcaggcgctggctgacagcagtgtcctgattgtcggagccggagccctcggaacagccgcggcagagggcctggcaagagccggagcgggccgtatggcgattattgaccgggattatgtggaatggagcaatttacaaagacagcagctgtatacagaagaagacgcgagacagcgcctgccgaaagcaatggcggccaaggcgcgtcttttagaggtaaacagtgatatacatatcgatgcttacgcggcggaaggtacggcggaaacacttgaaccgctgatcgaacaagcggattgcatcgtggatgcgacagataattttgaaacgagaatggtcatcaatgatctggcgcagaaaacgaaaacaccttggatttacggtgcctgtgtcagcagtcagggaatgtgcatgacgattattccgggggttacgccgtgtttatcctgcctgtttgagcaaatgcccgtaggcggagcgacatgtgatacagcaggcatcatacctccggcggttcatatcgtctccgcttatcagcaggcggaggcgctgaaattgctgacaggaaatcatgcggcggtaaatcggcgctttttcacgtttgacgtgtggaataacaccaatatgagcataaatgtggatcagatcaaacgggatcattgcccttcctgcggcgcggagcccgtatatccgtatctgcagcctgaaaacaggccgaaagcaagcgtgctgtgcggaagagacaccgttcaaatcagatcggaagccttaaagaggctggataaagaagagcttgtcaaacgtctgaagcagatcggtaaagtggaagcaaatgaatttttgctgcacatggcgtacgagcgcttcagaatcgttatttttcaggacggacgggctctgattcacggtacaaacgatataaaagaagcgaattcagttctggccagagtgatcggactgtaggaaggggatgtattgctatgcttgaaaaaagaacgccgattcaggtggacgaagcagtccgccgggtgagccggtataaaaaacagggggataccgaatgggtggcgcttgaggacagtctccaccgctatttggcggaggatgttaaggcggatcatgatgtgccggcctttaaccgttccccgtatgacgggtttgccatcagggcgagcgattcaaaaacggcttcccgtgacaatgccgtcacctttgaagtcattgaccatatcggagcaggcgccgtgtcagaaaaagaactcgggccttatgaagcggtccgcattatgacgggggcgcagattcccagaggcgccgatgccgtagtgatgcttgagctgacaaaaatgttttctgaaaacggcacgaattacatgtcagtgaaacgcccttttcatgcgggcgataatatttcatatcaaggagaagatgcgaaaaaaggcagctcgctattaaaaaaagggacgaaaatcacgccgggcgtaaccgctcttttagcaaccttcggctatgcttccgttcccgtggtcagaaagccggttgtcggcattatcgcaacgggaaccgagcttcttcatgtcagcgatccgcttgagccggggaaaatccgcaacagcaacgctgccatggtgtatgcccaggtcattgaagcgggtgcggtaccgctgaacttagggaaaatttccgatgattttgatgacagctatgctgcggtgaaggaagctatgaaaaaagttgattttctgatcacgaccggcggcgtgtcagtcggcgattttgattttcttccggacatttataataagctcggagcggaagttctttttaacaaagtggcaatgcgcccggggagcgtgacaactgtcgcccgggccgatgacatgctgctgttcggcctttcaggcaatccgtccgcatgttatgtcggattcaccctgtttgtcaaaccgatgattcagacgtggcttctgaatgaaaaacctcattccggatgggcggaagccgtgttaacaaacgactttccgaagccgaatccgtttacgagatttgtgagggcgtttgtttatcataaggacggaaaaatgatggcgtcaccggtcggtctcgacaaatcaagctcagtcacatctcttgccgaagcaaacgcgtttatccttctgccgggaggaacgaggggatatgaagcgggccggacggttcacgcgctcctcatccgtgatgagaatggaagtgaatggccgtggtcaattctttcccgatcgtccagatcgtaggttttcaaaacagcggtaaaacaacgtttattgaacgtgtgctgaaagcggcgccgaaagagtgcgatattggatgtttaaaacatcacggacatggcggagaaccggaacctttttctgacggaaaagactcggagcgtttttcaaaagccggagccgcggttacggcagtagaaggggacggcgtcctgcagcttacggcgcgaaaaaaatgggatctggcgggtttgatcagtctgtatgaatgtctgggaattgacggtcttctcatagaggggtttaaacatgcgccgcatccgaaaatcattatgatcaaaaacagcgaagattggcaaaagctgaagcatttggagcgcgtgatcgcggttgtcagcagaaatacggagcatatgccgacagatgcaggcaagcccgtattccatgcggacgatccggctgccattatgtttgtgctttcgcagctgaaaggggaatctgcttaaatggaacgttttcaaattacaagggaacctatcattgcggaaaatatcgtaaaaaaagttgaaaagcgtgaagccggcgccatcacaacgtttatcggcacggtcagagagtggactgcaggacggcggacggtgcgtctcgaatatgaagcgtatgaaccgatggctgttcaaatgctttctcaaatcggcagtgaaatcagcgcgaaatgggaaggagccgaagctgcaatcactcaccgtgtcggcgtccttgatatcggtgaagcagcggtcgtaatcgccgtgtcttctccgcacagaaaggcggcatatgaggcgaatgaatatgcaattgaacggataaaacagattgtgccgatatggaaaaaggaaatctgggaagacggggaagaatggataggcgatcagctggaaacaacgccctatccgaacggaaaaccggatttggataaaggggaatcgcgatgattaaagtattattatttgccgggcttgcggagcaggcgggaacaccggtcattgaacttgacgaaaaagagacggcggcgtctgctgtaaaaacgctgttaaaggaacggtacggccttcagacgattgacaatgccatgatcgcaatcaatgaaacatatgtaaaagacaacagcaccgtaacagaaggtgataccattgcctttatccctcctgtaagcggagggtgaaaaaagagccggatgtgcatcattgccatccggcttttttgtttataggcgctgaatttcagagaatatttaaatgggatttaaagggtttttcaattgaggcggttttcactgcatgaataggctgataacagtgcctttacaaggttttgagccacccgtcataccggtctgacgatgcttttttttacataattatggaacgtaaagctgagaatttgtgttacaatttagcataaatacgcaaacggcaaaaaaattgaaacttctctcagcctaaagcgtacgtataaacagaataatacataggaggcatcagccatatggaaccaaacctggaaaaaagcaatacggcagtcacggaaaagccgtcaattttcggcgtcattacaagtcctgttgtgcagtttaaaagattaaaagaaaagccggtcatcggcattcctctcctgattgtcatcattctcatcgcggccggcagtattttgcgcggactggggatgaattatgaagaactgctgaacagctcatctcttgacggattgaccgatgatcagattgaaatgaccaaaaccattgcgaaattcggctcgattttcggagggattttcggaggcattatcggtctctttatcgttccgcttatttattggctgtgcgtcaaaatttcaggcggcgtgacaacttataaaaaaatgctctcactcggcctctttactgcatttattactaacatcggcttagtcattaacggacttgtcatttattttaccggtgcgggctcactgtaccctgtcacatctttggcgagtgtcataccggccggagacggcgtatcggtctttttaagcgcgatcgatattttcagcatctggagctatattctgctcgctttgggacttcgctatacaggcggtatttcgaaaaaagcggcctggacttccgcgattgtcctgtttgttattatgcttttggtttcggcagtcggaggactgttaagttcagtgacagcaggtgtataacatgaaaaaaatttggatcggaatcggcatcgccgtaattgttgcagtattcatcggtatcaatatttataagtctgccgctcccgcgggcggcagcgccggaaaaaaaatcgaaaccggaaccatggaaaacagagaaatctcatctacggttatggttccgggaacacttaaattctctaaagaacagtatgttttttatgaagcagataaaggaactcttgataaagtgaaagtaaaagaaggcgacaaagtaaaaaaagggtcgtcgttagtcacttatacaaatgagcagctcaaccttgataaagaacaaaatgagttgacagaacaatcaaaacggatgcaaatcgaacaagttgaagaaaaactcagagcattaaacagcaaggaacaagatctggcaaaacaagtgggagaagcggaagccaaaaaacaaattgaatccgaacggactgatctgcagcttcagcaaaaaacggcggaaatcgaattaaagcaatctgatttgcaaaagcagtctcttgaaaatcaagtgtcgaatctcaatgttaagagtgagatggacgggacggttatctcggtaaatcaagaagcggcttctaaaaaatcggatattcaagaaccggttatacatataggagacccggaacacctggtcgttgccggcaatttgtccgaatacgacacgctgaaagtgaaaaagggccaaagcgttacaatcacctcagacgccatccccggcaaaacgtggaaagggagagtggcggctgtcggcctcgttccggatcaaaagtcaagcgctgcttcgggggaaagcacggaacaagccgtccagtatccgtttcaggttaagctgatcggaaaccttccggaaggcaagccgggatttaaattaattatgaacattgaaaccgacaaacggaaagctgacacgctgccgtcctccgcagtcaaaaaagacggagatgagcactgggtctttacggtaaaagacgggaaggccaaacgcgtgaaagttaaagtcggcgataccgcaaatcagcttacggagataaaagaggggctttcaaaggatgataaagtcattctgaatccggctgacggtttgactgacggaacggatgtgaaagcatagatgattcagctttcaaaggtgaaaaaaagctatcagatcggcaaggagacgtttgatgttctccgttcaatcgacctgacgattgaagaaggagaatatgcgtcaattatgggaccgtcgggatcgggaaaatctacgattatgaatatcatcggctgtctggacagaccgacgtccggcagttacaggcttgcgggcgaagatgtttcttcatgcaccgaaaaagagcttgcggcggtccggaacaaatcaatcggatttgtctttcagcagtttcagctgctgccgcgattgaatgcaagaaaaaatgtcgaactccccatgatctatgccggtatcggcaaaaaagagcgtgaggaacgggctgagcacgcgctggaaaaagtcggtttggcggatcggatgcgtcacatgccgaatgagctgtccggcggccagaagcagcgtgtcgcgattgcaagagctatcgtgaacgaaccgaagctcattttagctgatgaaccgaccggcgcgctggatacgaaaacaagcatttccattatggagcagttcacagagcttaatgcagagggcgtgaccgtggtgcttgtcactcatgagcctgaagtggcggactgtacaaacagagtgattttcgtccgtgacggcatgatcgtttcccgcgattctgagcagaggagagtgggggaatgagcctgtcagaaaatctccggatggccctcagttccgtaagagctcacaagctgagatcgattctgacaatgctcggaatcattatcggcgtcggttcagtaatcgttgttgtggctgtcggccagggcggagagcaaatgctgaagcaatccatcagcgggccgggcaatacgattgaattgttttacctgccgagtgatgaagaattaacagccaatccgaacgccttacagcaagcgagttttacagaagaagatattaatggattaaaaggagtggacggcgtaaagcaggttgtcgcttccgcggtaaaatccatgacggcccgttaccatgaagaagacacggatattacgctgaacggcattaacagcggctacttggacgtaaaaaagctggacgttcaagatggacggacatttacggacaatgattttctttccgggaaaagagcgggaatcatctcgaaaaaaatggctgaaaagctgttcgggaaaacgtctccgctcggaaaaatcgtctgggccggcggacagcccgtagaagtaatcggcgtactgaaagaagagagcggctttttatcgttaggactcagtgaaatgtatgtgccgttcaacatgctgaaaacgtctttcggtactaacgactacagcaacgtttccgttcagacggagtccgctgatcagatcaaaacaacaggaaaagaagcggcccgtctcttaaatgacaatcacggtacaaaagaggcctatcaagtcatgaatatggaagaaatcgcggcgggaatcggtcaggtcacgaccgttatgacgacgatcatcggttcgatcgccggtatttctctcgttgtcggcgggatcggggtcatgaatattatgctcgtatcagtgacggaacggacaagagaaatcggcatccgcaaatcgctcggtgccacgagaggacagattctgacacaattcttaattgaatctgttgtgcttacattaatcggcggcttaatcggaatcggtctcggctacgggggagcaacactcgtttcccttatcgcaggctggccgtcgctcgtttcctggcaggtggtttgtatcggcgtgctgttcagtatgctgatcggtgtcattttcggcatgctgcccgccaacaaagcatcacgcttagatccgattgaagcgttacggtatgaataaccggcgccccatgcagtctgcatggggttttttgtgttttaatgattgaatgaatataatagacttttttcatttatgataaaaagaaaatgtcatacaattgtccccctttttgtcgaatttacagtttacaaaccctatgtacatacgttaatatgaacaaatgtgaaagattttgatagttattgaatgaatttgagtgattttagttgcttgaagtaaaaaaagcgtttacaattatcttgcagccgaaatgaatacgttttcaaaggaggcggaatatgctcactcctgaaaggtatcagctgattatggatcagattgaaaagcgagatgtggtgaagattcaagagctgataagcatgacaaatgcttctgaatcaacgatcagaagagatttatcaacacttgaagagcgcgggtttttaaagcgcgttcacggcggggcgtctaaactttccaacagcaggcaagaacccgatatgcttgaaaaatcctccaaaaaccttcaggataaactgaagatcgctgaagaagcggcatctttattagaagaaggtgactgtatttaccttgatgcgggaacaactacattgcacatgattgattttatagatcatacaaaggacattgtggttgtcacaaacggggttatgcatatcgacgctttaataaggaaagggattcctttttatcttctcggaggatatgtgaagcatagaacaggtgcgatgatcggcggcgcctcattaacggcggtcagccagtaccgttttgacaaaagctttctcggggtgaacggcgtgcacattgaagccggctttacaacacccgatccggatgaggctcttctgaagacaaaggctgtgagacaggcgaaaaatgcgtatgttttagccgatccttctaaattcggcgagatttctttcgcagcgttcgccgccttgggcgatgcagctatcattaccactgaagctgaagaacatgcattcgataattaccaagaaaaaactgtcgtaaaggtagtgaaaccatgatttacactgtaaccctcaatccgtctgttgactatatcgttcacgttgaagattttgccgtaggcggtttaaaccgttcaagctatgacacgaagtatcccggcggaaaaggcatcaacgtttcgagattactgaaaagacaccatgtgccgtcaaaagcattggggtttgtcggcggatttaccggaaattatatcacgtcatttttgcagcaggaaggtctggaaacggctttttctgaggtggatgaagacacgcgtataaatgtaaaactgaaaacgggcgatgaaacggaaattaacggacagggcccgacgatttcagacgaagtgttcaatgcctttttagaacagttctccgctctggaagagggagacatcgtcgttttagcgggaagcatcccttcttccctgccgcataacacgtatgaaaaaattgctgaggcatgcagaaagcagaatgcccgggtagtggtggacatctccggtgaagcgctgatgaaagcgacagaaatgaaaccgtttttgatgaagccgaatcatcatgagcttggggaaatgttcaatacggtcattgattcagccgaagctgccgttccttacggtaaaaaattaattgaacaaggcgctgaacacgcgattgtttcgatggctggcgacggtgcgcttttatttacgaaagaggcggttttcctcgccaatgttcctaaaggaaagcttgtcaattcggtaggcgcgggtgattccgtcgtcgcgggattccttgcgggaatttcaaaacagctgcctttggaagatgcgttccgtttaggagttgcttccggaagcgcgacggcattttctgaagaactcggaactgaagagtttgtacagcagcttcttcctgaagttaaagtcacacgtctatagaggaggaaagaaaagtgaagataactgagctgttaacaagagatacaattcatctcaatatagaaagcaaagagaaagaaaacgttatcgatgaaatggtgacagtgcttgacaaagccggcagattaaatgacagagaggcttacaaagcagccattttaaatcgtgaaagccaaagctcgacgggaatcggcgaaggtattgccattcctcacgcgaagacggcgagcgtcattaacccggccatcgcattcggccgttctaaagatggtgtggattatgaatcattagacggtcagccggcacacttggtctttatgattgcggcaaccgaaggagcgaacaatacgcatcttgaagcattatcaagactttcaacgcttcttatgcgtgaggaaatccgcaaacagcttcttgaagctgaatcagaagatgcgatcattgacatcatcaatcagcatgacaaagatgacgatgaggaagaagaagagcaggaagaacaggcagcgccgtcaggaaaagggaaaatccttgcggttacggcatgcccgacaggtatcgctcatacgttcatggcagctgacgcactgaaagaaaaagcgaaagagctcggcgttgacattaaagtcgagacaaacggctcaagcggtattaaacataagctgacggctcaagaaattgaagacgcgcctgcgattatcgtggcggctgataaacaggttgaaatggagcgctttaaaggcaaacatgttcttcaagtgcctgtgacggccggtatcagacgtccacaggaactgattgaaaaagcagttaaccaagatgcgccgatttacgagggcagcggcggaggatcttccgcttcaaatgaagacggcccgaaacagaaatcaggcacaagcatcggaagtactttctataaacacttaatgagcggtgtcagcaacatgctgccatttgtcgtcggcggcggaattctcgttgcgatttcattcttctggggaattcattcagctgatccgaaagacccgacatacaacacgtttgctgcagcgctgaactttatcggcggcgataatgcgctaaaactgattgttgcagttcttgccggattcatcgcaatgagtattgcggaccgtccgggatttgcgccgggtatggtcggcggatttatggctacgcaggcgaatgccggattcttgggcggactgattgccggattcttagccggttatgtcgtagtccttttgaaaaagctgtttgtctttatccctcagactcttgatggattaaaacctgtattgatttatccgctgctcggtatttttatcaccggtgtcctgatgcagtttgtcattaacacacctgtagcagcgtttatgaatttcttaacaaattggcttgaaagccttggaactggaaaccttgtcttaatggggattattttaggcggtatgatggctatcgacatgggcggcccgctcaataaagcggcgttcactttcggtatcgcgatgatcgatgccggaaactatgcgccgcatgcggccatcatggcgggcggaatggctccgccgcttggaatcgcactggcgacaacattctttaaacacaaattctctaaacgtgaccgtgaagccggtattacgtgctacttcatgggagcagctttcgttacagaaggcgccatcccgtttgcagcggctgatccgcttcgcgtcatccctgcagccgttgtcggttctgcggtagcgggcggactgacagagtttttccgggtaacgcttcctgcaccgcacggaggaatattcgttgcattcattacgaaccatccgctgctttacttaatgagcatcgtgatcggagcgattgtaacggcggttatcttgggaatcatcaaaaaaccggtagtagagaaataagcgaaaagcgtcctttacgggcgcttttttcaatcatatgcgcatagaagcgttatgtattttgtgatgagttgtgataaagtaaagatggtacatgaaccgaaacagtgatcgtctaggaggaaccacgttgactgaagaacaaaaacctacttctgaaaaatcggtaaaaagaaaatccaacacgtattgggaatggggaaaggccatcattatagcggttgcacttgcgctgttaatccgccatttcctgtttgaaccgtacttagtggaaggatcatcaatgtacccgacattacatgacggtgaaagactgtttgtcaacaaaagcgtcaattatatcggagaaatcgagcggggggacatcgtcattattaacggcgatacgtcgaaagtccattatgtaaagcggctcatcggaaaacctggagaaacggtggaaatgaaaaatgacacgctttatataaacggcaaaaaaatcgcagaaccgtacctcgcgagcaataaaaaagaagcgaaaaaactgggagtcaacctgacgggagatttcggccccgtaaaggttccgaaaggcaaatacttcgtcatgggcgacaatcggctgaattcaatggacagccggaatggcctcggcttaatagccgaaaaccggatcgtcggcacctcgaagtttgtgttcttcccgtttcatgatatgcgtcagacaaaataaaaacgccgcgctgcccgattcggacagcaggcgttttttatttggcaaacgaggccgcgacggcgatgaacaataccgtggccagcactgatccgacaatggccagaacgctgaaaaaaagattcacctgcttcttctctttgccgcgtttttcaagcatccgttttgaaaagagatgcgaaaacgtataaatgagggcgattccgacatacaagccgatgtcacgtgccgtaaagcctgtgacggccagaaaaaccccggtgaagaaaatcataagacagtattctgtgagtgttaaaagcttcaacttgttcctccgtgatgaatatgtatatatatctattgtatcacagcgctccgggtttgacgcctgcatcttttcaaacccgtatattcgcagggaaacatttctcttcccctttattcatggtatacttttaatgatgatagacacgatggaggattctaaatgattgctgtaaataatgtgagcttgcgttttgcggatcgcaagttatttgaagatgttaatattaaatttacgccgggcaactgctacggattaataggcgcaaacggtgccggaaaatcaacatttttgaaaattttatccggtgagctggagccgcagaccggcgatgtccatatgagtccgggcgaacgtcttgccattctgaagcagaaccactttgaatatgaagactgtgaagtgctgaaagtcgtcattatgggacataaacgtttatacgaagtcatgcaggaaaaagacgcgatttatatgaagcctgatttttcagatgaagacggcatccgcgccgctgaacttgaaggagagtttgcggaattaaacggatgggaagctgaaagtgaagccgctattttgttaaaggggctgggcatctctgaagacctgcatacgaagaaaatggccgacttaggcggttcagaaaaggtgaaagtgcttttggcacaggcgctgttcggcaagccggacgttctgctgcttgatgaaccgaccaaccacttggatctgaaagcgattcagtggctggaagagtttttaatcaactttgagaacacagtcatcgtcgtatcccatgaccgtcactttttaaataaagtgtgcacgcacatcgccgatcttgattttaataaaattcaagtgtacgtcggcaactatgatttctggtatgaatcaagccagcttgctttaaagctttctcaggaagccaacaagaaaaaagaagagcagattaaacagcttcaggagttcgtggccagattcagcgccaacgcctctaaatcaaagcaggcgacatcaagaaagaaactccttgataaaatcacgcttgatgatatcaaaccgtcatcacgccgttatccttatgtcaatttcacgccggaacgcgagatcggaaatgacgtgctgcgggttgaaggcttaacaaaaacgattgacggggttaaggtgcttgataacgtcagctttattatgaacagagaagacaaaattgcatttacgggccgcaacgaacttgccgttacgacattgtttaaaatcatttccggggaaatggaagcagacagcggcacatttaaatggggcgtgaccacttctcaggcgtacttccctaaagacaacagcgaatattttgacggcagcgatgcgaaccttgtcgactggctccgccaatactcgccgcatgaccaaagcgaaagctttctgcgcggtttcttaggacgcatgctgttctcaggagaagaagtcaacaaaaaatcaaacgtcctttccggaggagaaaaagtgcgctgcatgctttcaaaagcgatgctttccggcgcgaatatcttaattctggatgaaccgacaaaccacttagatttggaatccattacggcgcttaacaacggcttaatcagctttaaaggcgctatgctgttttcatctcatgaccatcagtttgtacagacaattgccaaccgcatcattgaattaacgcctaaaggcattgttgacaaacaaatgtcttatgacgaatttcttgaaaacgcggatgtgcagaaaaagcttgaagagctatacgcgtaataaagaagcaggggagactctgcttttttatttatgaaaaaagttttcaatcttctgacttcccgttacaataaaggaatacataaattgaaaagagacggaggaatgcatcatgaagtttttagttgtcggagctgggggagtgggcggatatattggcgcacgtcttgcagaaaagggaaatgacgttacgtttctcgtccgtcagaagcgggcggaacaattaaaagagacgggattgaccgtcaaaagtgcaaatggtgatgtttcaatcaagccgaaaataatcatggcgggcgaagatggagagtttgacgccgttatcatcgcatcaaaagcgtattctttgcaggacgtcattggggatgtcaaaccgtttgtcaaaccttcgtcggtcattattccttttttaaacggatacaggcactataaccagctgtttgaagctttttcaaaacggcaggtgctgggcggcctctgctttattgagagcgcccttaacgacaaaggggacattcttcatacgagcgctgcccaccgctttgttttcggtgaatggaacggggaacgcacggaacgtataaatgagctggaaaacgcatttgcaggtgtgaaagcggatgtcatcatcagccgggagattgaaaaggacatttggaaaaaatatatgtttattgccgcgcaggcgggcgtgaccactctgtttcaacagccggtcggaccgattttagaaacagcaggcggccgcagcacggcaaagcgcctctttgccgaaatcggagccattttcaaggctgccggcatcccgaaagatcctggtctggaagaagagagttatcgcacattgacaagcatgtcttaccatatgaaatcgtcgatgctgagagatatggaaaagggcagggtgacggaaggtgatcatttacacggctttttgcttgagaaagcgaaaggcttgtcaattgatacacctgttttggaaaccgtctgcgccaacttgcaaatgtatgaagcgaaataaaaaggaggcctgatcgcctcctttttttattaaaatgcccagtttccgtttctgaagatcggttctcttttcccgtccgcggtaataccgtcgatattcatgtctttggaaccgaccataaaatctacgtgtgtaatgctttcatttaagccctctttaacaagctcttcccgtgtcatttgtttgccgccctcaatattaaaggcatacgcactgccgatcgccaagtggttagaggcgttttcatcgtacagtgtgttgtaaaataaaatatttgattgtgaaatcggtgaatcgtaaggcactaaggccacttcaccgagatagtgtgagccttcatcggtttcgacgatgccttttaaaatctcctcgcctttttcagctttcacatcgacaatgcggccgttttcaaaggtaagagtgaagttatcaataatgttgccgccgtagctcagcggtttcgtgctggaaaccgtgccgttcaccccgtcacgctgcggaagggtgaaaacctcttctgtcggcatgttggccatgaattcgtgaccgctttcattcacgcttcccgcgcctgcccatacatgttttttcggcagttcaatggttaagtctgttccttcagcctgataatgcagggcgctgtaatgttttttgttcaggtgttccactttttcatgaagattttgatcatgttttttccatgcttccacagggttttcttcatttacgcgggtcgttttgaaaatttcttcccataaaagctgaacggctgtttcttccggctgatccgggaacacttttttcgcccagcctgttgaagcagctccgatcaccgtccagctgaccttatctgattgaatatattgtctgtatgtatgcaatgcttttccggcggctttttggaacgctgcaatccgtttgccgtcagtgccttttaacaggtcggggtcggatgagacgacagaaataaacgcagccccttttttcgcgagctcttcttttccttttgcttcccattcaggatactcttcaaacgcttcaaaaggtgccatctcgtattttaatctggacagttcatcgtcctgccaatttacggtgacgttttttgcgcctttttcataagaatgtttggcaagcagtctgacaagttcccggacatcagttgaggcattgattacgacatgctgtcctctttggacattgacgccgacttctaccgccagctgagcatatgtatttaacttttcagtaaacgaactcatcgttcattcctcctcatcggtttttctcatcatatcaaataacgcctcataaaggaaagaaaggagcacaaacgaaaaagacacagcttttgctgcgtctttacgggtgattcagttttacggcgccgccggccggagaatggggcatattggccagtgaaatgctcataccccccaaaataattccgcttaaaatgacggctactgctacgcgtcttcccacatctctaagcatatgcttcctccttaatgtttctccagttctcacaatatgagccggccggagaaaaaagaagcacaatcttattatttaatcgctttttgcagcttgtcgatgacgtctaatgaacgcccagtgccgatagccactgattcaagcggatttgccgccaaatgaacgggaacgacgatttcatctgtcagccattctttcatcccgtttaaaagggagcctccgccggttaacacgacgccgcggtcaacgatatcaccgctgagctccggcggacaatcttcaagcgtcgctctgatcgcttcaagaatatgcaggagcgactcacgcatcgcgtgctgaatttcattagactgcagtctgattgtcttcggcagaccggttacaaggtcacgcccgcggatttccatcgtttccggcacatgttcgatcaatgcaaatccgatttccattttcacttgttctgccgtacgttccccgatcagcaggttgtatttttttctgacgaacgaggcgatatcttcatcaagctggtcgccgccgattctgatcgaatggcaggatacgacgccaccgaatgagatgatggcgacttcagtcgtaccgccgccgatatctacgacgacgtttgcgaccggctcgtcaacagggaggtcggccccgattgcagcggctacgggttcttcaatcaagtgaacgtttttcgctccgcagtttttgacagcgtcactgatggcgcggcgttcaacggctgttgagcctgaaggcgtgcagacgacgacattcggtttgcggaaggtcattccgattttttttccggcttttttcataatgtgttttaataagtcagttgtcatatcataatcagcaatgacaccgtctttcatcggccgtacggcgacgattttccccggcgtctttccgatcatgcttttggcatccgttccgatggcaagcaccgctttcgttgttgtatctacagcgacaacggaaggctcgtttaaaataatacctttatttttactgtaaacaagtatattagcggttcctaagtcgattccgatctcagttgattgaaacatgttttcacccaatccctatcctgatttaattgattctacatttaaagtttctgagaaaaaccacgatttttggggtttccgccgggaatgaaatgtttttgtaaaaaaggagggaaagtctgtatcccgtatttcaaaaggctttttttctgtaaaaaacattcatttccggatgctgagaaacttttgctccgttcctttcgtctacgtttatgaaggattttccttggacataaagaagagacattaaaggaagtaggggatttctatgaaatcaattggtgtagtaagaaaagtagacgaactcgggcgtattgtcatgccgattgaattgagaagagcattggatatcgctattaaagatagtattgaatttttcgttgacggagacaaaattgtcttaaaaaaatacaagccgcacggcatttgcttaatgaccggggaaattacctccgaaaatcaggagtacggcaacggcaaaattattttaagtcctgaaggagcgaaaatgctgcttgaggaaatcgaggaagcgttaaaagatagatcataatcagcaaaaagggcggggcatcattccgtccttttattatgaacttgtgcaaaaactcacgggaaaagtaagcgaacctgctcaattaattgggaatagttatcattttttagtcaataatgcagtcaacaatgttacaatatatgtagaaatgctagcggcaggtgggactatgggaaaatatcaagcgcgtatcatttccttaatcttggcaatgatttttattatgttttgggattatttattttatatgattgaacggaatccgattaactggcccgttgacatcacctttaccgccgtcacattaatcagcgtctggctgctggcttattatgtggacaataaaaagcagctgctggcggagctgaaggacagcgagcagaaagcaaaggcgctttcagatgagaaaaaccggatcatggacaatttgcaggaaatcgtttttcagacggattcacaagggaatattacatatttgaatcaggcctggacgacgattacgggccactccatcagcgaatgtatgggcacgatgtataatgattattttataaaagaaaaacatatcattgattatattatctcccaaatcaagcagcagtccccgtcaggaatgtttacggccaaatatattaaaagagacggcacgattttttgggggaagtccattataagctgtattatgaccgcagacagaaatttgtcgggagcctggggacgatgtctgatatcagtgaacggaaaaaagcggtcgacgagcttctggaaacgaacgaacgccttgccatgcaatctcaaaagctggccattgccggagagcttgcggcaggaatcgcccatgaagtaagaaatcctttaacgtcagtcagcggctttctccagctgatgaaagcccagtatccggaaagaacggattatttcgatattattttttcggagattaaaaggattgatctcgtgctgggggagctgcttctgctcgccaagccgcagaccgtgacgtttaccgctcatcatctcaaccatattttaaggcaggtggcgacgcttcttgacacgaacgcggtgctgtcgaacactgtgattgagaaggatttcaggcagactgagtcctgtatggtcaacggtgacgaaaaccagctgaaacaggtatttatcaatattattaaaaatgcgattgaagcgatgcctgacggcgggaatattcatatttatacagaacgggatgaagaatacgcggtgatcagcatacaggatgaaggaaacggcatgtcgaaagaaaagcttgaaaacatcggcaaaccgtttttctcaacaaaagatcagggaacgggtctcgggcttccgatttgtttacgaattctgaaggagcataatggtaaacttaacattaagagcaaaaatggagaaggcagtacgtttcaggtgattctgccgttagaagcggctgctgtccaaaaggaggaaaaataacttgcttctttttgtatacggtttgttacggaagcgtgaagaaaaccatgaactgctgaaaagcgctccgtgtgtgtgcgagcaggccgcgataaacggtgtgctgtacgaaacggataaaggtcagcctgcggcgtctttagcagaaacagcttttgtgtacggggaattgtatgaaacagatcatcagatgatccgtaagctggatatgtattatgctgattttgaccggaaagaggttgccgtgacgacggatgccgggaataaaaccgccttcgcatatgtcgtaaagcccggccagtgtgcctcattcagccgtatcaaaagcggagactggaaagaataccgttttatgaaacgggaggatgacagtccggtttattatttcgcttacggctcctgtatggacaatgcccggtttaaacaggcgggggtcgaccacttctttgccgagccggtcggaggggcggttgttgaagggtattcgacgagattcacgttaaggcgtcctgacggttccagagccgatcttgttgaagacgggggacgaactgaaggcgtgctgtacaagctcccgtttgaagcggcaacctatctgtacaaaagagaaggtgttgataatcacacataccgtcccgcgttcatagaagtgtgtgccggcggccgtgtatacagaggcgtcctgacgtttctggttcttgataaagctgaggaaattgcgcctccgggtcactatcaggaagaaatcgaacgcggagcggacctgtatttatcacccgccttttcagagaagcttaaacgctatatgaactcattgccgaaaatgtgatactattcctattagagatattgtttaaaggagtactgttatgagaaaagagtttgccgttatcggtctcggacgcttcggcggaagtatttgcaaagcattaagtgaagaaggccttgaggtcatggcgatggatattgatgaagataaagtaaatgaatacgccaaaatcgcatcacacgcggtcatcggcgattcaaccgatgaatcggtgctgaaaaacttggggctgcgcaactttgaccacgtcattgtggcaatcggcgaaaatatacaggcgagcattttaacgacgctgatcttaaaggaactcggcgtgaacacgatcacggttaaagcgcagaacgattatcatgagaaagtgcttgcgaaaatcggggccgatcacatcgtccaccctgaacgtgacatggcaaaacgcatcgcccacaacatcgtatcaaataatgtgcttgattatttggagctgtccgacgaacacagcattgtggagatcgtggccaacagcaggcttgcgggcaacacactgcttgatctggacatccgggcgaagtacggcattaatatcgtggccatcaagagagaaaaagaagtgatcgtatctccgctggcgactgaaatgattcaaaaagaagatattctcatcgttatcggctctcttacggacatttcccgatttgaaaaaagagtgcttcatacaaagtgaaaagccgtccgtaaaaggacggtcttttattatgtcagaatagaaagacatttattgtgtaagcggtatattctgcaatttttattgactatgatcaggcgatccgatagcatattgtaccatataaagaaaaagaggaggcctcattttgaacaaagaaacactggctgaacggctgaatgcatcagccggcagacaaaaagccgataccgtcattaaaaacggaaaaatcatggatgtatttaaccaggaatggatttctgcagatatcgccattacgggcggagtgatcgtcgggctgggcgaatatgaaggggaagaagtcattgatgcagaaggtcaaatgatcgttccgggctttattgacggacatgttcatatcgagtcctctatggttactccgattgaatttgctaaagccgtcctccctcacggagtgacgactgtcattactgatcctcacgaaattgcgaatgtttccggagcaaaaggcatttcatttatgatagagcaggcgaaaaaggcgccgctgaacatccgtttcatgcttccttcctgtgttcccgccgctagctttgaacgctcaggagctgtattaaaagccgaggatttaaagcctttttatcaggagaaagaggtgctcgggcttgcggaagtaatggattatgtgtctgttgcggaaggtgaagaggatatgcttcagaaactgcttgatgccaagcgtcacggaaaacggatcgacgggcatttagccggactgtcttcagatatcatcaatatatacagaaccgcaatggtgtcaaatgatcatgaagtgacgacaaaagaagaagcgctggacagaatcagacggggaatgtacgtcatgctgcgcgaaggatcggtggccaaaaatacgctcaatgtgctgccggcggtgaatgaaaaaaacgcgcgccgctttttcttttgtacggatgataagcatgtagatgatctgctttcagaaggaagtgtgaaccaccaagtcaaaatggcgataaaggcgggacttgatccattccttgcgtatcagctcgccagcttaaatgcggctgagtgctacggccttgaaacaaaaggggcggtagcgccgggttttgacgcagatctgctgttcatttcagatgtacgggaggctgccgtcacgaagaccatggtcgccggccgtaccgttgccgagaacggacgaacagttgatgaacagtctgccggttcctattcgccggaccaggcactgttggatacagtgcggctgaaatcgccgctgactgaatctgattttcatataccgattcaagagggcaggaaaatgaaagtaatcgaaatgataccgaatcatttggagacgagaaaaaaagaagtgcctgcaccgtctgctgacgcgtttcgttctgatacagataatgatttattaaaaatcgccgtcgcagagcggcacagcggcgaaaaaatgataggactcgggattgtacaagggttcgggttaaaagaaggcgccatcgccacaaccatttctcacgattcccataatatcatcgccgtcggtacaaacgatgccgatttggcaaaagcaatcaacaggctccgtgacaccgggggcggattaacagccgtgaaaaacggagaattgcttcactccgttccgcttccgatcgccgggcttttgtctgataagtcggcggaatgggtcaatgacagcttgggcgtgcttcatgaaaagcttcctctgctcggattcaccggtgatttcaatccgtttctcaccttatcgtttttagcccttccggtgattccggatattaaaatgacggcggccggtctgtttgatgtcaaagcctttcagcatattccgctgcaataaaaaaactgcactcgtaatgagtgcagtttttttagacctccataatgatcggaaggatcatcgggcggcgttttgttttttcgtataggaacggagcaagcgtatcggtaatttcgtttttaatttcggaccactgcgttgttttccgatccattactttctccagatggttcgaaatgagctgctgcgcgtcattgatcaaatcaccggattctctcatgtatacaaaacctcttgagattaaatcaggtcccgccgaaaccttaaagtcgtccatattgatgctgacaacaacgataacaaggccttcttctgaaagaatgcggcggtcgcggagcacgatattgccgatatcaccgattccgcttccgtcaatgtaaacggagccggacggaattttgcctgccacagcggcttcttcgcctttgagggccagcacttcgccattatccatgataaagcagttttcttcaggtatgccgcaatcagtcgcgagtttgacgtgcattttctgcattctgtactcaccgtgaatcggcataaagaacttcggtttgatcaggcggagcattaatttctgctcttcctgtccgccgtgtccggatgtatgaatgtcattcaatgaaccgtgaatgacttctgcgcccgcacggtacagctggttgatggtgcggcttacgctgattgtgtttccgggtatcggagaggaagaaaagacgactgtatctccgggattaatggaaatctgccggtgcgtcccgttagcgatgcgtgataacgccgccatcggttcaccttggctccccgtacataaaatcgttaccttattggcaggcaaacgattgatttcgttatgctcaataaacgtatttttaggacaggtaatgtaaccgagattttgtccgatttcaatagccgattccatactgcgtccgaatacggcaacttttctgccgtttaaaacggctgcttcaatcacctgctgaagacggtgtatattcgaagcgaatgtcgcaaatataattctgccgtccacttttcggaaaatatcgtgaatgctttcgcctacgcggcgttctgacatggtgaaatcaggcacctcactgtttgtactgtcagaaagcaggcacaaaacgccttctttcccgatttcagccatctttgtcaagttggccggttcgcctaccggtgtgaaatcgaacttaaagtccccggtatgtacgatattgcccggcggtgttttgacgacgattccgtatgaatccggaatgctgtgtgtcgttctgaagaaggatacagacgtcttgcggaacttcacgatgtcgtcttcaccgatgatgtttaatttggtctgtcttaacagcccgtgctcttcaagtttattccgaagtaagccgatcgcgagtttaccgccgtaaacgggaatatttacttgtctgagcaggtacggaataccgccgatatggtcttcatgaccgtgggtgataaacagacctttaattttatcttcattttttactaaatacgtgtaatcggggattacgtaatcaatgccgagaagttcatcttccgggaacttgattcccgcatcaatcagtacaatttcatcctgaaactgcaccccgtacgtatttttcccgatctcgcccaatccgccgagggcgaaaacggcagtctggtcattttttacaaatttcattccgctcataactccaatactttaaaattttcgctctgcttctcatattctaaaaaagcaccgtccacaggctgaacaaattcaatgttgtatttctgatctttcagtttcgttctgacgtcccgttctgaaacgccctcaatgtaaagtgaatctgttttttcccgaacaggtacttcgtcagccttctcttgataaaataccttataaatcatccaaatctctccttaaatgccgtatgttagactcgcttattctattatattcgaaaacggattataaggaaagtctcgagcaaaaaagggactttcaaaaaccgaaagatcccttctacgcgatgacttttttccggagcattccgccccactgtcttctgagtttcttccgtaatcggcgcagcatcgtatacctcctttaaagccctttatagcagtagtatgcggaaaaaatgaatttgttttcgtgggtaaaactggaatttgatcaaggcggttttccggaagaaaaactttctgtatgatgatattgaaaaagacacgactgataaacgggaaaaaggagaaattgacatgaaaccaaaactgatcttttttgatattgacggcacgatctatgaccatgataaacatattcccgatagcgcaagaaacgccgtgacggcacttaaagaggctggccatcacgtttttatcgccagcggaaggtccccgtttatggtaaaaccgattctggaagagcttgagattgaatcatttatttcatacaacggccagtatgtcgtatttgaaggtgaggtcatttataaaaatcctcttcctgaagatgcggttgcgcgtttattaaagcaggcggcagaaggggagcaccccgtcgtatttatggcggaagacacgatgaaaacgaccgtccccggacatccgcacgtctcggaaggaatcggcagtctgaaagcgccttatcccgaagttgatgaaacattttataaaggaaaagaaatttatcagctgcttttattctgccgcggacatgaagaaaaagcatatgccgcttttccggagtttgattacgtccgctggcatgaattgtccacggatgtgcttccgaaaggcggttcaaaagcggaaggcattaaaagagtgcttgagcggcttccgtacggcgtaagtgatacttatgcattcggcgacggactaaatgaccttgagatgatccgttttgtcggcaccggggtggcgatgggaaatgcggttccggaattaaaagctgccgccgatttcgtcacaaagccggtggatgaagagggaatcagctgggccgtcaaagaactgggccttttgaaataaagaaaaccggcactttgggaagtgccggtttttttttaacggtcaatggcaatggcgttttcaggttctttgaacggatcttctttatcgatatggtcgtaaaacatcacgccgttcagatgatcgatttcgtgctgaaacacgatggccggaaaacctttgaggcggatgtcaatctgttctccttcaagcgtcaccgccttcacgcggatgcgggcgtagcgcggcacatagccgggaatgggttcgtctaccgacaggcagccttctccgctcgtcaagtagcttttttccactgagtggctgacgattttagggttaaaaagagcatagctgtataaagtgcctttcgcatcttctgcatggacggcgatcatccgtttttttacgtctgtttgcggagcggcaagaccgacgcccggacgaaggttgtatttctcggctaattcaggattttggctgtttttcacaaactcaatcatatcagcaagatgctgtttttcttcgtcagaagcgggaagctgaacctcttcagcgatctctctgagcgcgggatgtccgtcgcgtacaatattttccatagtaatcaagaaacttcactcctaaagcttaatatgtaaattatagcgaatttctttatcgcggcgcaacgaaacaattggccggccatagcaggccggccgattttcatggtgtataaggtcagcagccgcagcctaaataagcggcaccgacgatgattaataagataaacaatacgacgattaatgcgaatgtgcggccatatccgccgccgcagccataaccgtaaccgccataaccgtatccgccgccgcagcaaccgccgccaaatccgccgccaaatccatatccgtacataaaaaaacctcctcttttaattacgctgaccctttgtcagcagggccggcgtctactataaactatgtaaaagccaaaaagatgtatggtcatccgccctgttttctcaattttttacgccagtattctttgacagcaccgtaagcgtctttttacccggtcatgccaattacagctcagctattgtcaaaaagcgttcgggcttctatagtggaaattgtcaagattgggggattttaagtgaatatgattcaaaaaaaggtattagcaggaatcggagcgctcggcgccgcaagtatgctgcttgcgggctgcgggggaaaagatccggttgaatcgcttcatgactcgatggaaaaagccgttcaagcggaaaaaccgtttcaaaaagagcagaaaacattggaaaaattggagaaaaaagagcacaagctttacgacagcgcggttaaactgaatatggatgattacaagaaaatcgtcacactgtctgatcaggctctgagcaatgcaaatcagcgaaaaaaacatctgaaagcagaaaaagacagtattgatgattcaaaaaaagcatttgaatccgcaaaaaaaacttctcaagaaataaaggataagaaagtaaaagaaaaagccgggcatgctgtcgctttaatggagaaaagatatgcatcttatgatcttttgtacaaaaagtacgaaaaagccatttcacttgataaggacctttataaactgattaaagataaaaagctcacattagcgcagctggaagagcagatcagcaaagtaaactcagtttacgaaaaggtgcataaacaagcagaggagttcaatcaatttactaaagactacaacaaagagaaagaactattattccgcgaatagtatagtgaaggcatatcggcatgggctgatgaactgataacaaccgagttcagccgcctgtaaaatggcggctgaagaattggtatatacgtgtgtttcccattgacaacatgtaaatcatggtatagtatttatttagggaaatattcacataaaaccaatcgttgtttcggcacgttggaatgtttttattatattgatatataaaaaacggaatgaaaatgtggttttaattatcagaaaattctatctatttatatttgcggcaatatgatatttgcacatgctttttgcttttaaacctttatccggcataaaggtttttttattttgcttcgtattgcttattaagtaaatgacaattttaaaattgaagtgaaaaatgttaatcaaataacaatcggaacgaaaagaaacggcagaaatacggaacaaggaggaaaacaaatgcttgcttacgtctttcccggacagggagcgcagtttaaaggaatgggcagagacttattcgatgaattcagtgagctcattaaaaaggcagatcatattttaggatactccataaaggatttatgccttacagatgaaaaagagaggctcactgatacgaagtatacacaacctgcaatttatacagtgagcgcactgcaatatttaaagggtttaaaagaaggtcatacacgccctgatgctgttgcaggacatagtctgggtgaatatactgcgctttttgcggccggcgtttttaattttgaaacaggtctccggctggttgctaaaagaggcgagttaatgagtgaggcttccgagggcggaatggctgccgtgatcggactggatgagcatcacataaaaaaaatacttcaaaagtatgaattcggccaaatagatatcgccaattacaatacatcttcacaaattgtgatagcaggggctgcagaagagataaagcgggcagcctctttttttgaaaaagaaggggcgaaagcttatatcgtattgcaagtcggcggagcttttcattctcgttttatggaaagtgcacagcgtgaatttgcggaatttatcgaggagtttcatttttctgaattgaatttcccggtcatctctaactatacggcaagaccttataaacaagaagatatcaaacggaatttaattgaacaaataacaaactcggtgaaatggactgaaagcatcaggtacttaatgggacaaggcgtcactgtgtttgaagagatcggtcccggaaacattctgactaaattaattcaaaccatacaaagagatgaggaaccgcttaatattagtgcgccggaagacagtctcttgttttctgaagggaacaaggacaattcggaaagcgggaaagagaagggcctcttggccgaaaatatagaaagcagtgcggcttcaccggtgtcccaattgggtgatcaatctttcaaagaagattacggtttgacatacgcgtatttggcaggtgcgatgcatagagggatctcttccgctgaaatgctgatccgcctcgggaagaaaggaatgctggggttctttggcacagcgggtttaactataagggaaattgaacaggctcttattactattaagaagacactcaaaagtggccagccctacggaatgaatctgcgatttgagccggatcatcaagatagagaaaaggaattgatagatttatatatcaagcatgacgtacgggtaatagaagcgtcttcgtatctttccgtcagcgcgccattaatttattacaaagcgcatcagttgaagatggacaaaagcggcagggtcatacctcataatcggatcattgccaaagtttcacggccggaagttgcggccgcatttctgagtccgcctcctcaaagtatcgtaaagagaatgtgtcagcagggtatgctgacggaagagcaggcggagtggctcagccgtgttccggcagcagacgatatcattattgaagcagattgcggcagtaataccgaacagggctcattgacggcgatgctgccgttttttgttaacctgcgggatgaaatgatggaaacacacaaatacgcaaggaagatcagagtcggggccgcgggaggaatcggaactcccgagtctgcggcgtctgcttttttaatgggcgctgattttattatgacgggatccattaatcaatgtacagttgaagccgaaacaagcggttttgttaaagaaatgctgagtgagacaggaatatgcgacactgcttatgcgccttcggagactctgtttgagttcggaacaaaggtgcaggtgctgaaaaagggcacgctgtttccggtcagggcaaataaattatttcaaatctaccaacaatatgagtctttgagtgagatagatgaaaagacaaaaattcagctcgaaaatgtttattttaacaagacttttgatgaaatctacgaaagcataatagaaaaacagccgaacctggcccaaaaagctgagcgcaatcaaaaatataagatgctgttactatttaagtggtatttgcagagaggatgtctgcttgctttggaagggcaggaagaacaaaaggtgaatttccaagttcattgcggcccgtctttaggcgcttttaatcattgggtaaagggcacggatttggaatcatggagaaacagacatgtcgatgacattggtgaaaaaatgatgaatgagaccgaaagtctgctaaggcgcagattggatacgttatttctacactaaagaaggggcgggtggaggccaatggttcatttgaataaacagagtgcggatatcgcgataatcggggttgcttgcagattccccgatgcagatcattatcatgaattctgggaaaacataaatagcggcaaagattccatccgggaagtgccgattgaacggtgggatcccgatctttattattcagctgatatcagtataccgaacaaaacaatcagcaagtggggaggttttattcataaagctgaccatttcgaccataagttttttaatatctctccccgggaagcgaaaaacatggatcctgagcaaagaatccttttagaagaaacttggcggtgcatcgaagattccggggtctctttgcgggatctccagcgtaaaaccacttctgtttttgcgggtattatgaattctgactaccggcagacaggtcatgctgaatcggaaatcgacagttacgcctgtttaggaagtttcgaagctatgctctccaaccggctttcatacacattcggtttgaccggaaaaagcatgtctgtaaatgccgcttgtgcatcgtcgcttgttgctttacatgaagcggttaagtcattgcggacaaaagaaagcgattatgcaatcgcatcgggagtaaacttgaatttccaacccggaaaatatatttctttttctaaagccagaatgctgagtcctgacggcaaatgtaaaacctttgacgcagcggcgaacgggtatgttcccggagaaggggcaggcgttgtattgctgcagcgccttggtgatgcagtaaaagccggtcaccatatatacgggatcataaaagggacagctgttaatcatggcggtaaatcccgttccataaccgctcccagagcagaagcgcagtgccgggtcatctcagaagctttacacaacgctgctgttgatgctgcgacggtttcttatgtagaagcacatggcacaggtacatctctgggcgatccgatagaaatagaagcattgacaaaagcgtatcggcaatatactgaggatactcaatattgcaggatcggaagtgtgaaaacaaatatcggtcatacagaagcagcggcgggaatggctggattgataaaagttctaatgatgatgaaacatcggagggtgccgaaaagcctgaatgtacatacggtaaatccaattatacagtttgaaaaaacaccgtttaggccggcgcttgattcaagtgattgggaggcggcagacggggctccgctcagggccggaatcagctccttcggttttggaggtgttaactctcacgtcatcatcgaagaatttatacatacaaaagacgaatctgacagaaagggaagggttcccttccttttttccgctaaaagtgaagaaagcatgaaacaaatgatacataattggagaaccttttctgacgattctgaggaattttgcaaaatatcaaatgaagtgatcagcagcacccttttaacaagggcatcgtttgattacagggctggtttattggcaggcagcaaggaggaatttaaaaatcagcttaaagagggattaagttttcggaggaaacaagattctgaatgggcgcttgccatcggtgacttcaaatgggaaagttataaacaatttgccgttttgaaacgcgtgttccctgatttagaaaagaacgtaaggtcggtgctgaagggtataccaacattgcacagttcatttaaaagaaaatggacgcctgagaaaatccgcttgtattctttagttatcaatacggaaatcataaaaagtatcctggcatccggttttaagccaagcctcattacaggcgccggagacggatattacgtcgctcttgcagcagcggatatcatcaaaattgaaaaggccatttctgtcatcacaggcgctgaaaaaccttcgcacttatcctgtgagccgtcgaccattccatttgtcaatccgtacactgcaaaaacgtacccgccggttcgattaaatgaagaatatgtaaggatgctgctgaacggtctgagcttcccggctgattttacagaccgcctgtacgggaaaacacggctgcttcttgagcaccaatatacgtttaaagggtttttagaagagtgggataaagcgggaaagactcaggaaatcgagattttatcttatattgtgaatcgcacggcggataaaagaaacgcattgccggctgatgaggaagcggcgatcatggctatccttgcctctatgagaagactgtataagagatgggatttaacagattatgatggattctttgataatgattatgttctggaaatattaaatttactggatgagggaatcttgtctaaagaactttttctgagcatgttattgaaaaagcaagacggaattaaacaggctgttgcttgtatgaatgagcagccggcaggtttttatgataagactcgttttccgctgatgacagaatacaatcaaatggatgccgtgtctcaggagatagctgaccatatgccgcttcacacggaagaaaagggaacggagccggatgtgaatatctctgatttttcagtttttcaattcggatcgctccctccatcagcaaaactaaacaaagcggctgcttttgaagcggacaaaccagccgatgaggctctttatcattcatttatgcaaatgtggctttcaggagaagagattgaatgggcgaaactaggtgattatcataaaagaaaagccccgcttccgccttatccgtttgagcgctctcaattttctttaaaccctcagccggtaaaatcagacgcggctttttcagaaaagaagaatcaggcactttatacgccggtatggaaagaaaccgaacttgagaatgaagcgggcagcggacaagcctgtactattttgttgttctccgggaataaagactattttgaagagctgaaaaaaagagagaatacgtccgcataccttattatgcccggtgagcgtttagagcagataagcgacagtgttttcaccatcaacaggcagcgtcccgaagattatcaaggtgtcattcgtctgttaaaggaaaaaggcgcagcgcctgatgcaattttgcatacttggtctgaaaaacagcctgaactggaagaaacactcgaatcaggaatttattctgtgttttatctgactaaggctttaatcagcgagaaccttataaacaaagtaacgttcatttatacattcagcgcagatcaaaaagaaaaattgccgtattttgaaggtgtgaacggttttttaaaatcgataaaacaagagtacccgcagttgcattgtaagacggtttgctttgaacatgattctgcatccgtttcattttcagagaaggctgacattctttataaagaaataaacacagcgcctgatcggcatattcatatcacttacagaggctgcgtaagatatgcacggatgttagagaagcagagagaaacaaacagaaagaccattcaataccctgaaaaagataaagtatatttaattacagggggattcggggggattggcagtaaaatcgctgaatattgcgcgaaaactgaaagatccactattatcctatcggggcgatctgttttaaacggagataagcagaaacatttagaatacctgaacagctttaaagcaaaggtttattatatacaggcgaatatatccgataaagaagcggtaaaaaaaatgattgacgatattaccgatcagcatgcaggtcttcatggcgtcattcattgtgcaggagttatcagagactcgctgctttttcgaaaaacaaagcatgaactttcagaggtgattgctccgaaagttcatggcgcattgaatcttgatcatgcaacgaagtcgctcgaattggattttttcgccgttttttcttcagtcgtctctattgcagggaacgaaggacagtgtgattatgcatatgcaaacggctttttagatcatttcgccgaatatcgggaacagaaacggcaaaagtttctgcgcagcggccgcaccctgacaatcaattggcctttatggcaagacatcggaatgggggcgaacctgtcaggtcaagggcggacgtctctttttcatggttccgggctcgaagaacttcctgctgaagacggaacgcaatggttttcgcggattgtaacttcgggtcagctgcataatattgcagtctgcggtgatcacgaacgctttgaacaatttatgcagcagagatttttgacggacgaaacagagacaggcagtgccgttcctttggctcaaggcgatattttggatcagacagttttgtttttaaccaatatcatctcctctgaggtcggtgcagaacgggaagagatcgatcaagatgtgcatctggctgaatatggaatggattcggttatgattcatcaatgcaacacaaagctggagcagtcactgggagcaatttcgaaaacgcttttatttgaatttcatacaatcagagatttagcagatcatcttgtaaaggaatacccggatcggctggggcgtttattttcacgggaggaaaaaggaaaacagattcagagcattacccccgccaggccggaacaagacatcactgcacctgcggcggaggaaaaagaacatcttgacgggatagcggtaatcggtatcagcggccgttatcccggggctgaaaatatcgaagaattgtgggatcttctatcaaaagagagaaccgcaatcacagaaattccgaaagaacgatggaattatgagacctactatgatccagaccccgctaaagcgcatgagggaaaaatttattgcaaatggggcggatttttaaagaatgctgaatcatttgattctttgtttttccaaatatcgccgagagaagcagaagcgatggatcctcaggaacgaatatttctcgaaaccgtatggaaagcatttgaagattcgggatataccattgaagggttgaggaagcagaccgaaaaacatgtcggtgtatttgcgggagttacaaccaattcttacaagctgctcggcgaaagaataccgacggacaaaaacgatgtacttccaaattcgttcccatggtctctcgcgaacagagtgtcttacacatttgattttacgggtcccagtatccctgtagatacggcttgctcttcatccttaacggcaattcacatggcttgccaaagtttaaaaaaaggtgagtgctctgttgcggttgcgggaggagtaaatttgtatcttcatccttctgactatttataccggtgtcagatgggaatgctttcaaaatcgggaaaatgcagaagttttggagaaggcggcgacggtttcgtgcccggggaaggtgtcggggccgttattcttaaaccgcttaaagatgccatacgtgataatgatactgtgtacgccgtcataaaaggaacggcaattaatcatggcggaaagacgaatggctatacggtgcctaatcctgccgcacaggcggatttaatccaaggagctcttaaagcggccggttggagcgccagaagtgtcagctttattgaagcccacggcacgggaacgccgctgggtgacccgattgaagtccgaggcctgaccaaggcgttcagagcttataccgaagatgtttcatattgctctctcggatcgattaaatctaacatcggtcatctcgaagcggccgcgggtattgccggcctgacaaagattattttacaaatgaagtataaaaaaatagccgcaacactgcatgctgaacgggtgcatccggatctttatctggaagagacacctttttgtctccagcaggaaaccgccgactggataaaacccgtgaatgaaaaacattctgacagcaaatatccgcggcgtgcgggattaagttctttcggagcgggcggggcaaatgcacacatccttgtggaagagtatgagtctgctgctgactgtcaaacggattgtgaggaaagtgaggaacttatcgtactctcagccaagcattcactgagtttacaggaatcagcaaaacagctggaggaatatcttcaaaaggctcgtcataagcagggcgagtgtttacagccggcgggaacaaataagccgcttcacctttctgatattgcgtatacccttcttgaagggcgtgaagccatgccggaaaggcttgctgtcatttcaaataatatcgatgatctgatgttgaaattaaatcacttttataatggaattgacgatcacgaaatattcagagggaaaaaaccgaatcataaacgcggacagcggcaatcagatcttccgctcaaatccggcagaaccacattagccgaaatggctgaattctgggtatcgggagggaatttaagctgggaagatttccgcaccggcagaaaaccggcaaaaattgcgctgccgacttaccctttcttaaaaaacagactgtgggtatcaaataaggcgcaaacaacatcagcagccggtacagctcctttatttgatttttctgcaggtgagtgccgattttataaaacgctttcagattctgaatattatttaaaagaccatgttgtgcatgggaaaacggttctgcccggagcggcaatcatcgaagcggccagagaagcgggagagaggctgtacggaaaatcagtcataaaactgagtcaggttgtatgggcggttccgataaccgttgaaaaagaaaagacgataatgatagatctgctgccgaatcaaaaagacggcagatttgtggtgaaaaccgatatgcagcctgaagcggcagttcattgccaaggaaacattatcacatgcggagataaagacgcctctcatacagagcattttaaattggacagccggttaaccggacagaaaagattaatcagcggcgctgagtgttataggaacttccggcagagcggtttggactatggagccggctttcaggtaataaaacagctgtttatccatgaaaatgctgttcttgcacgaatatcacttcctgagagcattcataaaaaatccggcgcgctgctggaaccgtgtttattggatggcatttttcaatccacaaccgggtttacgtccactcaggaagacgatcacaccgcatatttgccttttgaattaggtgagctggaaattcttcaaccaccttcggcaagcggctatgcttacattactgctgccgatgaaagacaacatgatgatgtcaaaaggtttcatatactatttatggatgaacacggatctgtaagtcttaaaataaaaaacttagcgttgaaggcattaagggctgcaccgcagactcaaaatgagcggcattcagctaagtattacactgatatgtggaagcgggcccctatgcttcatcagcctgaaggcagcggtttaaacagctgccttgtgatttcactccgtcaggatatatcagaaccgctgatccgccaggcatataaagatatcggcctgaacatgatctttgtccgccatggcggcagttttcaagaaaaagaagctgattcctttgaattgaacagcgtcaaacttgaaggctataagaaattgctggcgattcttaaagaaagacaagtgacaattgaccgcgtcattttaatcgggatgagccctgaaacgggaattgagcataacattcatgaaaagctggaaaaggctgttttgccggttttcaatgtaacgaaagctctgttagcaacaatcccaagacataaaatcctgatatcacatgtatttttcacaaggaacaatcaaatcttaccttatcaaatggcaatgagcggcttttttaggtcgcttcatttagaacatccaatgttgtccggtaaaaatattgaaatacacagcgatggaattcagttacagctgaacaccggtctgcctgaattaaaaaaccttgtgaaagaaacagtcatcagcgatgatgcttcagagatcagatacagagatggaatcaggcaggtgaaacactctgcagaaattgaaagggcagagccctccaaaaagatggaagtaaaagaagggggagtttacctcattacaggaggaacaggcggtctgggactgattttcgccagacatcttgtgcgaaaagggagaataaaacttgtgcttatcggcaggtcagagctttctgaggaagccgtaagcaatgtaaaagagctcgaaaaaaacggatcagaggttttttatgtaagaaccgatatttctgataaggaaaatgtcaacaacctgataaaactcgtcaaaaacaaattaggtcctgttaaaggaattattcacagcgccggtgtgataaaagattcattactcatcaataagcgtgaagaggatctcgattcagtcttggccagcaaggtttacggaacgatatggcttgaccggtatacagacagagaacctctggacttttttgttatgttttcatctatcagcgcaataatcgggaatgccggacaaactgattatgcttatgcaaaccggtttatggattattttgcggaaatgagagcggcggaaaataaacctggaaaaacagtctcgattaattggcctttatggaaagaaggcggtatgcaaattgacattcattcagagaagttcctttatgaccgtttcggaatgctgcctctggaaaaacgggaaggccttgcagcatttgatcaagcaatgacagggtgtgaacatcaaataatggtatttagcggtaatgaattaaagctggaacgaatgataacgattgacagcggaaaaagtgacccggcaatcgccgacgaaaatcacgaaccgaaagagctgtcaataactgaatctttaaaaagcactttgacgcgcatcatcaccggcgtattaaaaattgaagaacgggaatttgattttgaactgccgataagcgaatacggatttgattcaattatgtttacaatgctgggcaacgaattaaacgaaacattaggaatatcaatgatgccgtcagattttttcggtcttactgattttaatgaacttcttgagtttttaaagagtgagtattccgaagagcttcatctctgcgggtctttttcttcagatgaatctgcggcgaaagacagaagagaaaatctgattgagggcatcgcaaagatgatgtcaagtattttaaagattgacagaaaggaaatagaagaagagacttcattcggcgagtacggatttgattctattacgtttaccagactcggaaatgaaatcaatcaacaatatggtacggaattattgccgtccattttctttgaatgcaattcactggctgaactgactgattatgtaatcgagcaatacggagaaatcctttttgctgagacagaacctttttctgcagcagacgaaaaaacattgtacagcacgcctccgcccgaatcctatgaacattcccctgagcctgaaaacaaaaccaggcaagaggaaagacatatgaatgagccggttgcaatagtgggaataagcggccgtttcccccaaacagatacgctggaagacttttgggaaggaattgaaaaagggcgggatatgattacagacattcctgaagaccgttgggactggaaagagtttgacggcgatccgatcagggacgttaatagaacaaaaataaaaaaaggcgggtttatcaaaggcgcggacagttttgatccgttgtttttcgggatttctcccgccgaagcagaattaatggatccccagcaaagaatttttatggagactgtatggaaaacaatagaagatgcgggctataagccgtctgatttggcagggacgaaaactgcggtgtttgcaggggtcgccacaacggactatgcggaacgtctcaatgaaaatggcgtctctgttcaggcgcagaccgcaaccggtttaaatcattgtatattggctaatcgtatttcttaccagctgaacctgacgggtccgagtgaaccgattgatactgcctgttcaagttcgttagttgcactccatcgtgcggctgaggggattcaaagaggcgattttgaaatggcgattgcaggcggagtgcatattatgacaagccctactctgtttatagcttttgataaagcaggtatgctttccaaagacggaaagtgcaaaacgtttgataaaagcgctgacggctatgtaaggagtgaaggggcggctgcagtattgcttaagccgctcagcaaagcacaggcagacggtgatcatatttatggtttgattaaagggtcagctgtaaatcacggcggccgcgccaattctttgacagctccgaatccgaacgcacaggcggacttattaaccgaagcttggcggaaggcgggggtcagtcccgccactgcgggatatatagaagcgcatggcacagggacaagtcttggcgatccgattgaagtaaacagcatcataaaggcatttaaaacgttatatcaagaatgggacattccttttgagaaacagaaaagctgcggaatcgggtctgtgaaaacaaacatcggccatctcgaaaccgctgccggaatagccggagtgctgaaagtattactggcttttaaatatcgcaaacttccgggactcgcccatttttcagaactcaatccatacatcaaactggaaaatacgccattttatatcacagaaaccgctcaaaagtggaatccgataaaagatgaagagaacaacgatctgccgaggagagcaggtatcagctcattcggattcggcggtgtgaacgcgcatattgttttagaggaatataggaaacctcaaaaagaagtgccggaaaacaacggtaaaacacacatttttgttttatctgcgaaaaccaaagatcaattacttgagtatatccggcttatggttcattacttggatcgcgtgattgccggtgacatgaccgttaatgccagtgacatggaatttacattgcaaaacggccgggaagcaatgaacgaaagaattgccgtatgtgcagcgagtctgactgagctgagagataaatacgtcagcttttttgatgacagcaaggtgcaaaaaggcgtatttataagcgaaaacactgaagagcgcgcagctgtttctgaatatatgattcaggaggctcttcaaagcggaaaagaggagctgctcgcacaatggtgggccaatggagccgagtttgaatggaagacaatcggcaataagaaattgaatagagtgccgctgccgtcttatccgtttgcaaaagagagttattggtttactccgaaaaagaacaaaagcgaggttaatagcaaaagtcttcacccattaatcagcgagaatgtctcaacattaaagaaacaagcatttaaaactgttatttccggaactgaatttttcgtcactgatcaccttgtttcaggagactgtgtgttgccgggagccgcttcgcttgaaatggctcttgtttgtgcggaaataagcggagaaagtaaagtatataaaataaaagacgtgatgtggaacagacctatattatataaaggaaaaacgctgcacatttataccggcttggaaatgaaacaagataagttgaacgtaacgatatgtaaagagggcccggatggcgtgcagcaaatctgcacacaatgtgaaacagtattcggagacataaacagcaatcctgagtatgtcgatattgataagtccatacgccgcagtaaaacggtcataagccggaaagagtgttatcaccgcttcagtcgtatgggcctgacatatcagagcggttttcaaacgttgaaagccgtatatcgcggtgatgtggagttaatggcagaattggagcttccggatcatttagcgaacgggttttcacattttacactccatccttcattaattgacggcggttttcaagcggcggcatttttgttaagagaaaatgagaaagacggcttatttgttccttattcacttagagagcttcacattaagagggcgcttactgcccgatgccatgtttcggtgagagaaaccggtttttatacgtataacattgattttattaacgagagcggcgaaatagccgtgagcatgaaagacttctctgtcagaaaagtgaccgggggagaattaaccgcaggtcataaaaatgaagatcaggaaattctcttcttattggaacaattgaaaaacggtgaactttctgctgaccaagtttatcagctgctggagggaaaatagtgcagatcaaacaaatactttccttaattgaagaacagcaaatgtctcctgatgcaggactggagctaattcgcacttacagaaaagaacaaatggaaaaaaaggcggagccgggatcacaagctccgtccccaaccattttttttaagaccgattgggtaaggacaaatcacattgatatgccgaatcagcaggcaccggggaatatgctgatttttgatcaggataaccgtctctttcagcatgccgagatgatgaatggagaacataaccgtgtcattctcgtaacgcccgattctgattacagaattgaacggaatagatgcacaatcaatccttctgatgaacatcatgtcgaaatgctgctgtctgatttggctgaaaacggatttacacctgatgtcgtgctttatttatggaacggagaaatcagagaaatcactgaagaatccgttaatgaaactcttcgcagagggataaactcgctctttttattatcaaaagctttaatgcgaagaaacgaacctgttacgttattgcatatttattggaaaagcggtctgaatcagccgtttcatgaagctgtcggagggtacatgaagacggtaaacatggaaagctccaagcttaaagcgaaaaccatacagatacgccacgaggattctgacataaatcctccggtttccgagatgtgggatgctgcaatcagtgaaatgcagcgcagtcaaacggatgaatgtgaggttttaatagactcatatacccgttatgtgaaagagctgcagcctattgatattccggaacacgatcacggatctgtaacgtatcaaaaaggcggcatatatatcattaccggaggagccggaaaactcgggctgctgtttgcggaacacatcgctaatgaaaaccaagccgtgattatacttacaggccgttcttttttaacagctgatcaaaaagaacggatcagtaagcttaatgagagcggctctattgttgaatatcagcggacggacataacagatcgaacagaggcagagcgattcattttcggcgttaaacagcggtacggcagcataaacgggatcatccatgctgccggcatccttcgtgactcatttcttgtaaataaaagtctcagtgattttacggacgtactgaaaccgaaagtttacgggacaatctggctggatgagctgacaaaagacgaagatcttgatttttttgttctcttttcttcttttgccgcttacggaaatgccggccaaagtgactatgcgtacgcaaatcattttatggacagttttgcaatgcttcgatcccagctctctcgaaacggaaaaacactatcaatcaattggccgttattgaaagatggcggaatgagtctcgacagcaatggaatcattcaaataaaagaaaaatacggaatgactccgatgcgaacttcctctgttctggaagcgtttctgaaaatgctggggtcttcatttaccagcttaatgcctgcagaaggtgagcggaataaaatgataaaagcgctttcgattcaaagaaatacagctgcagcagatcaagatacactcacggcggaatacgatgaagaagaggaatatgctgcgaaagaaaaagtcaatgactatttaatcaagatcatcagcggtgtcttgaaaatccaagctcataaaataaatgcgaaagactcttttgagaagttcggaatcaactcacttatgatcatgtcacttatttcaaagcttgaagatactttcggggatcttccgaaaacaatcttttttgaatatcagaacattgaagagctttcaaacttcttcctaacatcttttaaagaaaaagtccttaaggccgcaggggcagctccggtaacaagagtgcagaagaaaagagaaaatccgagtaaaaaacagcaccggcagcagaaggatacacctgcaccgagcatggttcagccgggtgaggatattgccattatcggtgtgagcggaagatatccgaattccgatactcttgaggagttctgggaaaacattgccggagggaaaaactgtattattgaaatccccgaggaacgttgggatttcagatcaatttacagtcccgacagaatggagaaggggaaaatcaacagtaagtggggcggttttatcagcggtgttgatcaattcgatccgctgtttttccatatttctcataaagaagctgagctgatggaccctcaggagcgaatttttctcgaaacctcctggcatacgtttgaagattcaggatatacaaaagagaagcttaacggtatgaaagccggtgtgtttgtcggagccatgtacggacaatatcaattattcggcgcagaagaaactgcgcggggcaatccgattgcgctcagttccttcttttcatctattgcgaacagggtttcatacttttttaatctctccggcccgagcattgcactggatacgatgtgttcatcatcgctgacggccattcacttggcatgtgagagcattaaaagaggggaaagtgaaattgcgcttgcgggcggcgttaatgtgtccatacaccccagcaaatacctttggctgagtcaaggtaattttgtttccaccgaaggattgtgcagaagtttcggagagggcggagacggctatgtcccgggagaaggttcgggagccgtcctgttgaaacctctggaaaaagcaattgctgatcaggatcatatatacggagtgattaaaggaacatctgtaaatcatggcggaaaaaccaatgggtttacggttccgaatccgaatgcacaagctgagctgattgctgaaaatttcaagaaatcgggcatcagtccgcgatccgtcagctacttggaagcacacggaacgggtacctcgctcggagatccgattgagatcgcaggattgacaaaagcttttgagaaatttacggatgataaacaattttgtgccataggttcagtgaagtctaatatcggacatttggagtctgccgcaggtatagcagcccttacaaaagttcttttgcaatttaagcaccagaaattggcgccatccattcactcggaacagctgaaccaaaatatccgatttgaaaagacgcctttttacgttcagcagaaagaagaagagtggcggaaagaatcaggcgcctctaacaggagagcagcaatcagttcgttcggagcgggaggagcaaatgcccatgtcattgtggaggaatatcaaaaccatgcggacacacaaacaataagcggtccgtttgccgcagttctctctgccaaaaatgaagacagactgaaagaatacgcccggcgccttctgcaattcacagagcgggagacaacagcctcggcagctgatatcgcttttacattgcagacatgcagggagccgatggaagacagacttgctgttgtagcttccgatttgccggaacttaaggagaagctgagaactttctgtactgaaggaacaattggagagggcgtatacaaaggcaatgttacgaaagactttgataaagtctttatctttcatgatcaaaagatgaaagataaattcctcgaagtgatgatggagacaaaggacttgaatcttctagcaaaattatggtctttcggggctgatattcaatggagagagttatatgaagagtatactccgcaaaaggtcaagcttcctttatatccatttgctgaggagtcttactgggtgcctcgaaatcaaagtgcaatagttccggaaatattgccgcggcagtcttcactgcacccgcttctggattcgaatgaatctactctggaacagcagttttttaaaacgacattaagagaaaaagagatttggttaaaagaccacatcgtaaaaaacaagagcattctcccggcagctgcttttcttgaaatggcatgcgcagcgggaacgcggtcatatcgaaagaaagaggtcactcgtttaaaaaacgtgatatttgcaagaccggccatgcttttgcaagagagcctgaccatttacactcacatttccgtaaaagacggcaaaatattatttaatatgtcatctgacgaggatgctgctgtaaggaatggatttgtgacgggggaattagattatgatcatcattacgatgatgatatagagaatatcgacagacaagagatgataaacagaagtgcttttgtccgtgaacaagatgaatgttacaagtattttcgggaaaacgggttcctgtatgggcgcgcttttcagccgattcaacgtttatggggcggaaaaacagaagcggttgcacacttattgctgccaaaagaagccgcatatgcacttgaaaattatacaatgcatccgtctttaattgatggggctctgcaatctttgttcgggattacggacggaagagaagaggcatctgtttatgttcctttttcaataggtgagattacgattcggaaaaaagtttcagcagaatgctgggcttatgcgcgtaaaacaggccaaaaaggtcaatccgagcttatttacgatattcagctgcttaatgaacaaggagaaagacttgcaggtttgaaggatgtaaccattcgtaaaaaagaaacgttttccgcggaggcacagactcgtgcaacagcggattccaatggaaagaacgagagagtaaaagagctcctcagacaattaaaagcgggcgaactgactgcggaggaagctgattatgtgctggagcgcatgcaggattagtttatcattttgcggaagtgccatttgtaaaggggatgaagatttttatgaaagaagcccgtcatattagaaaaaaagtactttctgacatagaaagcggcaacatttctttggaagaaggagtaaagcggatacagcagcttggttttcattccgcaggggttaacggacaggcgatatattatcagacggtctggcagcggacagatctcagcattcatgtaaaaggcggccggcgtgagggcagccttttattatttgataaaaatgaagatgtgagtaaagaacttgctgcattgcatgatacaagggttattttggttaagccggggaaagagtttcgaaaaaccggggacggtgtatttgaaatcgacccccgctctgaaaaagattacatagacctgttaggatggcttatagaagaagaaaagtcagatatacgggaagcggtgcatttatggtcagacatgccgtttgaaaaaacagagagagcgattcgtgaacaatgcgacagcggagtcaattctttgtttttattacaacaggcgctcttcaaaaataactgccgcaaaccgatcaagctgttatatggatatttttcgcatctttccggagaacagcctctttacgcggcggcaagcggatttttgcggacattgcagctggaaaatccgttaatctcagcaaaaagcattgaaatggagcagtcaatagcagccgttcacgcagctgatatcatacgcaatgagctgaactatttccagccttcagatgtagagatccgttataaagacatgcagcgttatgtcaaacacctcaaaacgtatgaacccgaaaaaaattccggaagcggagatgtgccgctgagagaaaatggagtatatattatcgcgggcggcgcgggcggattaggatttacctttgcagaatatttggcttttcaaacaaaatgctgccttgttttaacaggaagatctccgctttcagaccatataagaaaacagctgaggcgattggaggatgccggttcttcagctgtttatgttcaggctgatattaccaataaggaagaagccgaatatgtagtcaaaaaagccaaaacttcttatggaaaagtaaacggggtcattcagggcgcgggaatcatccgtgactctttccttcttaacaagtcacgagaggaattcgatcaggtaatcagaccgaaagtattgggtacgatgtggctgaatgatgctgttgagaaagaaaatcctgactttttcatttgcttctcctctacttccgcagtgttgggaaatgtcgggcaatctgattacgcgtttggaaacagctatatggatcatttcatgaatatgcgttctgcccagcattctgatacgatttctctctctctgaactggccgctgtggaaagaagtcggcatgcaagtggatgagcgcacggtagagacaatgaaaaaggcgggtttttatcctttagaaaaagaagaaggtaaaaaagcgtttgcagtcgcaatgtcctccggtttttcgcaatttactgtattttacggagatgagcaaattgacaaccatgttactcaattatatgaacgaaaagacagcattcaggcagatgaaggaaaagggagaaatatcgaatcatttgattcagagaaactgacagctgaaacatctgattttatcataaaaataattgctgcagaattcaggatgcctgcggacaaaatagatgcagaagaggcattggaaaaatacggacttgattccgttatgattatcaatatgacgaatgagcttgaaaaacatttcggcgcgctctcaaaaacgctgttattcgaatatcagactgcggcagaattgtcacagtatttcgttgaggagcacagggatactcttcttcataaactccggttaggagaaaacgggagcggcaccccatctcagaagaaaaaagataataaacagacagccgatgttaacgggaaacagaaaatccagatgaaaaatcaggtccagcaggagaagtatcatgacaatgatatcgctattatcggtatcagcggacgttacccgatggcaaatgatcttgatactctgtgggaaaacttattgaacggtaaagactgtataactgagatacctgaggatcggtgggattcggggctgcactatcagcctgcggcgggcgacgaagtaaaaaaccaaagcaaatggggggatttattgacgatgtgtatcattttgatccgttgttctttaatatttctcctgccgaagctgaattaattgatccgcaggaaagactgtttttagagacggtttggcacaccatagaagatgccgggtacgcaaagaaaacgcttgaaagaaaaaacgtcggtgtttttgcaggggttatgtacggccaatatcagctgtacagcgttggtcacgaagcggccgtttcttcctcatatgcatcaatcgcaaaccgggtatcctacttctttaatttcagcgggccaagtattgctttggacacgatgtgttcctcatcattaacggctgttcattttgcctgtgaaagtttaatcaggaatgaatgtgaatttgcaattgcaggaggcgtcaatttatccattcatcctcataaatacgaactcctgactcaaggcggatttttatccagtgatggccggtgcagaagcttcggttcaggaggagacggctatgtgccgggagaagggacaggtgccgtgctgctgaaacctgtaaaaaaggctattgccgacggtgatcagatttattcagttattaaggcaacagcgatcaaccacggtgctaagacgaatggatataccgtgccgaatccaaaagctcaaagtgaggtcattacgagagccttaaaaaaaggatgtattgatccaaaaagcatcagctatatagaggctcacggaacaggcaccgcgttaggagatccgattgaaatcaccggtctgaccaaagcattttcaggtgccgaacgcgataagaagacatgcgcgatcggatcggttaaatcaaatatcggacatcttgaggctgctgcaggcatagcgggcattacgaaagttattcttcaaatgaaacataaaacgattgttccgtcactgactcattctgctgaattgaatgaaaatataccgtttcaaaaaacacctttttatgtaccgggcagtgcagaaaaatgggagtcatccgttcccaggcgtgccggaatcagttctttcggggcaggaggagctaatgcccatgttattttagaagaatttacggatgaggctttctcttctctcccggctgaagaacctgaacagcttttatttgttttttctgcaaaaaatgccgacaggctggcagaatatgcaaaacgcgcaaaagaacatatagcagccagagattatccattagaaacacttagaaatacagcatttactttacaaaccggcagagaagaaatgccgcacagattggctgttatcgcctccacaagagatgaattgcttaaagggctgacagactatactctcggaaacgcgagggatcatatttttacaagcggcaaagacacaacagaagctcaaaggatgaacaaagctgagattgaagaagcagccgcaaacagggatcttgtgaagattgctgaatactgggttggcggtaacggagtagattggccgtcactttataaagatgtcactttgagacgggtatcagcacccggatatccatttgccaaagagctatgcagaatagatgcgcaaaatacgggaagccgctttatgaacgtaaataacgatctgcatccttacatttcatgcaatatatctgattttaaagcacagaagtttcttatcaatgtaagcgataccaatttgtatataaaaacaaagtatcaagacaaggaaatgtttccgtttctcagccagattgaaatggcgagagctgccggagcgatggcttcaggaaatccgattattaaattaactgagctctcctttagagaaccgatgttacaaagcgaaagcaatgagcagatccggattgtattaaccccggataatcagggtgcatcgtattctatagaaaaacagagcgactcatccatttattcctcagggcggatcgaattagaagacggggcgtacgagaacggaaatattcatcttgagccgtttctgtctcagcgtgcagaccggataccgtacgaagcgttttatcagcggcttgccgaattcggatacagctgcagtgacagtctgaaagcggcagagcactgcgtcagcaggaacggacaggtgcttttaaagataaaagcaaaggccgggccgaaagggtgcataatcaaaccggaagtgattgagagcgcatatcaagccgtcatataccttgcgggggaaaatgccggagagctcccggaaaatattaaagaatgtacgatttttgatcatgagactgaacccgtttatgtatatgcagaacaaactgaagaaagcgattcggcttatgatgtgtatgtattagacaatgccggcgggattttgatggaactgagcgggctggtttttggcgaaaagcctaataaaaatgtacgtttttatgagcataagtgggatcaaaaaaaccctctgattgaaatgaaagatagggagccaaaaacaattctggtttttgcaaaagatgaagcattggctggagctctgaaaaatcaatcagacagccgtgtcattctcgtcacgccggatcagcggcagaccgatcaaaatctgctgacattctgtataaacccggaagtgacgtcagattatattcgtttattcgaagaattggagaaaaaggggttttctcctgatgtcatcttgcacacgggagaaacattttacgcgggtgaccgccttctcagcggcctggaatcaattttttatttattaaaagccctgagcgcccgcaatgatgcctctctttatctgcattctctgcttcttgttcactcttttaaagaaggcgtgaatgatccgtatacgggcgctcttgcaggctgtttaaaaacggcaaatatgttggtgccatccgcagagaatgtgaagtcaatcggtttttcagaacgtatatcaattgaaaaaatggctgaattttgtcttaacgaaatggtttcaggcgtggaacggcaggcggaagaagttaaatatataaatgacaagaggtatgttaagacattaaaggagtatgtattcaatcatacagagcactctcatcagctgaaacagaaagggatttacctcataacgggcggtttgggcggtctgggcctgattttcgcaaaatatttagcctctcagtatcaagcaaaattggtattgacgggaaggtcaccgttaacagctgataaacgccataacattgaccggctgcaggcgcttggaggagacgcggtatattatcaagctgatgccgcagatcaaaagacgatgggatgggtcatagaagaaacgaaacggacttggggctcccttcaaggcgttattcattcagctggtcatgccgatgatcggttatttacagagatgaatctgactgattttacggaaggcatgactgctaaaattgaaggaacggtatgcttagatgaattaacgaaagatgagccgcttgatttctttatcgtattttcttctatgtcttcggtcttcggagattttggacaggttaactatgcgatgggcaattattttcaagatcaatatataaattggagatccgaacagagccgccggcaagagagacaaggcaagagcatttcgattaactggccgttgtggcgtaaaggcggaatgcatttaaacaaagaagctgaagacgcatatctttccgcatccgggtttgattatttggaaacggaagaagggatagcggcttttgagacaattttggcaagtgactgtccgcaaatttcggttgttaccggggatgccggaacaacaccagcaaaaaatgatctgccgcatcaaaaagtaaatacacttccggttcgtcaagaggaaagttcttatacaggaccggattctgcagacaatgtccttgaagaactgaagcaaatggtgtcggaattattgaaaataaacattgaacagctggatacggcagagaatttcggcaatctcggctttgattctatcagtttgaaaacattagctgtcagactgaataaaaaatacaagcttaagctgacacctgccgttttctttacttacagccatataaagtctctttcagaatttctaagcagtgaactgcgtactgttgcaaaagggaatacagatgcagaaaaaaccatttctgaaaaaaggaaagtagtgcacgccgggaaaaccgcagggaaaaccgtgaagccgccgcgaagttttccgtttgaaaaaaagacagcaagacaggctgaccatcatccggagaagcagccggttgccattatcgggatgagttgtgtttttccgggagcaaaaaatgcagatgagttttggatcaatttaatcaatgaaaaagattcgattcaggaaattcccccggatcgatgggattggaaaaaatacgccgaaggcaaaggaagcagcgaagtacattcgaaatggggcggatttatcacagatgccgataaatttgatgaggcgtttttcaatattaatccgcgggaagcagaactcatggatcctcagcacagaatttatttgcaggaaacctggaaagcgatagaagatgcgggttacaaagcttcaaagctgtcaggcaaacatatcggggtgtttacgggcattcaatttaatgattaccgccagctgctgatgaggcattcggacggggcgcatgcgtttgcgggaaccggaaacagccaggcgctcatcagcaatcgtgtatcccactattttaatttcagaggtccgagtgagtccattgatacagcctgctcaagcagtcttgtagcaatccacagagctgtgcgctcgattcaaaatggtgaaagtgagctggcggtagcaggcggggtttcgctgcttttagatccagtcacgcatatgtataccgataaactcggtattttgtctagggacggccggtgtaagacgtttgataaacttgccgacggttatgtccgcggtgaaggtgcagctgttctgttattgaaaccattgcaagcggcaatgaatgacagagacaatatttacggagtcctgagaggaaccggagaaaatcacggaggaagatctgcttcattgaccgctccgaacccggaagctcaggcagaactgttaacgtctgtttataaaaatgccgatattcctgttgatacgatatcttatattgaagcacacggaaccggaacagaactgggagatccgattgagattgaaggcttgaaaaaagcgtttggatcttttgagccgcatccaggaaagaatcatgaccaatattgcggcatcggttcagtaaaaacgaatatcggtcatttagagcccgcctctggaatgccggggctgattaaagtattactatccatgaagtataaaacattgcctgccacacttcatgtcaaggagctgaacccttacattcaattaagcggaacaccgtttcatattgtcaataaaactatgaagtgggccagattaaaagatcgaaaaggaaatgaaattccgcgccgtgccggagtcagttcctttggattcggcggggcaaatgctcatgtcatcgtggaagaatttgaatacggacaagataaagcagtaactgccgagcgggatcaaatcattgttctatcggccaaaacaaaggaaaggctgatggttaaagccaaagagttaacagcgtttttacatgaagaactatcagttcaattcagtcagcaagaggtgcaggaacgtgatgtgcaagaggcggttcgggaagcggcagcgggtatcctgcgtttagataccgcaaatatagatgcaaagacacctctttcggaattcggatttgatccgttggcttattccgaattaatctcttttataaaccaaatgtacggcacagaaatatcactagacatatttcaggaattaatgaccctgagcgagctgtgccgctatatcagcagcgtgcggaatcgatcagctgataaaccgtataacggcaattttagagaaaagtccggaatcggtcttgaagaaatagcatatacgctgcaaaccggaagggaaccatttgaatgccgccttgcgatcacttgctcgaatatcggagatcttcttgaaaaattaaacggttacattcaggggagcaggctgcaaggtgtttatgaaggaaatgtaacggattttgatagtctgtacgctcctttattcggcggccccgaaggtcatgcatatgttcaatcactgattcagcaaaacaagccggccaaactggctcagttgtggacgatcggttgtgaaatcagctgggaagacttgtatgaggaggaactcaaaccggttaaactgtctcttcctctttatcctttcagcaagaacagacattggattcatttaaataaagatgaagcgcagaaggctgaggctttctcgaacactgagcttcacaactcaaataaagatacagcagatggagaaatcatgtcgcttcttgaaaaagcacaaacaggtgaaatgaatacgaaagagacgtcagagctgatagaggagttgcttttccatgaatgaaaaaacgatgcaaattgagcaaatcgtgaaaaaggtgaaagaaggcagcctgacgcgtgaagaagggctggaattaattaagagcttggggaaaacccatctatatgaaatggtatgggatagacatgaatttaaaggcagtgaaaaattcccgaatacgaaagagccaattttatttttttgcaaagacgacagcatgtataccgtaatgaagagacagcttgaaggttatgaggcgcctttcatttacgtgacttccggcgagcgtttcgaagattgccggaacggtcgttttaaaatgaactttgcaaaagataaggattatgatgcgttatgcggggttctgcgttctcaaaatataagaccccgccatattattcattttttagctgccgggctcttcaaaaatacagaagatgcaatgagaaagcagctcaataaaagtctgttttccttgtttcaaatgtttcaggccttcatggcgaacaaactttgtccgaaagcagaaattttgtatctgtatgaaaataccgagggcgaggttcagcccatttataacgcggttgaaagttttcttaagaccgtacaggccgaaaacccgaatttcacatgtaaggctgcagagctgaaatcaatgtttgacgagccgtttacaaagcagcatattgcagatgtcatctcttttgaatggaacaatcaatgcaagacggaccactttacctgttatgagccgagacattattataaaaggcagcttaaaagagtaaaaaaagaagatggggagaaacatagtttcagtgtaaaaaagaacggtgtgtatttaattacgggaggagccggcggtctcgggtatctgtttgcggaatatctggcgaaacaggcagaagtcaagctggtattaaccgggcgttccccggcatcccgtgaaacggcgcaaaaattgagcgctcttgaaaatcgcggcgctgaagccttatatgtcccggcagatatttcaaaggaaaaagaggcggacgcgttaattaagcacattaagcagacattcggagaattaaacggaattttgcacagtgccggacttgttaaggatgcatttatcataaaaaaagcgaaagaaagcatagaagaagttatagcgcctaaagtattcggaaccgtttggctggataaagcagctgaagaagagcctcttgatttcttcgttatgttttcatccctttcggccgttctgcctaatgcgggtcagagcgactacgccttcgctaacggatgtatggacggattcacccagtatcgaagcatgaagggacgtcccgggaaaacactttctattaattggcctttatgggatgcggggaatatgacagttggtccggcagagctgcaggctttaagacacacggggctggaacttttatctgcccaagcagggcttgccgcttttcaggacagtatgagccgttctgcttctcagctggctgttatcagcggagacaaagatagaataagtgaattactctcaactgaccataaaaagatagagactgtgcctgaaaacaacagtctgccgcaattaaatgaaaaagatctgaaaaagcaaacggtccgtctattgacagagattgtcggtgcggaaacgggaagaccggcggacagcattttacccgaggatacatttgaccgttacggaattgattctctaacgattttaggtcttaactcccgtctggaaaagtattttggaagagtgtctaagactcttttctttgaatacagcagtgttgaagagttgtcagagtattttcttgaacactatcaacatgagttgaagaaggcgtttttaccggcagccgaacagcgaattgatcattcggcgccggcgaaacgggagaagctttccgtttcccgcataccatccgcaccttccgaggaagatattgcaattatcggtatagccggccgctacccgatggcgaaggatgtggaacagttttgggaaaatatttcttccggaaaagattgtataacggaaataccgaaagagcgctgggattttcggaaatattatcacacgggtgacaatgcccgtcatgacagcaaatggggaggttttataaaagacgctgataaattcgatccgctgttcttctcaatttcgcctcgtgatgccgagttaattgatcctcaggaacggttatttttagagacagcatggcacacgtttgaagatgcgggttacacaaagaaaaagttgaaacggcataagacaggtgtatttgtcggcgtcacctacagccactatcagttatttgcagccggtgcttcagatgatgagggacgtcaggcgctcttatcttcttattcgtctatcgcaaaccgggtgtcatatttctttgacctgcacggacccagccttgcaattgatacaatgtgttcttcttcactttctgctgttcattttgcatgtgaaagtataaaaaggggagaatccaccctcgccatagcgggaggagtgaatttatccttacacccggataaatatactttactttctcaaaatcattttgtttcaagcgatgggcgctgcagaagctttggagcgggaggagacggatatgtgccgggagaaggagtcggggccgttcttttgaaaacgctttctgccgcaaaggctgacggggacaggatttacggtgtgattaagggaacatctgtaaatcacggcgggaaaacaaacggatacactgtgccaaatccgggcgagcaggcaaacgtcatcagtgaaactcttgataaggcggggattgatgcagacagcataagttatattgaagcgcatggcaccgggacatctttgggagacccgattgaaatttcaggtttaaccaaagctttgcacagctcgaaaagcgattatcgttgtgcaattggttcggttaagtcaaatatcggacacctagaggccgcggctggaattgcttctatcacaaaagtgctgatgcaaatgaagtataaacagcttgctccttcccttcattccgataacttaaatcctaatattgattttgaggaaacaccgttttacgtgcagtctgaactgactgattggaagacgccgcaaaatcaagcaagaaggtcgggcatcagttcgttcggcgctggaggatctaatgcccacatcatcatcgaagagtataagaatgaagaaaagatggaaacggtacagagcaacaaggcgcaaattattctgctttctgccaaaaatgaagaacggctcagactcttgattgatgcatatataaaagaactggagccaaaaacgtcactagctgatgccgcgtacacctcgcagaccgggagaaacgctatggaagagcggctcgctgttgaggttagcagcattgacgatcttcgcaataagctgacgatgtatttgcggtcagatcataagttaaacggtttatataggggaaaggcccgccgaggcgctggtcaaaagaatgccctgtcagccgctcactttgaaaatgcaagagatatgtccattcactgggtgaacggaggagacgttgaatgggaagaaatgtacactgcggaattaccgaagcttatctctcttcctgcatatccttttgaacggaacagatattgggtgcctgccgctaaagcagcagagaaacagaaaaaaacaggtgtaccgcagagtctgccccatgcaccgactgacttatcatttgatgtattaaaaaaatcgtggaaaaaacaaaaggctgcgccttccgcttttacgaaaggacaggtgatgatcctggctaatagtgaaagtgagcggcttgcattcgaattgtttgattcagatcctctgattgaatccgctgtcatttgcgcagataactgggatcaatcggatggggaagccaaaaaaacggctctagcagtcatagaagaaaatccggaaatcatcggcatgattgacctgtcagatttgcggagtaatcaaaacggggcacgcaccggcacaatcgggaagctgacactgctgcaggaaatcataaagacacgtaaacagcttttcgttttacatgtgacaagagggctgcagacatttctgaatgacaagccgtcgttagccggagccgaaacagccggactatataaaatgctgagcgcggagtatcaaaagataaaatcaaaaacaatagatgtagacgggcatgtcgggactgcggcggaactgagacaggtaatcacagatgaagcttgcgctgacgggctgtatagtgaaatctgctaccggaacggtgaacgttatattccatacgtcgagaaattacatgcagcggaaataaaccggaaactatccggtctgccggtctgccgtacggatcaaaccttggttattacagggggaacaagagggatcggagcagaacttgccagacattatgccggcaagggagtcaaaaaacttgtgctgatgggagtaaccgaccttccggaatctgataaaatagccggcatgttagaagacaccgatgaaaagtcacctctttattcgaaattacaactgctgcatgagttggatcaaaagggagttcaggtggaagtgtattccgggccgctcacggaaaaagaaaaattacatcgcttcttttcagaggtgagaatgaagttcggcaaaatcggcggggtgattcattgcgctggtgcagccaatcattcgaatccggcttttatccataaatctgataaagaaataagagaagtatttgagccaaaggttcaagggatgcaggtacttcatgacatttttattgatgacgaacttgatttcttcattttgttttcatctgttgcgagcgcttttcctttattaggcgccggaacaagtgactatgccgcggcgaacgcttttatggattactttgcggcgtatcagcatgcagccggcagaacatattatcaatcaattaactggccgagctggaaggacattggaatgggcgaggtgacaagtccatcatatcaggcactcggtttactttcacactcaacagaaacaggtatttctatgctagatgaaatcatgacgataaacggatatccatgccttataccggcaaagacacatcaggagaaattcaagctgcagcagctgcttcagacaagaattcaagctgctaaaaataacccggatgctgaggaaaaagtgatctctggtcatggagacaatgaagctatgatcaggaagttaatggagattttttccgcagagctgaaaataccttacgggaaattagatcaggatacgtcttttgcggattacggagttgattcaatcttactcgttcagcttgtcaaaaaagcggaagatgcatttcaaataaaaattgaaccttcggcttttctggagtatccgagtttttcacaactgggcgcctatttgaacgagttatttgcaagtgaggggatcagtcctcaaattaattcagaaaacattgaggttcggaaaaaagagcaacatataaatcaaaatgcttccgaagtacgggacagcggatctcaaatgcaaccaaccagtctgaaccaaatcgctattatcggaatgggctgtgagtttccggatgctccggacacagaaacgttctggagaaatttgaagaaaggacaaaatagtgtccgtgaagtcccggcgtcgcgatgggatatttcttcatactactctgacacctatgaaaaaggaaaaagtatcagtaagtggggcggatttcttcaagatattgagtctttcgatcccgcgttttttaatatgaacaaaagtgaagcatcagagcttgatccgttaatcaaaaaatgccttgaggtcagcgtccagacattgagagacggcggctatacaaaagaagaagtatcaaacaaagaagtcggcgttttcatcggttcgcggaccgggacgtttatgtccaaaataggttcaccttcaaaaaatacgatcgtgggtataggacaaaatttcataggcgcgcatatctcacatttttttaatctgaaaggaccgaatctggttgtagacacggcatgttcttcctcattggtcagcgtccatctcgcttgtcaaagcctgatgtcaaaagagtcagatatggcgattgcgggcggggttgacattttgctggatcaaaagccttacgtcatgctgagtgaggctcgggcgctttcacctgaaggaaaatgtcatacatttgatgaaaaggcagatggatttgtaccgggagaaggatgcggcgcagtccttttgaaaagacttgatgacgcccttgccgaaggtgacagaatttacgcggtaattgactcatccgcggttaataatgacggacagacaatgggaatgacaacacctaatccgaaagcgcaaagcgcagtgataaaaaaagccctgaaaaaaggcggaattgatgcagatactctcagttatgtcgagacgcatggcaccggtacgatgataggagatccgattgaattaaaagcgctgactgaagtgttccgggaggttacggaagaaacgcaattttgcggagtaggcagcgtaaaaacgaatttcggacatttaatgagcgcagcggggatagcgagtattataaaggttgccttatccataaaaaatcagatgctcccgccgacattacattgtaaaacgccaaatccgcgttttaaatttgatcagtcgccattctttccgaacacgtctttaaaagaatggcgtcccagaaaaggggttttgagagccggaatcagttcttttggattcgggggcacgaacgcacatatgatattgagcgacagccatctcacattaggatatggagagacaaaaagacacccgctttctccggttatattcaataaggaacaatgctggatcgacaatggagaaactccagaaaaggaagagtcagaattgctgattcctttacttgatttcaaagaattataaagaaaagaaaaggaatgagacaggtggccagtaatcaaaactatcagttcacattaacaattaaacatacggactatattgtcagggatcaccgggtgcatggcacccggattatacccggtgtcacatttttagatatgatataccgtatggcgctgagtaaaggtttgcctattgaagaactcgagtgtcagaatattttgtatttggaacctgtagcaacatcggatacctttgacagagaaatccgcatccgttttcagggattggaacagggatgggaaatccaggcgaagagcagaaaggtaaaagatgaccgcattctggatgaaagctgggatgagaatatgaactgcaggctcatgcagaaattcccggaaagcatgagttcaattcatatcgatgaaatcaaacatgcctccgtccgtgaagccgatatggagatatgttatgactatttaaaaaaggttgatatagagcattttgaatttatgaagagtctggggaaggtttatgcgtctgatcattctgtacttgcagagttgtcgctcagccaaattgccaaacaatataccggctattttcaattacatcccacttttcttgatgcgtctaccatcatatcgatcctttatcaggcatgccccgaatattttacacaaggatctccggcaagccggatgaaaacgtatattcccattcatattgaatctttccgtatgacgaagcgcctggaagacaggtgttatgtgtacatagagaagcaagaccaacatcatgattcaggggatgtcatccaagtcagttacggtttgtacgatgcacacggggagatgatcgcttattttacgcggctgtctgtgaaacatattcgctcaaaagatttaattgaaaacctgaagcagactcgtttggaaactgaagcggcttctcagccaaaagacggcctgatcagaaaagattccatcatagatcgaagcgaaagcattgagacacaccttaaagaattaatatccggggtttcaaatctagatctgcgtgacataaggacagacattggtttttatgaacaaggcctggattccgcttctttgcttgccattgtcaaagaacttgaaaacaaaacaggggaacagctgtatcctacactcctgtttgagcagaaaacgatccgggaactcgccgcgtatattaaagaaaatcaaaaaatgtccagttatttcttaacgcaaaatcaaccggctgaactgcctgacatgaaagaaagtaagaacgaaaatctttccgctcttataacagaaggaaacattcagcagctgatcgcagacatcaaagggactgcccctgaaacactctctgtggtaaaaggtttttatgaacaaggcctggattccgtcacacttatgcaagccgtaaaggcattggaggagaaaacaggcagggaactgtatcctactttattgtttgagtatccgacgattcaaaaacttgcaaattattttgcggagagcggcgaaaagacttccgttgaaaaagacctccctcttcatcatggagagaatcatacggctctgacctatttaacgccgtattggagacaaaaggctgccgcttgggacccgcattgcggaaataaaaagaaaagaacatgtctgctgtttcaatatgacagagagctttttcattttatgcgggaaaatgctgaaaatggattcgaaaatacacagatcattctcgttttatcagggaatcgtttctcctatcatagagacggtgtttatgagatagaccacagggaggaagctcactttgacaggcttgcagctgatctgaaaaaaagggggcaaatgcccgacaccgtggtttacgggtggccggaaggatcatttgccggcccggaaaaaataagtgaacagctttctaaaggggcttacccgctattctttttcagccgggcattgatgcgcagcaaggcggaaaaaaaggttgtatcgcttttcctttatccggcggatcataaaaatgatcagccgctttacgcttcagtccatggcgcagggcagtctattttgcttgagaacccgaaactggcccttaagacaatcgggatatcagtttcagacaagtcatcgttgccggctcttacagctgaaatcatcagatgcgaatcaactgaagcgcatccgggagaaaccgatctttattatgaaggaaatgtgcgctgggtccgtgccttacgggaagcagaaccggctcaaaactcaagtttctcctttaaagaaaacggagtatacatgattacaggaggggccggcggcttaggccttatatttgcagaacatatcgcagcgcaaacgaaagccaatattattttagcgggccgttctgaactgacggaagacaaaaagaacaaaatcaggcgaatgaaagcaggcggttcttcggttcaatatataagaggagatttttcagatagccgcgatgcagagcgaatcataaaaaccattaaaaggcaattcggagaaatcaacggtgtgatacacagtgccggtgtgacgcacgacgctttattgattcaaaaatcaaaagatgaaattcaggaagtgatcgctccgaaaataaatgggacggtcttattggacagcttgctgcaaaccgaacctttggacttctttgtgatgttttcatcaagcagctcgatgtacgggaatatcggacagacggattacgcattggccaataggttcatcgatcttttcgctgagtggcgtgaaggaatgaggcggaaaaaagaacgctccggcgtctcagtagccatcggctggcccctatgggaagacggcggcatgaaagtggataaacaaactgaaaaatggatgaaacaaaaaatcggtatggttcctcttagtaaaaccaatgggatcaaagcttttcaagattcactctctctgaacgcatcacagctgatcgtgtttgaaggtgacaaagaaaaattggaatctgcacttcaagataccttaatggaggatgaaagccgtgagatccaaataaatgaaacggctgatataaggcatcaagacattgccattatcggattaagcggaaagtatcccatggccgaagacttacctgaattttgggataatttaaagagcggaaaagattgtattacagaaatcccgcctgaccgctggaatatggatgatttcttcagcgaagacagagatatgaaagggaagtcttacagcaagtggggaggttttatcagcggtgccgatcaatttgatccgcttttctttcatatttccccacgggaagcagaacttatggatccccaggaaaggctctttttagaaacggccaaaaattgttttgaagactcagggtacccgagaaacatgctggaaaagatgaaagtcggtgtatttgtcggtgcaatgtggggccaatatcaactatttgaaggagaagaaaacggagtggctttctcgccggcttccgtctattcttcaattgccaatcgggtgtcttattactttcatttaaaaggtccgagtttggctctggatacaatgtgctcttcatcactaacctctattcattacgcatgccaaagcatacattgcggagagagcgatatggcattagcaggcggagtgaatttgtcaatacatccgaataaatataagttcctcagcatgggacagtttctatcaagtgacggcagatgccggagttttggaaaagacggaagcggttacgttcccggtgagggagtcggagccgtattgttaaaaccattgaaaaaagcaatagaagatcaagatcaaatatacggcgtgattaagggaagcgccgttaaccatggaggaaagacgagcgggtattccataccgaatccggatgcacaggcggaggtcatttcagaagcgcttcgtaaagctgacattgatccgaacaccgtcaattatattgaagcgcatggaacagggacgtcattaggcgatccgattgaaattcaaggactgaaagattcctatcaattgaaccatccttgcgccatcggttcggtgaaatcaaatatcggacatttagaatctgcggcaggaatcgctgcggtaacgaaagtgcttctccaaatgaagaataagcagcttgttccctctctgcattccgatattgttaatccgtttatagattttgatcaggttccttttcaagtgcagcggaaagcggctgaatggaatattccgcaaaacagccatgctgttcatcctttgagagccggggtaagcgcttttggggcaggaggaacaaacgcgcatcttatattggaagcgtatgagccgccaaaagcttttgatcatcaaagcggccgagtgatctttgttttatcggctcaagacaaacaacggctgataaaatatgcgaaggttatggctgattttctatcagaaaatgaatcgaaggataacaatcataaactgcgtcttcaggatattgcctatacacttcagacgggacgcgatcatatggaagaacggctggcgatagtggcagattccgggcaggtcattgctgaagagctttcagcttataccaggggtgaaaaaagcagcttaagctataccggtaatacattcgaatcagaagttcacaatgaaatgcctcacgtttgttcagattacgccgaagcagcatccaaatgggtaaacggaagaaagatagattgggagacttttgaggtgaatcggaatgcccgcaggatttctattccgggacaaccgctgatcaaacagcggtattggatagcggaaaaaggggaagcacttgtttcagcggatgtgagtaagacgggtcaccctttcttggggagtaacacgtccgattttaatcagttcagtttcacgaaaaaaatcagccgtaatcatccgttcgcactaagtctgtctgaaggaaacgtgtcctttttcccttacgcatccttggctgaaatggctatcgtcaatgcagcggcggcatttggacaaccagttcaaacattgaccgatttattgtggaccgaaagcatgaacgggatgactgatatacgggaactgatgattacgctgacgcctgagcgtgactttgcgcggtttgacatatatgcaaacacaaaaaatgagaataaagtacgtcttgccaggggaaatgcgcatatggttaagcctgaaagcggtatgcttcctgaagcgctagatattgctgaagtcaaatcagaaatgactgaacatccggctgaagcgccttttgtcatagaatcagtgaaaaacagttacggaatgctgtcgcttcattcaatgccggatgagctttatgcaaaaagagaaaattttacgatttcacctgaagcgcttgagtccgcgattcaagccagtgcgttttttgtcagcggagaaaccttcccggaattgatcggaatgggagcggcggatgtctatcagcctctcgctcaaaatttttacgtctatactcaaaaagagaaccggcagaacagccgtgatgtaacgtgtcatatgacatttacagatggaaacggaagcattctggcggagtgcagagatgtgagattcagatatggtcatgaaaaagacactgttcagacggacgatgaactcattcgtctcctgcgtcaattagaaaccaatgatattgatcagaaggctgtattgaaacaattaatgggggaagaatgatgaacggaaaacgtgaacaaatcagcgatattcttgatctgattcaaacaggacaaatgtcggctgacgaaggctatgcccgtgtgacatccattcagaatcaaaaatcacgggcatcgaaccatccgcttttatattacaagccggaatggactgaatcgttcattccgagtacgaagagcgtacccttgacgggattgctcctgatttttgcagaaaatgaacggcaaatacaagaattgagcggtttgtttaaggactgcactctcttgtttgtcatccgcggaaaagaatttactgttttacatgatgatacgatttgtatgaaccacgtgaaaaaagacgattatctaaagctgttccgatacattcatgatcattatcagacgcccgaaaagattcttcacttgtggtctgattctcaggctgacatgagtaagggaggtatacagaaacaattggaaaacggattgttttctcttctgtatattacacaggcgctgattgaactaaaatggaaaaagatactaaaactgacgcatgtttttcaaactgagaataaagaacaactgccgctgcatcatgctctcggcggattggtgaaaaccgttcaccaggaacaccccaattttcactatcagattatcaatatcactctttcagagggtgcgggagccgctcttccagcaatagctgatatatatcagagagagtgtgacgaaaaacgggatatccattttgaagtgcgctatgaaaacggcagacgttttacgaaaagctataataaagccggctcattcgatttaacccagccgctgaaacatcatgggaattatctgattacaggaggcctgggcggtctcggttatatactggcaaaacatctgtcggaaaaatggaaagcgaatctcatattgacagggcgctctgatttaactgaagagcagaaaaaaaagatcgaatatttaagaagctcaggttcaacaattgaatacatccgatctgatgtttcaaaacaaagtgatgctgaacggatgtttgcttttgcaaaagagcagttcggcaccttacatggagtatttcacagtgccggcgtactccgtgactcttttatcttaagaaagacaaaagaagaaatcgatcaagtcacaagttcgaaagtttatggcacgctctggctggcggaagaaatcaaaaaaatgaaagttgaattacttgtcttgttttcatccacatcggcagtcttcggatcagccggccaatgtgactatgctttcgccaatgcctttttggatcagtatgcagcagttatgaccgcaaaagagtctgccgaaagggtggtgtcagtcaattggccgctatggacttccggcggtatgaatattgacgatgaaggaatatcctacatgaaacaggaactcggccttgacccgttagatgacagtgacggaatacaggctctggagaacagcttgtgtcaatcatctgaacagctgattgccctgaaaggccgaaaagaaaagattgaggatgtgctgaagcgtgccggcacaatcagcttacattcataccagcaggaagatgccgatttacaaagcgatgaattaagacaaaatatcatcagttatctaaaaaatataatgtcagaggaattgaaattaccggcctcactcatagatgaaaaacaatacctggagaaatacggcattgattcagtgatgatcatgcgtctgaccaaaaagctggagcaaagtatcggcagattgtcgaaaacattattttttgaatatcattcaatatcgcagttagccgaatatttcctgagtcatcacagcgaacgaatgatgaaactgctgaacccggccggcaaatctgaacttgtttcatatcaaaaaaagcaaaaaagaaaaccggtggaaacaaaagcgccggcacgctctgaaggagaagattcaaaagagcactttgcggccgatcccctttctgctgatatagccattattggtgtcagcggcagatacccgggtgcggaaaacatcagagagttccagaatgtgctgatgaatggacgggattgcgtaagcgaaattcctgatgaccggaaggaaatgctcgagggaagctgctataagtggggaggttttctgaaaaatccagaccggtttgatcctttatttttccggatatcaccgaaagaagcggcttttcttgatcctcaggaacgtctctttttagagacagtgtacaataccatagaggatgcgggttataaaccttcagatctgacccgcaaaaaggtcggagtatttgcaggcgtcacatatggaagctatcaatttttcggcgttgaagaatcacttaaaggaaatgaactggccgtcgggtctccattttctgcaatagcaaacagaatatcgtatttctttaattttaaggggccgagtatggcggtggatacaatgtgttcatcctctcttaacgccattcacttagcctgtgaaagtatacggagaggggaaagcacacttgctgttgcgggcggggtcaatcttacacttcatccgaataaatatacattattaaatcaaagccgcttctttgcaagtgatggccgatgccgtacattcggcgagggcggtgacggttatgtaccgggagaaggagtgggctccgtacttttaaagccggcggcggaagcggtaagggacggagatcatatttatgcgctgattaaagcgacagcggtcaatcacggagggagaacaaacggttttacggttcctaatccaaatggtcagtctgaactgatacaggacgcgcttcagaaagcttgtattgaccctcgtacaattagttatattgaagctcacggaacgggaaccgcactgggagacccgattgagatcaccggattaacaaaagcgtttcgggaatttacggagcacactcaatattgttcaatcggttctgtcaaatcaaatatcggtcatcttgaggccgcagcgggaattgccggtttgacaaaggttcttttgcaaatgaaattgaaaaaactgtttccttccatacatgcggagacgttgaatccaaatattgattttaaagcatctcccttttatgtacagcggtcattgcaagactggaagaaaccgaaactgcaggaaaacggaaaaacagtaactgttccgagaagagcgggaatcagctcattcggagccggaggaacgaatgttcatatcattatagaagaatatgaagaaacaaacgtctcaacagaacatgttgagaacgaaccgcatattgtcctgttatctgctaaagacaatgaacgtcttcttgagtatgccgaaaacatgaaagattttattcagcgttcactaagtcctgaagtaaaggataaacagcctgatatgaaagaaaaggtgaatgaagtactcaaaccgtttgtttcggaattgcttcatatccatccagaagaaattaatatttctgatcacctgagtgaatttggcgtagggcctttggaattaagccggatggcggattttattaacgaaatgtttcatattgaactcacgatgtatgaattaacggattgtccctctattcaagcggttactgaatacttactgaaggaatatgccggagcgataagaaacatgttcccgaatgaagtgatggaaggcggccaatcggaaagcgtcgttttacgggatctggcatacactacacaatcgggcagagaagcgatggaggctagagcggcgattaccggtacctctcttaaagaaatgaaagataaattatctgagttttgccgcggtgacaagcaagttccaggcgtatatgttaatcagcaatcagatgcatttgctgaaaaaatgaaggcgttaacggaaggcagagcaggtgaattgtttgtaaagaccattattgagaacggtgaagcggaaaagctggctcaattatgggtttggggggcggatatcgactggaaatccgttcatcaacatttacagcagccgggtaaacggatctcaattccgacttatccgtttgcaaaagaacgttattgggttccgtccaggactgagaggacagagatccctcagcattcttttcaacatcacttgcaaaaaaaatggagggagaatccgtttgtaaatccttccgaaacaaaagagtacggactgacagttgtatttgtgaatcaagacacagaatcaattgcccgcaccatttgttcggatatagatcaggagaatctgattgtcataaaacatcactcttcatttataaaacactctgatcaaatgtttgagtgttctttattagatgaaaaccacgcatacgacgttatccgtgagatcttctcgggcggtgagcggcaggtcgaaaatatatttgatttctcagatatcggaaaccagagtgacaatcagaacggcatcccatatggtaaattcttatttatacaagaaataattaagcggagtaaaaaggaaacaccattatccattttacaaatcaccaatggcttgcaggtatttaaagcggaaaaaccaaagctgacgggtgcagaatcagcggcttttctgaaagccctttctgcggaatacggctttgttcatgtgaaaacaatagatatagacagcatgaaagaaacgcataagcttaaacaaatctttgagattgaaagggcgcaatgtaccggagagaatgaagtatgctaccgcagcggcgtcaggtatgttccgtattttgaagaagaaagaatccataccggcgggccggtttcatttcctgcggataaagccatcatcattaccggcgggacagggggcattggcagagcaatagctgaagatttggtgaaacggggagtgaaaaaactcgtgctgacgggtacgcgtccattacctttgcgaagtgaatgggatcatttgctgaaagagggcagacaggacgaaaagacagtcagcaatataaaactgtttcaaagttttgaagagaaaggtgtcgactatctgtattacagcggttctctcacaaatgaagagaagcttcgttcattctttcaccaagtaagccttgaatttaaagatattagcggtgtcatacactgtgcaggactgcacagcggcggaaatccggcctttattcataaaagaatgagtgaatttaagacggtgtacgggccgaaagtcactggacttcagaatttggagcggatttttaataataggccgctggatttctttattctgttttcatcaattgcagcacagtcacccaaactgtcgaaaggaatgactgattacgcgtctgcaaacgcatatatggactatttcgcggcttatcattttcaaaaggggagaacgtatttcacgtccatcaattggccgagctggaaagaagtcggaatggggactgtgacgagtcctttatatgatgaattgggattggactctctttccacgcgggaaggactggcgattttgtatcatgcactggagaaaaaatcggccaatatcattcctatcgtgaaaaaaggaacagtgtttcatgcagacagtctcctgaacatcaataaaaccggcaaggcttcatttccagcccgaagacaggagactcccggcacttttgatcgttcagaagggcttgtcagtgaactttctgccatatttgccgaggaattgagcataccccttgaaaagcttaacccaaatacggattttcaggaatacggtgtggattctatacttcttgtcagcattatacatcgtatagaagcaatgattcagaaaaaaatcgaccctactgtgcttcttgaacacaacacgattcatggtcttgcggaatatatcggtaagacggcgccgccgttgaaaaaacaaatcgaacagactgattctcaaagcagcaatcagcatgatatgcagtctgtgacgagccgagatacagaaccgcagacgccttcctctgcaaagatagctgttatcggaatcggatgtaagtttccgggcgcggctgataaagaggaattttgggacaatctgagaaaagggaagaatcatattaaagaagtacctgattcccggtggaatatagaagaaaattactctccggtgcagcaaaagggaaaaagcatcagcaaatggggaggatttatcaatggaatcggcagcttcgatccggagtatttccgcatggaagaggagaaagccatccaaacggacccgctgataagacatttcttggaaacgagtgtacagactgtacgggatgccggttatgaagaaacagaattatcgggaaaaaaagtcggcgtatttgtcggttccagaatgggcggctacggtcacaaactgccgaaagaaagcagcagccacatcgtcgggcttagtcaaaactttattgcttcacatgtgtcgcatttctttaattttcacggtccaagcatggtttctgataccgcttgttcttcttcattagtcagcattcatttagcctgccaaagcataaaaaacggtgattcagaaatggcgctggcaggaggggcggatctgcttttggatgaaattccttacctgatgttaacagaaggaggagctctttcgccggacggtcagtgttttacttttgatgaaagggcaaacggctttgtacccggagagggttttggcgctgttctgttaaaaccgctggagaaagcaaaagctgacggagatcggatatacggtatcattgaagcatcagctattaataacgacggtgcgacaatgggaattacgactccgaatcctaagcttcaagagcaggttattcaagatgcatttgaaaaagccgatatcactcccggatcagtcagctacgtcgaaactcacggcacaggcacgatgattggagatccgattgagcttcaggctctgacaaaagtattccgaagagacacaaacaaaacgcaattttgcggagtaggaagtgtaaaaaccaatatcggacacttattaagcgctgccggagcggcaagtttcattaaagtgattttatcaatatggcataaggaaattccgcctacattgaattgtgaaacgccaaatccccgctttgaatttgaaaagtcgcctttttatccgaatacagaactgagaagctggaaggatggaaaacggagagcgggcatcagcgctttcggttttggcggaacaaacgcccaccttttggtaagcggcctggatgattcatatcattccgtcagaactccgctgccgcctgccgagtttgtcagaaaagagtactggccggattcaaatcggaaaaaacaaatcaaacagaataaaaaacggcttcttgaaattattgatgaaacagagtagcacctgctctgtttctttactttgtaaaagaagaaaggttgtcgagttgcatgaggttcagcgtattagtcaaacatgacgattatattgtttcagaccatgtccttcatcaagtgcgtacgatacccggcgtaacgtatctggatttaataacacgatttttagctgataaagggatatcaccccgaagttttgaaatcaaacatgttttattccgtgaacctgttgccacgtcagtccattttgataaaaaagtcaccttccagtttatggaacaagaaaacggctggcttgttgaaacaacaagcaggaaatgggtcgctgaaaaggcggaaggtgaagcgtcagtcaacttgcaggcggaaatcataagaaaaaatgcgataaacgaaaagacaatttcaatcgaagcattaaagaaaggggccgtccggacttcggatgctgaagccgcctatcgtaatttgcgcaggggcggcctgattcataaagattttatgaaattggaaggtacggtatatgaaggtgaaaattatattctgggagaggtcagtttaagcggactttcaaaagaatatacagatgacttttacatgcatcccgcatttttggatggatctctcagcctgttgggaatccttacatcagacttgccggatgaaggaacaaatgcgtttatccctatatatattgagacattccgggcactgcataaaacaaccggatcttgttttgtgtatattaataaaaacagtataacgcagccgccttctaaagacattttatatgcggacatagaagtatacaggcctgatggagagcttgctttttattatgaacgattcggtgtgaaaagagtcagaaatgaaaaatcaatacaaaggctggagcattcccataaagcaaaagaggtcggcagcgtaacgagcaataaagaaatgatcagaaataatttgatccaagagatagccggcatgattgaaaagcctgctgaaacggtgaagaatgatatttccttttacgagatgggcttggattctaaacagttattagacttatccaaaaaattagaactgatgttaggttcaaagctgtacccgactttattatttgattactccacaatcggtgaattgacagaatatctgcaggagaaatacggagctcgcgttacagactctatctctgatacagttcagcaccaagacagtcaaaaaacattaacagatgagctgtcatccattattggagatgttacaaacacgccgccaaataaagcggacaaacatcaatctttttacgaactgggtcttgactcaaaacagctgcttcatatatcgaaaatgctcgaggaaagattagatacacaactgtatccgacattgctttttgattataacaatattcatgatttagcagcttatttagaagaaaaatatgctgtgcgtaatacgccggccgcagcttttaaagaaaaaacgcaaacgaaagagccgtctgaaaagccgatgcttgaatctttatatttacaaaaagaatggatagaatcgccattaaaatccggagaagtgtctaaggaaaatacattgattttcgatttcgacagttcattgagtgatgaaatccgaaagtacatcggcagtgaaaatgttatttatgcggaagccgctgctgaatatgaaatggtaaatgaaaagcattataaatttaatccggagcagtctgctcattacaccagactgttagatgatatgaaaaagtccggagcgtttccggcgtcaatcattcattacctgtcaaaaaaagcttatactgaggcagcgttagatttgactcacagcttttattcaatcctttatttaagcaaagcgttgatccgtcaaaaaataaaagataacatcaacattttgtacgtacatgacaaggatcaatatacaaatccggtttacgccgcgattggaggcttttttaaaacgctgaatgcggagcagccgaatataaagtgtaaaacggttgagatttcttcaagacagaccattgaaaaagcacctttgcttctcactgaattaagcgccggacatcatgaggctgtgaaatatgacggcgatcaaaaaaggcgggtgacagcatacaaagatgcttcgctgcaatcagggcaaaaggccgcaaagtttgtaaaaaacggagtgtatctcataatcggagggttaagcggcatcggctggattatttcagcgtttatttatgcaaatcacggagccagcgttatcattgccggacgatcgaaaatgacagcagaaatggaagaaaaattagacagcatccgatatgacggggcaagcatttcttacatccaggctgacatgtcagataaacagcaggtcatcaagttagcggaaaaaattcatgctgattattccgaaatcaacggggtcatttacagtgcaggcgtgttaaaagactctttcattatgaataaaacagacgcggaagctcaggcggtgctgcaatcaaaggtcaatggtgtgattcatttggatgaagcgctcagaaatatgcctttagacttttttgttttgttttcttccatctcatcagaaatcggaagtctgggtcaagccgattacgcctacgccaatcgttttctggagcattttgccgagtggagggaatgtatgagaaaggagggggggagatcaggaaaaaccatcgctgtaaattggcctttctggaaggacggaggcatgtcagttgatcccggcattcaagacattatgaaaaccgagtacggacttcacccattagaaaatactgccggaatcaaagcttttgaacactcgcttctcggccaaggccaccagctgatcgtgttatacggagaaaaagaaaaaatacaaaatgatttcaatccgttatccgcccgttcagcaccgcctctagtaagagattcagcgattgcagccgattttgatgcttcgtcaatcgttacggaagaagaagctgaaagtccattccgaatactcggcacagcttccaatcgtcatctcgacgattatttgcattattggagcagactgaagaaaggagcccttcagcacgatcaaagcgatgccgcaaaaaaactcatcgctttttaccagacagaagaaacggaaaccgttcattttctggcaaacacagaaaatgcccggcatatggaaatattgatgagcggtaagggtgaaacaattttactgatttgcggttttgctaccactgcttacatgtggaaagaacagatgaaggagtgggcagaccaatttaatgtaattgtcatccacacaccgggttacgggctgagtgaggggagcgccgattttacattgagcgggctggctcagacttttatcgaagtgctgaacgagataggggttgcttggccgatccacattgcggcagcttcttggggaggcatgatagggcagaggatagcctatgaataccctgaaaaagtaaaaacactcattctttccggaagttacaccgaatacgaagaagaccctgaaagcagtgttgaggaaaaactgaaaaatgattttatagctataggaaaatcgcatgaatatgaaagtttatacaggaatcaattcttaaatgcttctattgaacgttttatgaagatacatcaacaagaaggctattctacgatcggctttttaaaagacattcatacaagaacgcttatccttacgggtgagaaggaaagcgtagttgatcagaaagaaacaaaaaggctgcagaaactgctgagcaatgcagaattaaagaaaattaagggagcggggcatcttccgaacttcacacatccggaagaatttaataaagcggtgtcagaattcatcaagaaatcagtaagtaagggatgaaaacgatacatacagtacagggggagaaaacaatgaaacaaacaataagcaatccggcatttgatatgaaacaaattaacgctcttaacagccattatcagacgatgatagacaatggagatctgcaatgtgcgagttatatgatgtcaagaggaggcgaggtttttgcagctgagtcgttaggggaatttaccggcggacaaaaagaaaagcaaacatttcagcttgatacaatcagagaaatcggttctttgacaaaagtgtttaccgctgtagccgtcatgcagctcgtcgaaaaaggtctgctcgatctgaaaatgccggtcaagctcattttgcctgcgtttgataaaccgggtttcggagacattaaaattttacaccttttgactcatacggcgggattaagttttgagctggatattcaaaaggctgaagcgattgacttaacgaatgaggaagaatggataaactatctgatcagtacgcctttagagtacggagtggatgaagcatggaactattccagaaccggctttgttatacttggcatcattatttcaaaagtaacaggcgtatcctacgaacagtatgtgacaaagcatattattgaagcgctcggattagaaagaacgtttttttatgtgcctgatgcgttaaaagaagaagtttgtgtgatcaatgaacacgagtgcgtacagctggaaaaaagtcatcacccgtattttccgaataaagcgacaagcggtctgtactcttcgctggaagatatttggaagttagctgaaatgtttagaaataaaggcagattgaaagataagaagctgcttggaagaaaaacagtcgaggccatgctgagaaatcaaataaagcccggtcttcctttttacttcttcggagcgcccagagaggaaggcggctttggtttaggcattaatttgtggccggccggtgaccattatttcatgacagaaggcaccttctcacatcttggaatgggttggtgcggcatgttttctgatccagccgaagattttacgtatgtatttttcactccgatttccgagtttcatcctcatgccgtgctgacgccgctgaatatcgtgtgggcgggtattgaataattagacaaaagcatcgtcccgtctgtccggcaggcgggacgattgctaactgcccgtttttatcccgcggcatcttctcaaagcccgccctcgaagttaaataacttaatttactctttgtaattttttttaattatagtacagtagagcctttttataatacagtttaaagtcttttatagtacagtttggcgcagtatgatcttaagttttataagcggtttcaaaataaggttataaataattgacggctttgtttaattactgtaaactatggttgttgatcatattgtactaataaaaaatctttttttattagtacagtttaaacgtcattatctttgcttaagcgctatgtgaatttctgaatgattatttttagaattgcagagcatgataagactgtttttaatacggatggctaaacggtatcctaaccctgttaaatcaaaagaagaggtggtttaaaaaatggctgcaaagacaaaaacttcaattgttgatagcaaaaaacaatttgatgctattaataagcagtttgaaacgttccaaattttaaatgctgaaggagaagtcgtaaataaagacgcaatgcctgatctttcagatgatcagttaaaagaattaatgagaagaatggtgtatatccgcattttagaccagcgttcaatttctctttcccgtcaaggacgtttaggtttctatgcaccgacagcgggccaggaagcttctcaaattgcatcacacttcgcgcttgaacaggacgactttatccttccgggttatcgtgacgttcctcagctgatttggcacgggcttcctttacatcaggcattccttttctcaagaggccattttaaaggtaatcagatgcctgagggagtaaatgctttatcacctcaaattattattggtgctcaaattattcaaaccgcaggtgtagctttaggtcttaaaaagcgcggtaaaaaagcggttgctattacttacactggtgacggcggagcttctcaaggtgacttctatgaaggaatgaactttgccggagcatttaaagcgccagcgatcttcgttgttcagaataaccgctatgcgatttcaactcctgtagaaaagcaatcatccgcgcagacaattgcccaaaaagcagttgccgtcggtattacaggtgttcaagtagacggaatggacgcactagccgtttacgctgcaaccgcagaagcacgccagcgcgcaattaacggtgaaggtccgactctgattgaaactcttacattccgttacggacctcatacaatgtccggtgacgatccgactaaataccgtacgaaagaaatagaaaatgaatgggagcaaaaagacccgctcgtacgtttccgcaagttcttggaaaacaaaggactatggtctgaagaagaagagaacaaagtgattgaacaggccaaagaagaaatcaaacaagctatcaaaaaggctgacggcgaatcaaaaccgaaagtaacagagctgattgagaatatgtttgaagagccgacgttcaacttgaaagaacaacttgaaatttacaaagcgaaggagtcgaagtaagccatggcgcaaatgacaatgattcaagcgatcactgatgcgttacgcacagaactgaaaaacaatgaaaacgttctgcttttcggggaagatgtaggcgttgccggaggcgtattccgtgcaactgaaggccttcaaaaagaattcggtgaggaccgcgtatttgacacgccgcttgctgaatccggtatcggcggtctcgctctcggtttaggcctgcaagattaccgtcctgttatggaaatccaattcttcggattcgtatatgaagtaatggattcaatctcaggacaaatggctcgtctccgctaccgttccggcggacgctggacttctccggtgacaatccgttctccattcggcggaggggttcatacacctgaacttcacgctgacagtttggaaggccttatcgctcagcagccgggtattaaagttgttatcccttccactccttacgatgcaaaaggactgctgattgcctctatcagagacaatgatccggttgttttcttagagcatatgaaactttaccgttctttccgtcaggaagttcctgaggaggaatacacaatcgagcttggcaaagctgatgtgaaacgcgaaggtactgacctttctatcatcacatacggcgcgatggttcatgagtcgcttaaggctgctgaagagcttgaaaaagaaggcgtttctgctgaagttatcgaccttcgcactgtaagcccgcttgatattgatacgattattgcttctgttgaaaaaacaggccgcgcaattgtcgtgcaggaagctcaaaaacaagccggcatcgctgccaacgttgtagctgaaatcaatgaccgcgcgattctgagcctggaagctccggttctgcgtgttgcggcgcctgatacagtatttcctttctcgcttgctgagagcgtatggcttccaaaccataaagacgttcttgaaactgcgaaaaaagttcttgaattttaatcaggcatcataaaagacggtaaagagagtccttttctcttatgatgaaggagtctgtttactaggttcaatgcttgcgtatgcataactaaaatttgcttaatcaactaggaggtcgaaaactgtggcatttgaatttaaacttccggatatcggggaaggtatccacgaaggcgaaatcgtaaaatggtttgttaagccgaacgacgaggtagaagaagacgatgttctggctgaagtgcaaaatgataaagcagtggtagaaattccttcacctgttaaaggaaaagtattagaattaaaagttgaagagggaacagttgcaactgttggacaaacgattattacgtttgacgcacctggttacgaagatcttcaattcaaaggaagccatgattcaggagaggcgaaaactgaggctcaagttcagtcgtctgctgaagcagggcaggatatctctaaagaagagactcctaaagagcctgcaaaagaaaccggcgcaggacagcaggaccaagtggaagctgatccgaacaaacgcgtgatcgcgatgccttccgtacgcaaatatgcccgtgaaaaaggcgtggatatccgtaaagtaacaggttcaggcaataacggacgtgttgtaaaagaagatatcgacagctttgcaaatggaggagcggctcaagaagcggcaccgcaagaaacagctgcacctcaggaaacagttaaacctgcagcggctcaggctcctgaaggcgaattccctgaaacacgcgaaaaaatgagcggtatccgtaaagcgatcgcgaaagcaatggtgaactctaagcatactgcaccgcacgtaactcttatggatgaagttgacgtaacaaatcttgttgctcaccgcaaacagttcaaacaagttgctgctgatcaaggcatcaagctgacttatctgccttacgtcgtcaaagcattaacatccgctttgaaaaaattccctgttttaaacacatcgattgatgataaaacagatgaagtgatccaaaaacattacttcaacatcggaattgcagcggataccgaaaaaggcctgcttgtgccggtagtgaaaaatgccgaccgtaaagccgttttcgaaatctctgatgaaatcaacagccttgctacaaaagcgcgtgaaggcaagcttgcacctgcggaaatgaaaggcgcttcttgcacgatcacaaatatcggttctgccggaggccaatggttcacaccggttatcaaccacccagaggttgcgattctcggtatcggccgtattgctgaaaaagcgatcgtccgtgacggtgaaattgtagctgctcctgtcttagctctttctctcagctttgaccaccgtatgattgacggagcaactgcacaaaatgcgttaaaccacatcaagcgtttactgaacgatccacaacttattttaatggaggcgtaatgttatggtagtaggagatttccctattgaaacagatactcttgtgattggtgcgggacccggcggctatgtagctgccatccgcgctgctcagcttggacaaaaagtaacagtcgttgaaaaagcaacgcttggaggcgtttgtctgaacgtcggctgtattccttcaaaagcgctcatcaatgcaggccatcgttacgagaatgcaaaacattcagatgacatgggaatcactgctgagaacgtaacggttgactttacaaaagtccaagaatggaaagcttctgttgtaaataagcttaccggcggtgttgcaggtcttttaaaaggaaataaagtggacgttgtaaaaggggaagcttatttcgtagacagcaactctgtccgcgtaatggatgagaactctgcgcaaacatacacatttaaaaacgcaatcattgctaccggttctcgccctatcgaattgccaaacttcaaatatagcgaacgcgttctgaactctacaggcgcacttgcgcttaaagaaattccgaaaaagcttgttgttatcggcggcggttatatcggtactgagcttggaacagcgtatgcgaacttcggaactgaattggttattttagaaggcggagatgaaattcttcctggcttcgaaaaacaaatgagttcccttgttacccgcagactgaagaaaaaaggcaacgttgaaatccatacaagcgccatggctaaaggcgttgaggaaagacctgacggcgtaacagttacattcgaagtaaaaggcgaagaaaaaacggttgatgctgattacgtattaatcactgtcggacgccgtccgaacactgatgagctcggccttgagcaagtcggtatcgaaatgactgaccgcggtgtcattaaaacagacaagcagtgccgcacaaacgtaccgaacatttacgcaatcggtgacatcattgacggacctccattggctcacaaagcgtcttacgaaggtaaaatcgctgcggaagctatttcaggagagccggctgaaatcgattacctcggtattccggcggttgtattctctgagcctgaactggcttctgtcggttacactgaagcacaggcgaaagaagaaggcattgaagtcgttgcagctaagttcccgtttgcagcaaacggacgtgcgctgtctcttaacgaaactgacggcttcatgaagctgatcacccgtaaagaagacggtcttgtaatcggtgcgcaaattgccggcgcaagcgcttctgacatgatttctgaattgagcctggcgatcgaaggcgggatgactgctgaagatatcgcaatgacaattcacgctcacccgacattgggcgaaatcactatggaagctgccgaagtagcaatcggaagcccgatccacatcgtaaaataatgatgtaacaaagaaacagcccccgtttgtaaaagcgggggctgtttttattgtgcaagcacatgctgcataggtttgatgatatcctcttttttctttacggatccctcaatcttcatgaccacatgccgatgattgatcaccatcagcgcagggaacgtgttgatttcctcttcccatccctttctgttgtcataaaccttcatttgatcgacatgatggggatatttcttttctaaatcaagaatcgcatcgtaataaggaacttctttatctatatgattttcatcggaaaaaaacaagatttgagtgtgatgaatgctgtcgatccggttatttttgaatggaatgacagtagaaaccgaacagcttgacagaacgaacagcatcaaaaaaaagggaatcaccgtacggtagcgcatctatcttactcctctgttttatataatatattggttcatccatttataaggactatatcaagtgtatcacgagaggtgaaaaacctaaggcttgttactgaattgttatataattgaaaccgtttttaatgaagaaataatacgtgtgacaacttgcacagccgatgtgtaaaaaaggcacattgtttttcgtgagagcgctgttttttcgttatactgggggcaaaaccatatcaggagggattgtcatgtataaagccgctgcagccgtcatatgtatgtgcttactcgccggctgccaatcaaatgaaaagatgcaaacaaacaaaccctattctcaagccgcggccaatcatgccaaacgggaaaaccatcataaaaaagagaaaaaacagaaggcggagccccgttactatatcaatccgaaaaccttttctgtggaaaaaatggatgaacagaaagaaaaaaaaccgatcgcattggtaacgatcgatgacgcgcctgatcagcatgccgctgagattgcggacaaactgcatgatcttaatgcgtcagcgatcttttttgtaaacggacattttttgaaaaaagatgaaaataagaaagcgcttaagcatattcatgagttaggctttatgatcggaaatcatacaatgactcatcaaaacttaaaagatctttccgaacaaaaacaacgggaagaaatcattggcgtcaataaagcggttgaaaaggtaataggagagaaacccgcatttttcagggcgcctttcggaagcaatacggactacagtgacagacttataaaaaaagaaggaatggtgaaaatgaactggaccttcgggtatgattgggatcagaaatatcaatccaaaaaagcgcttaccgatatcaccctgagcagtccttacctgcgggacggcgccaacatattgatgcatgaccggaaatggacggctgaagccatgccggacattgtaaaaggattgcgtcataaaggatataccgtgattgaccctcgagctataaaaagaccgtaaaaaataaatgtgttatacaatttatcagttgacatattaaatgtgacataataatataataacaacaagtgaaaattaagcgttttcaaattctgagaaatggggaatgacagatgggtacaattgtttgccaagactgtaacgaagcgattcattactttgaggatgagaaggtcacgacgttatacggaacatgctgcggacaatgccagtgtcatcttgaagaagagtaaaaagcgtaaaaaggcccgaaacgatttcgtttcgggcttatttatgtttattggatggctttttgctctttgatgactctgatcatttcaagcgttgcatcttcgggaccctgcacaggaaggccggcgtccaagtttttaaaaatgtagctgatattttcttcagtaatgatctcacccggaataaagatcggaattcccggcgggtacaccatgacaaactctgcaatgatccgtcccgcggattctgttaacggaatgacttccgtatttgcgtaaaaagcgtctcttggcgtcatcgctaacagaggaatctcaggaagcagaacttccgcttgctgatgagcatagtcatttgcagaagcctgctttgaaatgtctgtaagcgcgcttacaagacggtcggcatctcctgctctgtctccgggggtgaaaatacataaaatattatacaaatcggacagctcgacttcgatattaaatgattcgcggagccatttttcaacgtcatgacccgtcaggccgaggtttttgaccgaaatgattaatttagtcggatcataactgaaggcagcttttgacccagtgatttcttcgccgacacagcggatgccttcaatttgattgaggcgttcccgtgtctgatccgccagcagaatcgtttcttcaagaagatcgcggccttctgtagcgaggcgttttcttgcgacatccagtgaagcgagaagcagataggatgttgacgttgtcgtcagcatgcttaaaatcgactgtactctttctttggaaacaaggccttctctcacatttaaaatggagctctgcgtcagggagcctcccaatttgtgcacgcttgtggctgccatatcagcgcccgcctgcatggcggacagaggaagcttatcatgaaaatgaatatgcacgccgtgcgcttcatcgacaagaacaggcacatcgaaagaatgcgcgagctttacaatgctgctcaagtcagctgccacaccgaagtatgtcggattgatgacaagcaggccttttgcgtcagggtgttccgtcaaagcccgctcggcggactcaagcgtaatgccgtgagaaattccgagctcatcgtcaatttccgggtgtataaaaatcggcaccgctccggaaaatacaatggccgacataatggatttatgaacgtttctcggaatgatgattttatctccgggtccgcatacggccatgaccatcgtcataatggcgccgctcgtcccttgtacggaaaagaaggtatggtctgcgccgaatgcttccgcggccagatcctgggcttctttaatgatgccctttggcgcatgtaaatcatccagaggttcgatattaattaaatctatgcttaacgcgttttctccgataaattgtctgaattccgggtccattcccgcgccttttttatggcccggaatgtggaattggacaggctgtctgtccgcgtgctttttcagtccgctgtacaggggtgtttcatgttgcggcaattgttttcccacctttatcataatacctacggattagtttgtattacattcagttttattacccgttttttaaacgtaaaacaaatgaattatattatgaacttgaaagaaagtaaagaacaatttatgatctatggaagatgcttattttgagcatgatgataaaggagtgaagacatttggaatatcaatatccgatgaatgaggactggacgacagaggaggccgtggacgtcattgctttttttcagcaggtggaacacgcctatgaaaaaggagctgaccgagacagacttctgaatgcgtaccgccgctttaaagaaatcgttcccgggaaagcggaagaaaagaaaatctgcagccaatttgaagctgacagcacctattccccgtatcggactgtgaaacaggcgaaacaatcagatcaagcgattatcaaaatgtagacaaaagcgagccggcaatcggcccgctttttatgttatgagactttctgagtcattgtgtataaaaaggaaagcttcctaaaagcatcttcaatggtttgcaggaattcattgttgttcatgttgatcacgtcttctttttgcagctgaatgccgcataaaagctctgcttttttcactgtctgcaggcgttcaaataatgttttcagctgctcctgatccatgtcggactgcttgtacgcacctggcttcgtatgatccggcgaccatacaaaatgaccgggaatctgttttgtgatttcctcctgcttcgcttccagcaatctgccgtattcctcttttatcggagattcataaatgatggcaaaccatacaaacatatgggtgtcccataaaccgatctgaaagtgagggagtttcttatagccgcgtttgctgttggcaaaggcaacccagctgtcagccggcgggttgacagatcttctcgcgtgcttggcgacatgcgggaacatttcatctcctgtcaatgctgacaatgtcggtgcgaaatgctctcctaacaaggtcagcttcggacggacttgttcttttaacacctccatgcgcgggtctaaaccttctattgtaaatgtatcgaagtcttcttttgtaaaacgcatctgagtcatctttttcctccttatcgtaagtattcatattttaccacagccgccgccggccgcaaaaacattgagaacgtttgagacgagaggattggtggtaaaaaacgaataggtaaacacacaattttaagaatgttgttacagccgaatataagtttccatacgatataagaagtatcattaataaattggaaaaatgggatgcttttttaacaaatgatctctggaaggggcgaaagacaatgaggcaagtggtgaaggaaggattcagggaggaaaaaaataaccgtgtagctgtctggagactagaggttgattatgaattggcaaccctgtacgaggccatgcaaaaagagaatgaagatcaaatcgatctcagcaaaagaaaactggaacgtctcagaaaagaatggattcggcttaacggataaagaatagtaaaaacgaaccgcaggaaatggttcgtttttacgtgagaaggcatttttttcattttccttgctttttcatcgcctttatcagtatgctatagaataagctatacatagaaaagaggtacacggtatgacaaattggacggaaattgatgatatcgcaaaacaatgggtaaaagaagccggaacgagaatcagacaatccatgcaggaaagcttgacgattgaaacaaaatcaaatccgaatgatttagtcacaaatattgataaagagacggagcgctttttcattgaccgtatacaaggaacttttcccggacaccggattctcggagaagaagggcagggggataaactccgctcccttgacggaatcgtctggatcattgatccgattgacgggacgatgaattttgtccatcaaaagcggcatttcgcgatctccatcggcatctttgaagacggaaaaggcaaaatcggcttaatttatgatgtgatgcaggacgaactgtatcacgcattcagcggaaaaggggcttatctgaacgatgcgccgcttgctcctttaaaagaagcttccattgaagaagccattattgcaatcaatgccacatgggtgacggaaaacagaaggattgacccgagtattttggcgccgctcgtaaaacgggtcagaggaacgcgttcctacggttcggcggcacttgagctggccagtgttgcggccggccgcattgacgcatatattacgatgaggctcgcgccgtgggattacgctgccggctgcgtgctgctgaacgaagtcgggggcatttacacgaccacagacggcgaaccgttcacgtttttagacaaccacagcgtgcttgcgggcaatccggctatacataaaattatctttgacgactatttacatgctgacaggtagagattttgaagaagaagatctcgggtttctggagcagctggcggcatcgcacccggtgtggaaaaaggaagagttcggaacaaaaaatgcggcggagtttatgcttgcatactccatgtacaatggaacgtggctcgtatgggagattgacggcgctcctgccgccgtcagttttcatttggaatgggccccttcaaacggaaaaccgtggctcggaaccgtggccgtcgctccggaggcaaaagagaaaggaatcggacgcgcggtcattgaagagattgcgggccggctgagaggagagcataaagcgatgttttcagccgttcccctggacaggcaggaatgggttttgtttttaagtcaatgcggctttgaacagcttaagcttgaaaaagacgatcgggaaaagacatatatgatcatggtgaagccattgtgaaatgtttcagatataaaaaagagaccggatttctccggtctcttttcttgtttacaagccgaccgcattccaggccgcttctacgcttgcagcgtcttgagagccgtaaaggtcccgcgctgattgaatcaaagctgcttttgcatctttaaagcttgatgacggagtgagatataccgtcagtgcgcgatagtaaatctgctccgcttttttcacgccgatttttgtaatcgtgttgtaagcggctttgttcggaattccgctgtttgtatgcacgccgccgtagtcgccggcatcagtgttcggaaggttttgataatttttgtaatggtcgggctgtccgtattttgtcggattggataagctgcggagagccggctggctgaccgtaatatcctcaccgatatcccagtcctcagtatcggtgaagtacccgaatacatcggagaaggattcgtttaaagcgcccggctgattttcatagttcaggttggccgtttcctgtgtaacgccgtgtgtcatttcatgagccgtgacgtccattgaaccggaaagaggcgagaagaatgaaccgtcaccgtctccgtaaatcatttggtcgccgatccaggccgcgttattgtatttgctgccgtaatgaacggaagatacgattttgccgcctctattgtcgtagctgttgcgtttaaacgtctgatagaaataatcatacactttgccgagattgtaatgcgcatcaacggcagcgcgctgagaagaagttgtgaactggtttgtagtgcttgatacgagtgtgcccggcaggttatattgtcggttttgcagatcgtacgtaataatttgtgttccggtaggcttcgaaagatcgcgcattacatatttgccgttttcagaagaaatatttaatgagaccgtttttcctttaagagtcgtacctgttccggttgcagcggcatgctccactttgttttgctttttcaggactttccctgtttccgcatcaacggttacttcccagttagctggttccggttcgatgtagcggatggttacatcataggcgaggcggtatttaccgtcttttgtggccgctgctttcagctcggctttgtttttgtttgcaacgttgccgttagagacggcttcaggtgatttgccgattgctttaaaagcatgatccagcgcctgatttgcagataattttttgctgtttgccgttttggcagaagcatcgttgtttaattcgccgttaatcgcatagacattgttggatttatcgacgtgaataatgacttgcgagtccttcacaggcacaccgttaacgacaggcacataacggaagtgcttgtagccgagatcatcggtcgtgtggtcaatcagcttcagtctctcagaagggttgcctttgaagactttgccgttttgtttcaagtattgcttgattgctttgtcactgactgaaggcaattcagattgcaccaaagaatgcttcggcacaaagttcgtcaggttttctttaagctgaggattctcagcggcctgaacacccggaagactgatggttaaactcataaaggaagcggcgacagcaacagacaatttcttacctaaacccacaataaatccccctttttgaaaataatgaaaacttatattgttataataaaccagcattctctcattctgcaatataaaactagactccgctgatgaattgatagaatcgtcccgtaaaggcttccggcgggcagcgtcaggggataagccgagaggcacgtgttgaatcagacatgagtcgaatgatgcgatttattctgaaaaaaatgacaaatgaagtcgggaaaaatgatagaggaaaaatgttccgatctgtaaaactttttttatagccgtttgtctaaacaggtgaggccttaataaacgaaaaggattgtttcagatgtcagagattttcagtcattttattcagcatttcgacagatatttcaagagctgtcttacgaagagattgctgatgttttggactggagtctttcgaaggtgaagagcaccctgtacagggcgagaatgcagctgaaacagcacttggcggaaaaaaggaaggacggacagatatgatttgctgtttagtgagagatttactccctttatatattgaaggcgattgtgaaacagaaacggagcggtttatttcccgccaccttgaatcatgcggtaagtgcgaaagtttatatcatatgatgaaggagccgcttgacctcggcagccctgagatgaaggcgccagcctgttatgcagaagaagaaaggcggtttaaggaacggtattacgggaagctgctgataaaagcagccggtttgttcggggctgttttctttatcatgctgatccttaaactgctgatttaaaaaaacgcccggctgaatgaccgggcgttttatccgtttactcagccggatgaaaggctgtataaataccttcaagcaattcttggggcagtgaattaaagaatccggcacacagctttgcttctttttttcctgctcctgctttttcagcaaggtcctgatcaaacgtatacacaccgtcttcttcaatcagcgcagattgaaggatatgaagactttgggaaaaagcggtgaacagctgatcaacgataagagcttctttttccgtaaagccgagctccacagctttttctttattaaatgtatattcgccgtccgttttctcaatacattgggaaaggacggttaaaaattccgttgagctgtcccacagcttttgaatggtctgtgcggtttctttatctaatcccaattcaaccgcttttttactgtcaaaataatagatgccgtcttttttgtaaatcgattggccgatgatgtcaatgagttttgccgcgtcttccggtgttttctctgcggaagcctgcagggcatgtggttcatttgcctggatcgtttttgcgccggcagaatcaagcggactgaatgcaagcaaggcggctgaggcggttgcggcggcagttacagcggttttcttcaaaaaagatgttttcatttcattctctccttgtcatgtgtatttgcttacagtcacaagtataaaaagacaatgatggaattgatataggaggtatggtattttctgcataacgatgccggactatttcagactgtatattctgagggaatctgctgatgtaactagaatgggggccgtcattcccggcttcctgactagacggcgggggagataagccttacatctggagtctgtttttgaggaggtaaaaaagcctgaatctttgattcaggcttcataagatattgtctttccatgtttacggaattttgcaaagggtcatgcttttaatcaagcagtccctgttcgcgcatttttttctttacggtgaaaccgcttcccatcatggcgataacgagaacaatgcttccgatgataccccatgcgcttttctcagcgattgatacgccgatcagcatcatgctgaagactgctgcgaatgcaaataataataagagccaattcaattttttcatatttccatcccctttaacgtcatactttcagtttacagaaaaacgtaacgcttttaaagaggatgtgtggtataatatgaaagttatctaatttttttaggagatgaaaatgtgaaacttcgaaacgatcttcgcaacatcgcgattattgcccacgttgaccatgggaaaacgactttggtagaccaattgcttcaccaagccggaacattccgtgccaacgaaaatattgccgaacgcgcaatggattcaaacgatcttgaacgtgaacgcggtattacaattcttgcgaaaaatactgcgattaactataaagatacacgcattaatattttggacactccgggacacgccgacttcggcggagaggtagaacggattatgaaaatggttgacggcgttctgttagtcgttgacgcatatgaaggctgcatgccgcaaacccgtttcgtactgaaaaaagcccttgagcagaacttaaatccggttgtcgtcgtaaacaaaatcgaccgtgatttcgcccgcccggaagaagtcattgatgaagtgcttgatttgttcatcgagcttgacgcaaacgaagaacagcttgagttccctgtcgtctacgcttctgcgattaacggaacggcaagtctggatccgaaaaagcaggacgaaaacatggaatcactgtatgaaacgattcttgaacatgtccctgccccggtagataacgccgaagagcctcttcaattccaagtggcgctgcttgattacaatgattatgtcggccgtatcggtatcggacgcgttttccgcggcacgatgaaagtgggtcagcaggtttcattgatgaaacttgacggaacggttaaatcattccgtgtaacgaaaatcttcggtttccaaggattgaaacgcgtggaaattgaagaagcgagagcgggagaccttgttgccgtttcgggcatggaagacatcaacgtcggtgaaacggtttgtccggctgaccaccatgagccgctgccggttctgcgcattgatgagcctacgcttcaaatgacatttgtcgtaaacaacagcccgtttgcaggccgtgaaggcaaatatgtcacagcccgcaaaattgaagagcgtctgaatgcgcagcttcaaactgacgtcagtcttcgtgtcgaaccgactgcatcaccagacgcatgggttgtttcaggacgcggtgagcttcacctgtccattttaattgaaaacatgcgccgtgaaggctatgagcttcaagtgtctaaacctgaagttatcattaaggaaattgacggcgtcagctgcgagcctgttgagcgcgtgcagattgacgtgcctgaagagcatactggttctgttatggaatcaatgggtgcgagaaaaggcgaaatgcttgatatgattaataacggaaacggccaggtccgcctgatctttaccgtaccttcacgcggactcatcggctattctactgagtttctgtcactgacacgcggtttcggtatcctgaaccacacgtttgacagctatcagccgatgcaaaaaggccaagtcggaggccgacgtcagggtgtgctcgtttccatggaaaacggaaaagcgacatcttacggaattcaaggtattgaagaccgcggcgtcatcttcgttgagcccggaacagaagtgtatgaaggcatgattgtcggcgaacataaccgtgacaatgaccttgttgtcaatgtcagcaaaatgaaacagcagacaaacgtacgttccgctacgaaggatcaaacgactacgattaagaaagcgcgcattatgtcgcttgaagaatcactcgagtacttaaacgaggatgaatactgcgaagtaacgccggaatccatccgtttaagaaagaaaatcctgaataaaaacgaacgtgaaaaagcggcgaaaaagaaaaaaacagcaggaatgtcttaatcacttgcagaatttgaaaaggtagaacccgaacggaaaaggggagggggatctttttgaatgaagtaagtgaacggctgtcgttctttgcggctctttaccaagtggatgagcatccgctggcgggaatgtggctgttatacggaacgatcgtcgtgctttcggtgattgtatttaaactcggctttgccaaacggctgccggttttgaaggctgcggcagtttatctctttctcgtgctcggctgcaccgtgctgacttttttcggtgtgtttttgccggtcggagaagggcttgttgttgccgccttgattttgatcatttacaaaatccgtctgcaccagtccaaaaaaagccagtcagctaaaccgcaataaaaaatgaccttgccttccggcgggtcattttttattctgtttattttttcagtttatcttttttcgctttttgtccaggatgaaaggaaaagtgtccggtattcagccgcgcctccgttttgattttgattcggtcatggcattcccggcacatatatgtatgaatcggacgattgcggaggcgtttggctgtcagtgtttcatcatcaatttgttcgattttgtcgcaaatggaacattttactctcattgattttcacctctttcactatgacaagcattatatcatggatgcccctcctgccaaagggaaagaaagcagcgcccttcttttggagcgggcgctgctttttactggcggtttttcatatgatgatccgattgatcgttctgttcgttctgcagcttgttctggtctctttggttcagctgatcatcattcgattgagtcggtgattctttttcattgtcggtcacatcattcgggacttccggcatgacacgaccgacgatggcggcaagttcgtccaaaatgcctgaaacggggcggccggctttaatgtcgctgcccatgcctctcagacgggaaaccgtatcaggatcagccacgacaacggcattggcgccgtaaggatcgttttttaacgcctgggcaaccgtgtatttaatgctctccaccttgcttctttctaaattgtcatccacatcgattccgacaacggagtatcttccgagtactaccgcggtggcatctgaaatgccggggattttttcggttacctcgacgagatgcttagcgatgtctgtccggccgggattttcagctgtctcaggagccgtattttttacatgaatcggttttgcatcacgctgatcggttgattcgttctgaatattgcggccgcggccgtcctgtacagcagtgcagccggtcaggataaacaaggcttgtatgataatgaaaagaattcgcacgtcagattccctccttgaatgctttcatttattttattgttgaattaaccttctatctttattcaccaaatcatatattttagcaggcatccccgtttttcgcggaaagagaagcacacgatgggctttgatccttatttcaggaggctgagacttgagtaaaatttatgtgttagatacgaatgtacttttgcaggatcctaacgccattttttcctttgaagaaaacgaagttgtcatccccgccgtcgtgctggaagaggtcgattcaaaaaagcggtatatggacgaggtcgggagaaatgcgaggcacgtatctaagctgatagacgggctcagggagaaaggaaggctgcacgagaaagttccgcttgaaaacggaggaacgctcagaattgaactgaaccaccggtcatttcatcagctccaagaaatttttatcgaaaaaacgaatgataaccgcattttggcggtggcaaaaaatttaagccttgaggaggaaacgaaagaaaacggccgcctcgtcatcctggtcagcaaagatgtgcttgtcagggtaaaggcggatgccatcgggcttttggcggaggactttttaaacgacagagtcgttgaccatgatgaaatatatagcgggtacaaagatatatttatgaataaagagcggtttgcctcgttttataaaaacaaacaaattccagtcaaggagcttcagcagcatcaggtttatccgaatcaatttgtgctgatgaaagatgaattaggaggatcttcgtctgcggtcggcatggcggataagaaaggagagaccgtaaaaagactcgttttcgatgatgagcacgtatggggtatcaggccgaagaacgtccagcagacaatggcgctcgaactcctgctgagggaagatatcccgcttgtcaccctgatcggaaaagcgggaacgggaaaaaccttgcttgctctcgcggcagggcttctgcagacggaggatctcggtatttataaaaagctgatcgtcgcgcgtcccatcgtcccggtgggaaaggatatcggatatttgccgggcgaaaaagaggaaaagctcaagccgtggatgcagccgatctttgataatcttgaatttttattcaatgcgaaaaagccgggtgaacttgaagcgattttggcaggaatcggatcgattcaggtggaggcgctgacatacattcggggaagaagcattccggatcagtttattattattgatgaggctcagaatctgacgaggcacgaggtcaaaacgcttttgacaagggtgggagagggcagcaaaattgtcctgatgggcgatccggagcaaatagatcacccatacttagacagtttaaacaacggacttgcttatgttgtagagcggtttaaaggacaaaccgtctccggcagcgtgaagcttgtgaaaggtgagagatccggccttgcacagcttgccgccgatttgttataaaacttcgatttctgtgacgcccgttatcggtttttcaaagtctccgtccacgtaaaaatggaccgggccgccgtcttgaagcggtttccccgcatcgctgaaatgcgcgattgcgtccatcgccttttcaagcggcacttcgattctttctgattttgaaataaatgcgcacaggacagcgctttctttcggctcggcatttgctaaaacagcgccgagcttcatggcgaagctgccgttcatcagtctttctttttcataacgtttttcgctttttaaagtcggcggcgaaatgcgcccttctctgatcacccgttccggatcaagtgtatgctcctgggtttctgcagagccgtccggatgaacgggctgattgttttcaaacggaaacttgcggtcatcgaaaatccagacactcggatcaattgtaatcgggtatgtaacattgccttttacttgaataacgctcatgttgaagcccccctttacttaaagtataaaagttttcgcatgaattgtcactttgcgtcgcaaacttagatgtatacaacggcagcgaagtgaggatgatcgacatggtatgccggcattaccaagagctggacgcattagttcaggaagcgaaaaaaaggaccgaagaaggcaaagtggcagactatattccggctcttgctgaatccgaacaagacagcctttcggtcacgatttatcatgcggaaaatacatgtctgacggcaggagacgccgaccggacatttacgctgcagagcatttcgaaagtgctttctctggcgctcgtactgatggattacggaaaggaaaaggtgttcagctgcgtgggtcaggagccgaccggcgacccgtttaattccatgattaagcttgaaacagtgaatccgggcaagcctttaaatccgatgattaatgcgggagctctcatcgttacgggtttaattaaagggcattcgccgaaagaccgcctggattacctgctcggattcatcagaagacttgcgaacaatcaggacattacatattgcagacatgtcgcggaatcggaattcaaatcttccatgattaatcgggccatgtgttattacatgaagcagtatgacatttttaaaggcgatgttgaagaggtcatggatttgtatacaaaacagtgcgcgattaagatgagcagtctggatttagccaaaatcggctgtgtattcgcccttgacgggaagcatccggaaaccggggagcaggtcattaaaaaagatgtggcgagaatctgcaagacgtttatggtgacatgcggcatgtacaatgcgagcggggaattcgcaataaaggtcggcattcccgctaaaagcggcgtttcgggaggaatcatgggcatttcgccgtacaacttcggaatcggtatattcggcccggcgcttgatgaaaaaggcaacagcatcgcgggtgtgaagcttttggaaatcatgtctgagaaatacaggctgagtattttttgaaacattttttatcataacatctgcttaaatcctcttgcaatttcatctgataccctttatgataaatagaagaattaggtactcgcctggggaacggagggatacttttggcttcagagattatagttgaccatcagcagaaagcattcgagctgttgaagttagatgctgagaagattttgaagctgatccgagtacaaatggataacttaacgatgcctcaatgtcctctgtatgaagaggtcttggatactcagatgttcggactgtcgagggaaatcgattttgctgtccgcctgggattagttgacgaaaacgacggcaaagagctgctggacagacttgaaagagaactgtctgctttgcatgacgcgtttacaggaaaataaatgatcaaactcaaactattcaacggtttgggtttttttataaccgtaaaccgttttttttgcatcttcttttcgtaagacggtctcttaatctgcatttcatccgaaaaactataaagaaactgcgtaaattgtttatgaattatagtaaaatataatacgcaataggtattaaacgtaagctttaagcaggaaagaggatgttatgtttaaaagaatgttaaaatcttacgattattcattgatatgcgctatcattctgctgtgcagtttcgggttggtaatggtatacagctcaagcatgattaccgccgttatgcgttacggcgtgagcagcgactatttctttaaacggcagctgttcgccgtcatcgcggggtttgtgctgtttattatcgcggccgtttttccgtacaaagtgttcgcccatcaaaagattcagaaaatcatactgcttgcgtcagtggctgcgctttgcgcgctgtttgttttcggacatgttgccggaaatgcgcaaagctggtttaaaatcggcggaatggccattcagccgggggaatttgtcaagctgaccctgatactgtatcttgccgcagtgtacgcaaagaaacaaagctacatcgatcagcttttgacgggggttgcgccgccggtgatcgtcaccgtagtcatttgtgcgcttatcgctattcagcccgacttcggaacggcgatgattatcggtctgatcgcgttttgcgtcattatgtgttcgggattcagcggaaggaccctgctcaggctggttctcatggcgggaatcgtattactccttgtcagcccgatcatctatctgaaatgggacgatattttgacacccgggcgtatgagccggtttgaaagccttgaaaatccatttaaatacgccagcacatcaggcctgcagattataaattcgtattatgcaatcggctcaggcggttttttcggtctcggtcttggagaaagcattcaaaaatacggttatctgcctgaatcgcatacagactttattatggcggttatttcagaggagctcggcattttcggcgtcctgtttgtcattgtgctgctggcttttgtcgtgttaaaaggtttttatattgcgagaaaatgtgaagatccgttcggaagccttttggcaatcgggatatccagcatgattgcgattcagacctttatcaatctcggcggtgtcagcggtttaattccgatcacaggtgttccgctgccgtttatcagctacgggggatcatcaatgtttttgttattaacgagcgccggtatattggtgaatgtcagcatgcatgtcaagtactcagaaaagaagaaaaagagggagcccgttccgtctaagggggtaaaaagacggcagacggaaaaatctgtgtatctctaaaaaacaagtgtatacacagggcggatattcctttattataaactacatatttattaggccaagggggagaaaagtttgtcacaacaatccatccaaaaagtgttagtagcaaacaggggagaaattgcgatccggattttccgggcgtgcacagaattgaacatcagaacggtagccgtttattcaaaagaagattcgggctcctatcatcgctataaagcggatgaagcttatcttgtaggggaaggcaaaaaaccgattgacgcgtatcttgatattgaagggattattgagatcgcaaaaagaaacggcgttgatgccattcatccgggctacggatttctctctgaaaatatccaatttgcgagacgctgtgaagaagagggcatcgtatttatcggaccgacgtcagcgcatttggatatgttcggagataaggtaaaggcgagggagcaggcggaaaaagccggtatccccgttattccggggagtgacggaccggctgaaacaataaaagatgtcgaacaattcgcaaaagtccacggatttccgtttattattaaagcatcgctcggaggcggaggccgcggaatgagaatcgtccgaagcgaaagcgaattgaaagaatcgtttgagcgggccaaatcagaagcgaaagccgcattcggaaacgatgaagtgtatgttgaaaaactgatcgaaaatcctaagcatattgaagttcaggtgatcggagataaagaaggcaatgtcgtccatctgtatgagcgggactgttccgttcagagacgccatcaaaaggtcattgaggtggcgccgagtgtatctttgcagcctgaattaagggacgaaatctgtgaagcggctgtggcgcttgcgaaaaatgtcggctatatcaatgcggggaccgtggaatttctcgtagcgggcggtgaattttactttattgaagtgaacccgcgcgtacaagtggagcatacgattacggaaatgataacgggggttgatatcgttcagacgcagattctcgttgcgcagggccacggactgcacagccgtgccgtcaatatcccagagcagaaagacatttttacaaacgggtatgcgatacaatcacgtgtgaccactgaagatccgctgaatgactttatgcctgacacgggtaaaattatggcttaccgctcaggcggcggtttcggcgtccgccttgatacgggaaacagcttccagggcgccgtcatcacgccttattatgattcactgctcgtcaagctgtcgacatgggcgctgacgtttgaacaggcatcagcgaaaatggtccgcaacctgcaggaattcaggatcagaggcattaagaccaatattccgtttcttgaaaacgtggcaaagcatgaaaaatttctgacgggccaatacgacacatcgtttatcgacacaacgcctgagctgtttgttttcccaaaacagaaggaccgcggaacaaaaatgctttcctatatcggaaatgtcacggtgaacggttttccgggaatcgggaaaaaagaaaaacctgcatttgataagcctcagaccgttacgttagatatcggggaaaagccggcaagcggtacgaaacagatccttggtgaaagaggcgccgaggggcttgcagactgggtgaaagagcaaaaatccgtgctactgaccgatacaacgttcagggatgcccatcagtccctgctcgcaacacggatcagatccaatgatttgaaaaaaatcgcgaatcctacggctgccctgtggcctgaactgttcagccttgaaatgtggggaggcgcgacatttgatgtagcgtaccgtttcttaaaagaagacccttggaaacgccttgaagatctccgtaaggaagtgccgaacacattgttccagatgctccttcgttcatcaaatgccgtcggttatacaaactatcccgacaatgtcatccaaaaatttgtccggcagtcagcggagtccggtattgacgtattccggatctttgacagcctgaactgggtaaaagggatgacgctggcgatcgatgccgtccgtgaaaccggaaaagtggcggaggctgcgatttgttacacgggagatattcttgataagacccggacgaaatatgatttgcaatattatctttctatggcgaaagagcttgaggcgtctggtgcgcacattctcggcattaaagacatggccggtcttttgaaacctcaagccgcatacgaacttgtctcagcgctgaaggaaacgattgatattcccgttcatcttcacacgcatgatacgagcggcaatggcgtctttctctatgccaaagctgttgaagcgggtgtggacatcgtggatgtcgccgtcagctcaatggcgggtctgacttcacagccgagcgcaagcggattttatcatgcgcttgaaggaaacagccgccgtcctgaaatggatgtccggcaggtggaaagactgtcacaatattgggaatccgtccgtcagtattacagtgaatttgaaagcgggatgaagtctccgcatactgagatttataatcatgaaatgccgggcggccagtacagcaatctgcagcagcaggcaaaaggagtcggcctgggcgatcgctggaatgaggtgaaagacatgtacagcgtcgtcaaccgcatgttcggcgacgtcgtgaaagtaacaccttcttccaaagtcgtcggagatatggcgctttacatggtgcaaaacaatttaacagaacaagatgtttatgataaaggcgaaacgcttgattttccggattcagtcgttgagctctttaaagggcagatcggccagccgcacggcggatttccggaaaaactgcaaaagctcgttctgaaaggacagacgccgatcacggtaagaccgggggagctgcttgaaccggtatcttttgaaggcattaaagaagaatggaaagaaacgcatcagatggaattgagtgatcaggacgcaatcgcgtatgctctttatccgaaggtgtttactgaatatgttaaaacggctgaacgcttcggtgatatttccgtattggacacaccgactttcttctacggcatgacactcggtgaagaaatcgaagtggaaatcgagcgcggaaaaacgctgatcgtgaagcttgtatctatcggtgaaccgcagccagatgcaacacgtgtcgtttatttcgaattgaacggccagccgcgcgaggtggtcattaaagatgaaagcattaaatcgtccgtgcaggaaaaattaaaagcagatcggacaaacccaagccacattgcggcatctatgccgggaacagtcattaaattgttaacggaaaccggggcaaaggtgaataaaggcgatcatctgatgattaatgaagcgatgaaaatggagacgacggtacaggcgccgttctccgggacgatacagcagattcatgtgaaaaacggtgaaccgattcagacaggcgatttactgatcgaaattgaaaaagcgtaaaaaatgaacataaaaaacctgatccgccccgtgtgcgatcaggttttttatatgtaaaaaggccgaagctctgatgcttcggccttttcgtgtgcctcagatgttccgctgttttgattcatagcggaagcgggcgattaataataagaaatagcataagacgccgaacagaccggcaataaagagcgaatgggcaagtgcaaagccggtggccatttctgaataaacaaccatgattccggagagcgcctgtaatacaacaaaggcaagagccgctatccagcccccaagaatctgtttttggtctttgtaggagcgcaccgcatgcgcaaaagcgacaagaatccatacgaacagaagcagcgctgccgttctgtggcccatctgcacccactcctgaaaatgagacggaaacccgtggttcagcctgctgcaaagcggaacgtcaggacaggcaaggcttgatttcgtatggcggacgtaagcccccgtataaacgacgatatacgtgtaaatcgaaaggccgatcatatgaaactgcattttcctgccgattctgagcggcttgacgagctttttgtctgatttatcagcttcaaatatgagcagcgtcaaaatcagaacagaagcgaaagaaatcagcgatatgccgaaatgaagcgccataacgagcgcatttgatccgaaaacaaccgctaatgcgccgagaagcgcctgtaaaaataaaaagataatggacataatggcgagaaaggttgtttcacggaaaacaggcgtgacttttctccatgcccaaaaagcgagactcagcacgagaacgattgagacaccgcttgcgagtctgtggctccattcaatgatagaagcggcgttaagctccgggaaaaaccggccgtggcaaagcggccactgccttccgcatccgagacccgatcctgtttttgtgacaagagcgccgccgatcagcacgacgagcataacgaacgtcgtcagcacaccgagcgctttcaaagctttattcattttacattcaccttcttaacaaactggacaaaatgatatacgtaccaagtgtaagcgaatatgtgttttgtggcaattctcaattctgtttgttcacaaaaatataatagaatcaggacttcttagataatggggttgattattccagatgggtctgatagaaataaagtaaccgctttattatgaaaccggcggatttggtaaaattcataaaaagttcacaaataaattcctgtttctcgtttaatatttaagaggatgtttttttacaggtcattatcttgtatgatagagttgcaggtcttaaaaaacctgctttaggtttgtaagggaggtttacgttatggctaattccagaattttaaacgatacagctatagacggacagattgaagagacgacggcatggaaggatttcctttcgcttatcaaaataggaatcgtcaattcgaatttaattacgacttttaccggcatgtggcttgcgttacatatatccggtctgagttttttaggcaatttaaacaccgtgcttcttacattaataggatcttctttgatcatcgccggttcttgtgcggttaacaactattacgaccgtgatattgatcatttaatggaacgcacgaaagtaagaccgacggtaaccggaaagattcagccgaatcaagcgctgtggtcaggaattttactcattgctttaggacttatcatgcttttgatgaccaccgtgatggcagcagtcatcggttttatcggcgtgtttacgtacgttgttctttatacaatgtggacgaaacgccgttatacgattaatacggttgtcggaagtgtatcaggcgccgtgccgccgttaatcggctggacagcggttgaagggcacattggtgttgtcgcgtgggttttattcatgattttattcatctggcagattccgcactttttagcgcttgcgattaaaaagacggaagattacagagcagcgaatattccgatgcttccggtagtgcacggctttgaagtgacgaaaagacagattatcgtctgggtcgcatgcctgctgccgcttccgtttttcctcggcagtctcggtcttccgatcgtcattctcggcactttgcttaatgtcggatggcttgttctcggactgatgggattccgcatgaaaaacatcatgaagtgggcaacccttatgtttgtctattcgcttaactacatgaccatttattttgtagcgatggtggtcttcacgctgttttaattgaataatgagcttgtttgatcgccaaaacaaacaatgacaactagtaaacgccgccttgaccttttgtttaatcaggcggctttgcttttatacatagatggaattttaagtaaaaaatctcatattttaagaaatgaggaaatgaagtatttcggctggaagcagatttactgcttgtgcatctcgtactgattcaaaaaaggggttgggtgaaatgttaaagcgttggcgtcttttatcattattagccttagtgccgcttttattgagcggctgtggaaaaccgtttctgtccacactcaagcctgccggcgaagtggctgataaacaatatgatctgacggtgctcagcacacttatcatggttgtcgtcgttgcggtcgtagcagttattttcttttacgtcattgtgagattcagacggtcgcgtataggggaagacacgataccgaaacaggtggaggggaaccgttttttagaaatcacctggaccgttattccgatcctgcttctgattattcttgtcattccggttgtcattgatacattggcactggcggatacgtcgccgatggataagaaaaaccgtaaagcagaggatgcgctcgtgattaatgtaagggcgaatttatactggtgggaattcgagtatcccgattacgggtttgtgacaagtcaggagctgatcgttcccacagatgaacgcgtctatttcaagctgaagtcctcagatgtgaaacactctttctggattccgtcagccgggggaaaaatcgatacgaatacggataatgacaatactttctttctgaccttcgattctaaacgcagcaaagaagcgggagaatatttcttcgggaaatgcgcagagctgtgcgggccttcacatgcgctgatggatttcaaagtgaaaccgctgccgtcaaaagaatttaaacaatggacgaaagcgatgaaaaattataagcatacaacagattccggtttagccgcgcaaggagaagagctgtttaaggaaaaaaactgcctgagctgtcatgcggttgagcccaatgataaacgggctgaagcggcaagaacggctccgaacctcgctaccttcggtgaacgggtcaaagtggccggtattaaggatgcgaataaagagaatataaaagcctggctgaaaaatccggacagcattaaaccgggcaataaaatgacaggcacttatccgaagctctcggacgctgaaacggatgcgctgtatgaatatttaaaagggctgaaagcggagaacaagtgaggacagggagatatcaggggggaggtcgcaaatgatgaatacgcttacaggacagcaaagaaaaagctctttactttgggattatttgacgacggttgaccataagaaaatcgcgattttatatatgatcgccgggggatttttcttcgtcgtcggcggacttgaggccatgcttatcaggattcagctcttgaggccggggaacgattttatgggtgctcagcagtttaatgaaattatgacgatgcacggcacgacaatgatcttcctggcagcgatgccgctgttattcgggctgatgaacgcggttgtgccgcttcagatcggggcgcgtgacgtatcattcccatttctgaatgcgctcggattttggctgtttttcttcggaggcatctttttgaatctgagctggtttttagggggcgctcctgatgcaggctggacgtcgtacgcgtcgcttgcgctgaattcgaaagggcacggcatagactttttcgtgctcggtctgcaaatatcaggcttagggacgctcattgcgggaatcaattttctcgccacaattattaatatgagggcgccgggtttgacgtatatgagactgccgctgtttacgtggacgacatttgtggcgtcggcactcattttattcgcattccctccgctcaccgtcggtttggcgctgatgatgctggatcgtttgttcggaacgaatttctttaatcctgaattgggcggcaatacgataatctgggagcatctgttttggattttcgggcatccggaagtatacattttaattcttcccgcctttgggattttttcagaaatcattcccgtatttgcgaggaaacgtctgttcggttattcgtctatggtctttgcgatcgtgctgatcggctttctcgggttcatggtatgggttcaccacatgtttacgacgggactcggaccgatcgctaatgcgatatttgcggttgcgacgatggcgatcgcggtgcctaccggcattaaaattttcaactggcttttgaccatctggggaggaaacgtcaaattcacgacgcctatgctgtatgccgtcgcctttattccctctttcgtactcggaggagtcacaggtgtcatgctggcggccgcagcggcagattatcagttccacgatacgtattttgtcgtagcgcatttccactacgtcattatcggcggcgttgtgttcggcatcctggcgggcgtgcatttctggtggccgaaaatgttcgggaaggtgcttcatgaaacgatggggaaaatttcgttcgtcttattttttatcgggtttcatcttaccttcttcattcagcattttctcggcttgatgggaatgccgcggcgcgtttacacatatctgcccggccaggggcttgataccggcaacctgatcagttcaatcggcgcgtttttcatggcgggcgcggctgctttactcgtcgtcaatattatttatacctcaataaaggggaaatacgtcgggaacgacccgtggctggacggtcgtacgcttgaatgggcggtctcttcgccgccgccggaatataattttaaacagcttccgtttgtccggggacttgacccgctgtggattgaaaagcaggccggaaatgaagggatggcgcctgcagagcctgtagaggacattcatatgccgaacggctccatcatgccgtttatcatatctttcgggctgtttgtcgcagcgttcgggtttttataccactccgattattcatgggggcttccggttatcttcatagggctcggcatcacattctttaccatgctgcttcgctctgtggtcgatgattacggctatcatattcacaaagaagatctgccgaatgatgataaaggggtgaaggcgtaatgcagctgcaggaaaaaatgacggctgaaacctttccggcttctcctgaaaaagcaacgctggaggggaaaaataagtttttgggattttggctgtttctcggcggcgaaacagttctgttcgcctcgctatttgcgacattccttgctttacgggaatcaaaagccggagggccgtcaacggctgagatgtttgagctgccgatcgtgtttatcgcgacgatgcttcttttgacgagcagcttaacgagtgtgtatgcgatgtatcatatgaaaaatttctcctttaaaaaaatgcaggtgtggcttctggttaccgtattattgggagcgggatttttaggggttgaaatctatgaatttatgcattacactcacgaattcggctttaccattacaagctctgcgctcggctcagcgttttacacgctcgtcggcacacacggagcacacgtggcgttcgggctgttgtggatcagcgcgctcatgatccggaatgcgaaaagagggctcagcctttataatgcgccgaaatattatgtggccagcttatattggcattttatcgatgtcgtgtgggtctttatctttaccgttgtatatttgatggggatggtgggataacgatggacgataacaaaaacagagggactgtcagtacggatctcgaatatcggagaaggaaaaatgccgaggaaatgaaatatcaggtcatatccttcggcttgatgatcggccttacgcttgtcgcgtttttgacggtggctgcagacggcattgccggatggtttacgatgccgtttctgatcctgcttgcggtcattcaggtcatctttcagctgttttactttatgcatatgagccagaaggggcatgaagcgccgtcattatttctgtattcgggaatatttgtcgcgtttatcaccgtgcttgcatttgtcacgattatttggtggtaatcggggcggcggggagtgagagatttgattaatttggaaatgttcgggtttcgcgcaatgtggagcccgtatctgttttgtataactgccgtgataacaggtgtttacttttactggtgcagccggcataaaggacgtgtggccgttaaggagaaggtgctgtttgtgctttccgcgctatttttttacgcggctgcgggaagtccggttgatttattgggccatgtgatgttcagcgcccatatggcgcagatggcggttctgtttttagtcgtaccgccgctgttgatttccggaattcccggctgggcatggaaaaaactgatcttccgtcctgtcgtaaagccgctgttttcgtttttttcaatgccgcttatcgctttagtgctgtttaacggtattttttcgctgtatcacatcccgtttatatttgatttcgtcaaaacagattcgctgtatcacacgctgatgaacggactcatctttgtaacggcgttttttatgtggtggccgcttgtgcataaggtggacggtctgccccgtctcagcggtttaatgaagctggggtatattatggcagacgggattttgttaacgccggcctgcgcgctcattatgttcagcggggcgcccatgtatgccacgtatacagatccggcggcttgggccgaagcaatgaagctttgcgttcctttagatttgctggaggagatccctttatccggaccggagatgtttaacacgctgcctcctctggaagatcagcagcttggggcagtgctgatgaaaatcattcaagaggcggtctacggaatatatttggctgtcatcttttttcagtgggtcagaacggaacgggaaaaagatacgctgtcagagccgccgtatatcgagcataccgtctcataaaaaaaagtacagcagaatatgctgtacttttttattacatttgcactgtttttaatgactcttccaattcaagcagtaaagctttgctttcagcgatgacatgttccggaaattcttcagcgctgccgtattctacgccgtgcggataataatgctttcctaaaagaggggccttcagctgaatcacggcccgtctgccgccgacatcgccctcttttgccgttccttgaatccgcagataaaatgtcccctcaggtactgaaaactttttgtcgtaagtcactctttcataatcccattgtccagccagaatgagccctttaccttccatcagatcattcaagcggctgagctccgctgttaccccttcaagaccgctgttttcaaacttcaaaccttccccctccttttaaaaatgccctttcctgacaatcatagtatgaaagcgttacactttcaatgattcatacggtgaaagtatgcaaaaacaaaaatttgacgacaatagtagcagaaaaaaggaggaattccgcaatgacaaagatcaataagctcatgacgtcagacttgcaatattgtacagtattagataatgtatatgaagctgcggtgaagatgaaagacgcggatgtcggcgccattccgatagtggatgaagacggcgccacacttgtcgggatcgtgacagacagagatctcgtattacggggaattgcttcaaaaaagccgaactctcaaaaaataaccgacgcaatgacagagcgggttatcagtgcagaagaagacgcctctgtggaggaggtgctccatttgatggctgaacatcagctcagaagaattcccgtcacaagggataaaaaactggtcggcattgttacgctcggcgatctttcgttggccgagcaatcaaatgagcaagcaggccgggcgctgtctgacatttctgaagacggaggtccggaggggtttatccattaaacataaatcacggacgatgcaaataggctgtactgtataagagtaaacaataacagaacggtttgatgatatgggggtgagaggttgaaaaatatcgcaagggctctcgttatccttttgcttatttacggagcgtatgttctgtttatacaatatggatcggctcctcagaaaaagaccaatcaggaggagcctcaggtttccaatgaagaagagagcggaaaacggctgaaaatgccgtcatccggactgctttctctcatggggaaatctgccgccgatgtgaaaaagaaacttggggaaccgtcccggaaagatccttctgcctacgattacgagtggtgggtgtacaaccaggggaaagaccaatacgtacaagtcggtattttgaatgataaagccgtgactttatacgcttcgggaagcggcatcaacgcaaaaccgtttaagatcggcgaatcgacgggcgaagtttttaaaacgacgcaggtttctccttttgtcaatgtgactgacaagggaaacacgtatcggtttgagttttccgaagaagatatcaatacccgtcccaccgtcaagataggcggaatgtatgttcagctgtacatggacaaatttgacgggaacttgtcaagcatcagggcttttgatgcggaaacgcttgtgaaacaaaggccgtatgaggtcatgtacagaggaaagctgacagaacccgagccagtttctgataaaaaatggaacgacattgaacgagcgagtgaacagcagattctcgacattacaaatgtcatccgcgtgaaacacggactggcaaggctgaaatgggacgaaggcgccgcgaaagtggcattcggccacagcaaggacatgaaggataacaagtatttctctcacgtctcaaagaaatacgggactctgaaggaccgcttggaaaaaggcgatgtgaaataccgggaggccggtgaaaatattgcctacaactatgtggacggtcctgcagccgtggagggctggctgaacagcgaaggccacaggaaggcgctgttaagcccggattatacgcacctcggtgtcggcgtggaccggaagtattatacgcaaaacttcattaagccttggcagtaaaaaaccgcagaggggcgcgtcccccgcggtttttttatgttttttcgcgagcggcgctcctgctgaaaaaaatatacctgctttttttcgcaatttaggcgaacattaaggcgcatgaaccgatacattatagcaggcaaaacttttcggagggggtgagaattgtggcgaatcagcaatcacggcaatcaatcgatgattttaaacaattcgtaaaaaagcatcccaaactgatccaaaatgttcgcaaggaacaaagaagctggcaggaagtctatgaaaactgggttcttctgggcgaggatgatccgatgtgggacccttttaaagacgaggccgttcagccttcttccgacgcggaaaccaaacaggaaccagctgaaaagaacgatttcgtttcaaaaatggtcactgccgtcaaaaagatggatatcaaccaaatgaatgagcagatcaataaaatgagccagtccatttcatcattgcaaagccttttaagccaattttcggggagcagcacgaagcagccccggcaaggctccggacaacatcctttttcattcagaaaggattaaagaaggggatcgtgtatgcgaaaagaggttcaggaattcatatccgcagatgaggaacggaaacggtttatacggcagcgtcccgtctggtaccgcagacttgcgagaaaaccggacgatctcaattcttttcagcttgacatgatgaatttttatgaaaagacgataccgcatcgggtaagtcaattctcaaacgggattcaaatggcgcagatgatgatgcagatggtacacgccatgcgttcgcaggattaaaaagcgtttaaacgccgcattttccaattgggtggtttcatggtaaactagcaactggaggtgcgtatttatgtatgcaacaattgagtccgtcaagcttcaaagtgaagcggagcagcttgccggcatgattctgcagtctgagacggctgaaaattaccgcgattgttacaagcgtctccgtgaagatgaagaggcagggcggatcattcgttcttttatgagcgttaaagagcagtatgaggatgtgcagcgcttcggcaaataccatcctgattatagagagatttcccgcaaaatgagagaaatgaagcgggagctcgatttaaacgataaggtggccgaatttaaaaaagcggagactgagcttcagtcgctgcttgacgagatcagcattgaactcggaacggccgtctcggagcatgtaaaagtgccgacggggaatccttattttgacggcctgtcatcctgcggcggcggctgcggttccggcggcggctgcggatgcaaagtttcctgacgagacggccgtctcgtcttttacataaaatgaacagaaagtcaggcgggtgatcatgatggaaaataagcgccaaggcataatcgtatatctgcattccttaaaacacagcaaaatgctgagaaaattcggcaacgttcattatgtttccaagcggctgaaatacgttgtgctgtattgcgatatggacctgatcgaaaaaacaatggaaaagatttcttcttattcttatgtgaagaaggtagagccttcttataaaccttttttaaagctggaatttgaatcaaagcttgataaagcgaaagagtacgattataaagtcggcatataaaaaaatccccgcagatacctgcggggtccttctattccttaacaagttaaggagaaggaaaagggagaggagaaaccggaggaagaacttatggggaaacgtaagtcttctccgcggttggcaacaacatcattcattgatgctgttacacgtagtcttgacaggaatgtgaatatgtatacacgtttttcacgttcattgtttgaaagaatgctttatgataagatagggattgtttttatacataacggctcagccgatgagaaacatcaaagttttcagaaaaagtggtgtgaataatgagagtgatttccggttcaagaaaaggacgagccttaaaggcggtgccgggcacatcaacaaggccgacgacggataaagtaaaagagtctatttttaatatgatcggcccgtattttgacggaggaacggggctggatttgtttgcggggagcggcggtctcgggattgaagcgctgtcgcgcggatttgaccgctgtatctttgtggaccgtgatttcaaagccatccaaacggtaaaagcaaatatcaaagcgctcgatctgctggcttcagcggaagtataccgcaatgatgcagagcgggccctctatgccgcggcgaaacgggaaaaaggttttgacggaattttcttagatcctccgtataaggaacaaaagctgaaagcgcttatcgaaatgattgatgagcagaacatgctgaatgaagacggttttgtcgtagccgagcatgataaagccgttgcgcttccggaagccgtcggcgcgctttctgtaacaagaagggaaatctacgggcttacaggagtgacgatataccgaaatagggggtaatgatgtggcaagtatagctgtatgtcccggaagttttgatcccgtcacctacggacatctggatattatcagacggggggcaaacgtgtttgagcatgtgtacgtatgcgtgctcaataattcttctaagcagccgctgtttacagtcgaggaacgctgtgagctgttaagagaagtgacaaaagacattccgaatattacggtcgagacgtcacagggactgttaatcgactatgcgaaaaaaaagcgggcgaaagcgattatcagagggctcagagccgtttctgacttcgaatatgagatgcaggggacttccgtcaaccgcgtgcttgacgaatcaatagaaactttttttatgatgacgaacaatcagtactcttttttaagttcaagcatcgtaaaagaagtcgcaaaatataacgggcctgtttcagagtttgttcctccggaagttgaacaggcgctgaagcagaaatttaaaggatgagaagcgctgatcggcgtctcatcctttttttgtccgtgctgacagcctgtaacaataaatcaatgcgtatacggcgagagctgtcagcgtgatggcgggcccggtttcaacaagtgtattccatccgctgacggcagctgatcccgcgtcctgatcgcggaaagggaggaatacggactggtaaggttcgtccaatgcaaggtaaagcggcttccacagtaagagaataaagagtgcggcataaatgccctgaaggatacgcgccgcgaaaaacggtttaaagcggatatctgtttccgataaaatgccggctacctgggcctgtacggaaaggccgctgaacccgagaataaaactcacaatcatggctttcggcagcaaggcggcatcagcttcactgaccagcttgctcccaagtgtaatttcaaacattccgctgataagagggatgtccagatttgccggaagatgaaaaagtgaaagcagcgcgtttgtaaatacagaaagcacatccatgacttgtacgattgataataaccggctgaaaaccgaaaacaatataataaaaccgcccaccatcagcaaggtttgtacagaagaggtgacggcgtcgcccaaaatttttccgagcggccgcttttccgaaagccgcgccttgtggagggccagaaatgcttccttcagagaagggagagcgatcgtctttttaccggtatacgccgcttcttctttccgtccgtatgaacgcatcgtcaggccgacggcgatgtttccgagatagtgagccgatgccagcagaatgccgagagacgcgttatgaaaaaagccgaccgccacggcagcgaatataaataacggattggatgaattggtaaaagagacgaggcgttcagcctctactctggagatttgtttatcctggcgcagccgtgcagtcagcttcgcgccggccggattgcctgaagccatgcccatagccagtacaaatccgccgacccccggcactctgaaaatgggacgcataaagggttcgagtaaaaggccgacaaatttgacaatgccgaatccgattaaaagctcagatagaataaaaaacggaagcaatgaaggaaaaacgacctcccaccacatggaaagaccggttttggaggcttcgaatgaggcctgagggtgtgaaataaccgtcgctgtcaaaaaaatgaaaaacaatgaaatcaaaaatgtatgaaacttagacaaattcattcttacctccccgatgctaaaattgcacactgacatttatatcatgataaaatatagaacagaccttaaaggcggccgggcaagtacctatttgtcatcctgtactaatatacgagcataggggttcaatttagaccatagaattcatgtataggatgtctattagggggttcgtcgcgttggccaaacctacaatcgggttagcgttaggttcgggaggggcaagaggcatcgctcatctcggagtgttatccagtttacataagcatcagattccaattgatatgattgccggcagcagtatgggagcattagtcggaagcttttatgcggccgggcatgacgtggctacgatgaaaaaagtcgccaaagcatttaagcggcgggtgtacgcggattatacgatgccgaggctcggatttttaaaaggagaccgcatcaggcagcttgttcatgcctatacgtacggcaagccgatagaagaactgcggatcccgctcggcatcgtggcctgcgaccttcagaccggcgaaaaactcgtttttacgaaaggttcagtgtccgaagccgtccgcgcgagcatcagcataccgggcgttttcgtcccgcaaaaaatgaacggacgtatgttagtcgacggcgcggtggttgacagaatcccggtttccgccgtaaaagacatgggtgctgatatcgtcatcgcctctgacgtatcccgagtgaaaaaaacggaaaaagcggcacatatttttgatgtaatcatgcaaagtatggatatactgcaaaatgaattggtccgtcaccagaccattgccgcagacgtcatgatccgcccttctcttgaatcattcagctcaagttcttttgccaacattgatcatatgatcacagcgggcgaagaagccgcagaccggatgatcggccggattaaacaagaaatagagaactgggagggctaactcatatgaaagcaaaacattttcgctgggtgtttatcatcctgatcttattaattgctgttacatttattaagcttccgtattacattacacagccgggagaagcatcagagctgagaccgctgattaaggtggacggaggctatcctgaaaaaggaagcctttccttgatgactgtcaaagtaggccccgccaatccgtatacatatctttgggcgaaagtgcatccttacgatgaaatcgtccctgatgaaagcataaaagaagagggcgaatcggactcggattatatgaagcgccagctgcaaatgatgaaaagctcccaagaaaacgcggtcattgccgcttatcaaaaagccgggaaacaggtgaaatattcatttaacgggattttcgccagctcagtcgtctctgacatgccggcaaaaggaaaaatagaggtcggtgataaaatcatcagcgcggacgggaaaacatacgaatccgctgaaaagctgattgattatatcagcagcaaaaaagcgggggaaaaagtaacgtttcacattgaacgggacacgaaagaaaagaccgttgacattgtgctgaaatcattcccggacgacccgaaaagagcgggaatcggcgtcgcgttatatacggaccggaacgtgaaagtgaagccggatctccatttcagcattgaaaacatcggcgggccttctgcggggctcatgatgtctttagaaatttacaaccagctgacaaaacctgacgaaacaaaaggctataatatagccggaacggggacaatcgacgtggacggcaaggtcggaccgatcggcggaatcgatcagaaagtcgtcgccgcagacaaagcgggaaaagatattttctttgcgccgaatcaaaacggagctgaaaattctgattacaaaaatgcggtaaaaacggcgaaagcaatcaagtccgatatgaagatcgtccctgtcgacaccatgcaggacgcacttgactatttggatcagctgaaagtaaaaagcacctgatacaggcaggtgctttttttacgcattcaaaaaacgcttttcgtcttcatcatagcggatcggcgcttgtgaaaattcctgtttctcaaacaatgtgcgttcaggttcttttatcggcaggctgtaaacccgtcccgccagtatgtccagatccagagcgggatgagagaaagaagagagcttgctgacgagaggtgcggtaagctcttttttctttgccgacaggtacccctgtccttttttcgtcattccgagaagacggatataaggagcgcttgaaggctgtaaaagccgatgcatgtcttcctttttcgtccgtgtcagaatgtgcgtgttcatccgctgcagcctcgtccacgtgtatcgttttgttttcaatcgttccatcatttcgcgataggatcgggcttgtctgatggtgcgcaaaattctgtgctcaaggccttcttccacttcgtagattcggctcaattcttcagcggacagagtgctgaggctgtattttacatatgaaaaatagtcttccgtgctgtgccatatcccgtatgcatttctgtatgcctccagctcacgcgcagacgcttccgggagaaagctccttgcggccgccgttcctttttctatcagcgctttccggatgcttgttgcgctggctatccggctgttatctccgggaagctcgtcgtcatgatactgggaagcgattctggctgtcgtataaggcttcatagcggaaccgaaggcgtgtatcgctctaacgtagtgaaaaccgagaatattgttcggcttggacaaatcgagcatgtcccgccctttgaatatgtgtgaaaaagcttttgaggcggcggccggatagctgagaccctttttcagctcctctttcagaatcaggttgcagtcatcttcctttcggctgaacgcttcagacgcttcaataaagggttcgatccgcccgttttcgctgccgaaaaacaagctgctgcatcctaaatgatgaagaagcgaaacgctgccgcgcgcgaataattccgctttttgtacggcatatatataagggagctcaatgacgatatctacgccgttttccagcgccatttttgtccgggcccactttgagacggcggccggttccccgcgctgcaaaaaagggccgctcatcaccgccgccgcgacgctgctgtccgttttgatttttgcttgttccgcatgatagcggtgtccgttatgaaagggattatattcaacaaccaggccgactgctttcatatttgtcccgcctttcttgctatgttttgcttcgtgtggtacatttgcaaatgaagtgcatattttagtccgcttcgtttagtgtatgcatagcctatccggctgtcaacgattgcatgacggcggcattatgctgtaaagaaaaaatattgacaaaaacattctgaaaagctataatcatgtttgttgctttcctgaggtgatacaaatgaaatggacgatttatcagcttcatcaaatggcgaaaaagagctttgaatttgatgaaacagttgagttaaatgagctgacaaaattgaattctgacatccgccgcatttctcccgtccgggtgaagggccgcgcggagattgaatccaagcaagtttcgtttgactttacgatttcaggcgaaatggttttgccgtgctcaagaactttagttgatgtgccgtatccatttacaatcgcgacaaaagaactgtttagatttcataagtcggatgatatagaagatgaggacgttcatattgctgaagacgatatcgttgacttaactccgatcgtaaaagaagagattcttttagaaattcctatgcaagtcttttgtgaaactgaacaaaaagaaggagccgctccccaagtggggaaggattggcaagtgatttctgaggaagacaagaaaaatcaaatcgaccccagacttgcggatctgaaaaagctcttaacacaagatgatgaatcttaactctttaaggaggtgggaataatggctgtaccttttagaagaacttctaaaatgaaaaaaagattgcgccgtacacatttcaaactaaatgtacctggtatgacagaatgcccgtcatgcggagagatgaaattgtctcaccgtgtatgtaaagcatgcggatcatacaacggcaaagacataaatgttaaaagcaattaatgtatgaagaaaagcgcgggaatctcggttcctgcgcttttcttttttttttgcccctccggcctgcttccgccgaaaaaattgtgagcgccagtagtctatctaatctatcagcggcatatgtatgaggtaaatgagcaaatatggagggagatacgattgacgataacgagacaagacgcttggacgcaagatgaagatttgctgctggccgaagtggtgctcaggcatattcgggaaggcgggacccagctttccgcttttgaagaagtcggcagagcgctgacgagaacggctgccgcctgcgggttcagatggaattcttatgtcagaaaacaatatcagtcagggatagaactggcgaaaaaacagcggaaggaattaagaaagcagatcggggtgcattccgccaatctgccgggaaccgtcaaacagcctccgatccgcagggcggaaggagaaaaagagctgtccattgatgatgtcattttgtttcttcagcaatttaaagagtcgccggccgcagcggatgttcgtcatgaaaaagaaaaactcacagaacagctgaccgcgctgcaaaaagaagtcgaggatctgcgtgaggaaaatgaaagcttgagaaacaagctggagatgacggaagaagattataaagcgttaattgacattatggacagagcgagaaggatggtcaattcaaaagaagacgacaggaaatcggcgcagagcctgtaaaatgaaccggcctgagggcggcggcccggccggttttttattatgccgtttctccggatgtcatttcaccgtccatatcgggatgccagatgtaaggattttctcctttatcacgcgccatatcatatttaacgggctcaaaattcatcttatcccagaattctgctgatttcatgcgtgaatttgtcctgatcggcattctgaaagattttgcaaaatcaacaagcgcttttccgtatccgttgttttgatagcccggaagaacctcaagcttccacagttccaaaaagtcctgacgctgatcaaaatacggattcgcgcctccgtttacctgatataaactcattctcgccactagtttatccccgaagtaaatcccgtaaaaaggcgaggtgctgtcattttcaatgatattatcctgaagatcttcaagcatcgacagctcctgcatcccgtattccttaaaccttttaaattcttcgagtgtcttaaagttgatgagcaggcgctctattttcaacacaaactccccctttgttgtgttctaccattattgtaaacgctttaattgaaaattccaactataatatgcttgcctgtctttttgctcaaaacgaaattgaagtaatttgcggcggcttctgctatgataatatggaaaaatgcagatatagggtgtgacagtgtgaaaatcggaattatcggcggcggagcggtaggtcttttatgtgcttactacttatcgtcccgccatcaggtaacggtcattacgcggcggacggagcaggctgatgcgattaactcaggcggtatacggcttttgaaagacggaatagaatgtacggcggcatgcagagcgcaaacaggcatcacttccggattcgacctcttaatctcagccgttaaacagcaccagctcagtgctgtgctgcgggatcttgagacggtaaaagggacgaatgtgctgtttttgcaaaacggcatgggacacatacacgacattaaagattggcatacggatcattcgctttatgccggcactgttgagcacggagcaaaaaagatatcggatcatgccgttgaacatacgggagcgggagccgtaagatggagtgtattcagcgcatcccggccggaaacgctcaaaagcatcttttccggcatgcaccgggattttcccgtatatgatgaaaacgactggtatcggctgttaacgggaaaactgatcatcaatgtatgcatcaacccgttaactgcattgctgcgtgtgaaaaacggagagctgttaagaaatgacgcttacaaaaaatatatgagaaacgtgtttgaagaagcggagacaatacttggcctcgccgatagagaaaaagcgtggaacaaggtttgcgaagtttgcagactgacggaaaaaaatcattcttccatgctcgtcgatatcatggcaggcaggcggacagaggccgatgcgattatcggctatcttgtaaaagaagcggaaagccgcggattgccggccgttcatctcacgtttttacaccgcagcataaaagcgttagaaagaaattgaaacaaagtcttttgaggttttccggtaacatgctatactcatttcggaaacctaactatttattggagaaaggaagttccagacagatgcagctaactgaactttccatcaaaagtcaaaataagtttgtgcagcactatatagatggagaaaacatgtcttcattttttgattatgatattcattcagaggacgtatggcaaaagcggcttcatgacctctcttcgcggccgtttgccagagaggaattagcggattatttatcctcctatcacgaaaaatttcattccgacgccatgcaggcctccatcgaaaaactgagagatccaaaaagcgcagcggttgtaggcggccagcaggccggtcttttaacagggcctctttacaccatacataaaattatctccattatcgtacttgccagacagcaggaagaggcgctgcagattcctgtcgctccgatcttctgggtggccggtgaagatcacgatctggaagaaattaattatgtgcatacgtcaacagagaataaaggtccggtgaagcggaaactgccgcagtcgtactggaaaaaaacatcggcggctaaaaccgagcttgatcaggaaaaatgcgcggcttggattgatgaagtgttcgctgcttttgaggaaacggatcacacaaacacactccttcaaaacgtgaagcgatgtttacgctcatcagagacattcacggacttttttgagctgttgatcgccgacttgtttcaagaagaaggccttattctgatgaattcgggagatccggggattaaaaagctggaaacgggtatgtttcagcagattttaaaacacaatcacgagcttgccaaagctgtgtcagaccagcagcgtcttatgcgggaagccggttatcacccgattattgaatcggacaaagatcaggctaatctgttttacgaacacgagggagagcgtttcttaattgaaaaagaaaacggcgtttttgtcattaaggagcttgacctgaagtggacgaacgacgagcttcatacccatatggaagaaaaaccggaatgtttcagcaataacgttgtgacaaggccgcttatgcaggagtttctcatcccgactctggcgtttatcgcgggaccgggggagatcaattattggggtgagctgaagcaggctttctcattaatgggctttcgcatgactccggtagtgccgagactgaacattacgattcttgagcgccatattgaaaagaagctttcagaacggaatatcccgcttcaggaagcgatcgaacacggcaccggacacctgaaagacacttattttgaagagcagattccggaagagttttcttctgtaatggaacaggcgaagtcacagattgaagccgtccataaacgtgcaaggaacgaagcgctgaaggtcgattcaagccttgagccgctcttacagaagaatgccgccttcattcaggatcagctcttgtttttagaacggacggtaacgaaaagaattgaagaaaaagaaggttttgtgctgcgtgactatgaaagaatccaaaacagcatcagaccgctcggcgctccgcaggaacggatttggaatgtgatgtattatttgaaccgttacggtccaaaattcttcacaaccttcaaacatctgccattttcttttcaaaaccaacatcagattgtcaaactttgaaataaagttttaaagaaccctgaatagttcagggtttttttttatgtgtaaacagtgtaaaatgaggttgtggagagaagtggcggatagtggtgagtttaggggagaaagtgggggtccttatcatgtttatgggtgaataccagcatacaattgatgcaaagggccgcatgatcgtacccgcaaaattcagagaaggcctcggtgagcagtttgtgctgacaagaggacttgaccaatgccttttcggctatccgatgaatgaatggaagctgattgaagaaaagctgaaggctctgccgctcaccaaaaaagacgcccgcgcatttacccgattctttttttccggtgcgaccgaatgcgaactggacaagcagggaagggttaatattgcgtcatctcttctgaattacgcaaaactggaaaaagaatgtgttgtcatcggggtttccaatcgaattgaattgtggagtaaggtaatatgggaacaatacacagaagagcaagaagattcattcgctgaaattgctgaaaacatgattggatttgatatataatggatcttcgtgcatcacaacaacaactgacaattcaattcattcctgataaaggtgggaccgacacaaatgtttcagcataagacagtacttcttcgtgaaaccgtcgacggtttaaatatcaaaccggacggaacctatgtggactgcacccttggcggcgccgggcacagtacatatttattgcagcaattatcggaaaaaggacgcttgatcgcctttgaccaagatgacacggcacttgaaaacgcaaagaaaacattgtccgaatacaaaggacagctcattctggtaaaaagcaactttcgttatttaaaagagtgtttacatgaacacggcattacgagtgtcgacggaattttatttgatttaggagtatcctctccgcagcttgatacaccggaacggggattcagttatcatcatgacgcaccgctggacatgaggatggaccagtcggccgcccttacggcgaaagaagtcgtaaatgaatggcggtatgaggaccttgtgaggattttctttaaatacggagaagaaaaattcagcaagcagatcgcccggaaaattgaagaggcaagagaaaaatcgcctattcaaacaaccggccaactggtcgatctaataaaggacgcgataccggctccggcaagaagaagcggaggtcatccggccaaacgtgtattccaagccattcgaatcgccgtaaacgacgagcttcaagtatttgaagaggccctcttgcaagcgatagaggtgctgaagccgggcggaagggtgtctgtgatcacttttcactcgctggaagacagaatgtgcaagacgacattcaaggaaaaatcatcacttcccgaactgcctccgggtcttcccgtgataccggaagaatttgaaccggaattaaaactgattacgagaaagcccattacggcatcaaaagaggagcttgaagaaaataaccgcgcccggtcagcgaagctccgcattgcggagaaacgaaaataacgggcagcaaatgacaacattaaaggaggtcatcagcctatgagcaacttagcttaccagcaggaaaaacaacaacggccagtgataagtcccgaaaaaaaggtgattgtcaaaaagagggcttccattacactcggggaaaaggtgctgctcgtcctgtttgccattgccgttctctccacatcaatgtttatcgtatcaaaggcatacgcagcgtaccaatccaatattgaggtgcaaaaactagaggagaaagtatctgagaagaataagcagatcggtgatctcgaaaagacggcggctgacttaagccagccgcagcgcctgatggatatcgctaaaaagcacggtttgaatctgaaagataaaaaagtgaaaaacatacaggaatgataacccatgccgaaaaaaaataagtttatgaacagaggagcagcgatactcagtatttgtttcgctctctttttctttgtcattctcgggagaatggcgtacattcaattaaccggtaaagcaaacggtgtagaacttgcaacaaaagcgaccgagcagcacgaaaaaaagcggacgatagaagcgagccgcggctctattcttgaccgaaacggcaaagtgcttgcagaggacacggcgacatataagctcattgccgtgcttgataaaaagatgacgaccgacaagaagcatcctcagcatgtcaaagacaaagagaaaacggcggaaaaactggcgaccgttatcaatcttgataaaagcgagattctggacatcttaaacaggaatggcgcgaagcaggtggaattcggttcggccggccgcgatatctcttatgcgaaaaaacagaagatcgaaaaaatggatcttccgggtatttctttcttaagagatacgaagcgctactatccgaacggcatatttttgtcaaatgttctcggctatgccgatgtgaatgaaaaaacaaacgagatacaaggctctttagggcttgaaaaaatactgaataactatctgacggaacgtgacgggtccgtcacttacgaaagtgataaatccggctggaaacttccgaacagcaaggaaaaaatcaccgcacctaaaaacggtgacaatgtatatttaaccattgatcagaaaattcaaacctttctagaagacagcatgacgaaagtagcggaaaaatataaaccgaaaaaaattatggcggctgtcgtagaaccgaaaacaggcaaagtgcttgcgatggggcagcgtccgagttttgacccgaatatcagaaacgtcaccaattattacaacgacttagtgtcgtacgcgtatgaaccgggttcaacgatgaagatctttacgcttgccgcggcgattcaggaaaatgtgttttccgcaaacgagaaatataaatcaggaacatataaagtgggaggcaaacctgttaaagattggaacgatggcgccggatggggtatgacaagcttccatgacggcctcatgaggtcatcgaatgttgctttcgccaaactggccaacgaaaaactggggtttgaccggtttaatgagtacctgcacaaattcgggctctatcaaaaaacagggattgatctgcccggtgaagtatcaagtaaaattaactacaaatatgattttgacaaagcgtctacggcttacggccaagcatcggcgataacaccgatccagcagcttcaggccgtcacggcgattgctaataacggcaaaatgatgaaaccttacgtcattgatcatattgtcgaccccgatacgaaaaaagtcgtcaagcagacaaaaccagagcaagtaggcacgccgatttcagccgatacggcgaaaaaagtccggaacctgctcggagaagtcgtgacatcagacatcggaacggggaaaccttataaaattgaaggttttgacgtcgcgggtaaaacgggaaccgcacaaatcgccgggacgggcggatatttaaggggaacgagcaactatgtgttttcattcatgggcatggcgccgaaaaatgatcctaagctcgtcatctatgtagccgtgcagcagccgcagttaaaagcgggtcaaagcagctctgatcctgtcgcggaaatctttaacccgacgatgaaaaacagcctccactacatgaatatcgaaccgacggaaaaaacagattccggtcaggaagaaacgaaaagccaaaagatgcctgacctgacagataaaacggtcacgggcgctgagaaggaagcgaaaaatgaacacctcacaccgattgtcatcggcagcgatgttgccgtaaaagagcagtatccgacagccggagaagatgtgatcaccaatcagaaaatcttcttgaaaacagacggaaagatgacgatgccggatatgtccggatggtcgagacgggaagtgcttcaattcagcaaagtatcaggcattcacatcgatgtgagcggtgaaggttacgcttcaagccaaagtgtgaaaaaaggcaaagaactgaaagaaaataccgtgattaaggtgaaatttaaaaatcctgattaacgggacagagaagtccgcggatgcccgcgggcttcttttttatgcgcggccgttctatgtgtccaagctgaggcataaattgaaacaagcctaaataaggagtggacggtcccttgcgcgtttcaaatgtaacggttcgaaaacgtttattactggttttgctttttggcgtaatcatttttttgatcattgacagcagattaggctatgtccaatttgtgatgggggaaaagctgacttctttggctaaggattcctggagccggaatttgccgtttgagcctgagcggggagagatccttgaccgaaacggcgtgaagctggctacgaataaaagcgcgccgaccgtctttgtcgtaccgcgccagattcaaaatcccataaaaacgggcaagcttctcgcgtcagttttaaatatgtcggaagagaaggtctacaaacacattactaagaaaacctccatagaaaaaatctcacccgaggggcggaaaatttccaataaaaaagcgaaagaaatcaaagcgctcgacttaaaaggggtttatgtggctgaagacagcatccgccattatccgtacggaagctttttgtcccatgttctcggttttgccggtattgataaccagggccttctcggattggaggcttattatgatgatgacttaaaaggtgtaaagggatcagtgaaattttatacggatgccaaggggaagaaaatgcctgatgaagcggatgattatacccctccgaaagacggacttgatatgaaattgacgattgacgccaaggttcagacgattatagaaagagagctcgacaatgcagcggcgaaatataacccggacggaatgattgcggtcgcaatgaatccgaaaaacggggaagtgctcggtatgtcaagccgtcctgattttgatccggctgactatcaatccgtagatccgtccgtttacaaccggaacctgccggtatggagcacatatgaaccgggttcgacctttaagattattacgcttgcggccgctctccaagagcaaaaagtaaacttgcaaagagaccacttttatgacaaaggatttgccgaggttgacggcgcccgcctccgatgctggaaaaagggcggccacggttcgcaatcttatcttgaagtcgttcaaaattcctgcaaccctgggtttgtacagctgggggaacggctcggaaaacaaaagctgtttcaatatattaaggacttcggctttggaaagaaaacaggcattgatctgcaaggggaaggaacggggatcttattcccgcttgacagagtcggcccggtcgaacaggcgacaaccgctttcggacaaggagtttccgtcacgccgattcagcaggtggcagccgtttccgcagcaataaacggcggaacgctttatactccgtttatcgccaaagagtgggttgatcccgttacgaaaaaaaccgttaagaaacaatcgccgattgcgaaaagacaagttatttcccaggaaacgtcaaagcagatcagatatgctttagaaagcgtcgtcgctcagggaacggggcggaatgcctttgtggaaggatatcgcgtcggcggaaaaacaggtaccgcacaaaaggtcaaagacggcaaatatctcgaaaacaaccatatcgtctcctttatcggttttgcgccggctgatgacccgagccttgtcgtgtatgtcgcggttgataatccgaaaggcacgattcaattcgggggaaccgtcgccgcgccgattgtcggaaatatgatgagagacagtctgccggagctcggcgtgaaaccgcgaaaaaatcaaatcgagaaaaaatatcaatggaacgacacaaaaacaatagaggttccgaatgttgtagggatgtctgtctctgatcttgagtcgctgcttgtcaatttgaatattgactcctcaggaaaaggaagcaaaattgtgaaacaatcacctgcagccggaacgaaagtaaaagaaggctcaaagatccgtgtttacttgagtgaagaatgagtctttttgaggcagccgattgttttcggctgccttttatcataaagagaaaaaaagaagataacttttaagattaactggatgtatccttttatttacgctaaaatatgaactgtatgtttaaaagccattctgacttttataaacggttatcatgataaaagaatgaatagaatttctgagaggtttgatacaatgaaacttacaaagctgcttacatatttaatggccgaacctgttcaaaatgactttcatgaccctgacataacttcaattgagatggactccagggaagtgagaaaagggagtctttttgtgtgtataaaagggtatacggtagacggacatgatttcgctcaaaaagccgcagaaaacggcgcagcggccatcgttgccgagaaagagcttgacgtcgatgtccctgtcattatcgtccgccggtcacagcgggcgctcagcgttctttctgacgcgttttacgggcagccgacaaagcagcttcagcttatcggcatcaccggcacaaacggcaaaacatcaacgacgcacatggttgatgagattttcaaaaaagcgggaagacagaccggtttaatcggaacgatgtacattaaaatcggggatgagacattcccggtcaaaaatacaacgcccgaaagcgtcacactgcaaaaaacgttcaagaaaatgaatgatgagcatgttgacacagctattatggaagtgtcttctcacgctctgtcactcggcagggttcacggctgcgattatgatattgccgtattcacgaacctgacacaggaccatttagactatcacaagacgatggaagactacagacaggctaaaagcctcctgttttcccagctgggcggctcctttaaccatgaaaagccgaagcgggccgttttaaacgcagatgacaaagccagtgcttactttgaaaaagtgacggcggcgcacatccttacatacggaatcgagaacgatgccgatgtcatggcgaaacaaatcgagatctctgcgcaaggcacaagttttgaactcgttacgccaaaaggaacaaagcagatcacggtttcactcgtcggccgcttcaacgtgtataacgtactggctgcagcggcgacagcgatcgcagcgggtctgccgtttgatacgatcacaagcgctcttgaagagctgcaaggtgtcagaggccggtttgaactggtgaatcataatcagccgtttcctgtgatcgtcgattacgcgcacacgcctgacagtctggaaaacgttctgaatacatgcaaagacatgacagagggcaagcttttcgtcgtcgtcggctgcggcggagaccgggataaaacgaaacgcccgaaaatggcggaaattgcggtgcggattgccgacgaaccgattttcacttcagataacccgagaagcgaagaccctctggccatattaagagatatggaaagaggggtagaaggcacctactatcacagtatcgcaaaccgcgagcaggctatcttttttgccattgccaacgcgaaaaagggagatgtggttctgattgccgggaaagggcatgaaacctatcagcagatcggcaatgaaacattcgactttgatgacgccgaagtagcgggaagagctattgttgagctgaataaaaagtaaaacaggaaagagtgttagaatgagggaaatgaaaagaattacggggacacaatgtgaatatgataaatacgtatgtcgtttgaacgaaacgggaggagaaaagagcaatgcttgagcaagtgattttatttacaataataatgggatttttaatcagtgttctgatatctccgattcttatcccgtttttaagacgtttaaaattcggccaaagtatcagggaagaggggccgaaatcacatatgaaaaaatcagggacgccgacgatgggcggggtcatgattatcgtatccatcgccattacggcgattgtcatgacgcagaaattttcgcatctgagcgcggaaatgtttcttctgctgtttgttacgatcggatacggcctgctcggctttctggatgactatattaaagtagtaatgaaacggaatctcggattgacgtcgaagcagaaattgatcggccagatcattattgccattgtattttacggagtatatcattattgccatttttcaaccggcatcagggtgccgggcacacatctgtcaatcgatctcggctggggatactttatcctcgttctctttatgcttgtcggaggttcaaatgccgtcaacctgacagacggtctggacggtctcttgtccggtaccgcggctatcgcattcggcgctttcgccatccttgcgtggaaccagtcacaatatgacgttgcgattttctcggttgccgttgtcggcgccgttctcggttttcttgtattcaacgcccatcccgccaaagtatttatgggggataccggttcgcttgcgctcggaggagcgatcgtgactgttgccattctgacgaagcttgaaattctgctcgtcattatcggcggagtttttgttattgagaccttatctgttatcttacaagtcatcagctttaaaacgacaggaaaacgaatctttaagatgagtccgcttcaccaccattacgaattggtcggatggtctgaatggagagttgtcgtcacattctggactgcgggactgctgcttgccgttttaggaatttacatcgaggtgtggttataagtggaaaacgaactttttttgcaaaaacaaaactttctggtcctcggactggcgaaaagcggatatgcggctgcgtcgattcttcatgaaaaaggcattaacgtcgtcgtgaatgatcaaaaagcctttgaagagaacgaacctgccaaaaggctttcagaaagaggaatcgaggtcatctgcggtgagcatccgacgtcactttttgatcagcaccacattaccattctgatcaaaaaccccggaatcccatatgaaaatatcatggtggaggaagcgcaaagaagaggcatcccggtctggacggaaattgagcttgcgtattatatcaccaatgcaaaattcatcggcattacaggttcaaacgggaaaacaacaacgacgaccctgatttatgaaatgctgaaagctgactcgataaaggcgctgatcgcagggaatatcggcactgtcgccagtgaagtggcttatcatgctgacggtgatgaatggatcgtcacagagctttcttcgttccagcttatggggactcatgcgttcagacctgaaatcggcctgattttaaatgtgttcgacgctcatttggattaccatcacagccgtgaaaactatgaaaaagccaagcagaacgtgtatcttcatcagcttgagagtgatacggccatcgtgaatcaaagcgatgaaacagtcgtgcggcttgccgaaagcggaaaagccggcaccgttccgttttcagttcaccaggaactgtcaagcggcgcatttattaaagacggaatgctgatgttcggcgatgaagcgattctgcctgttgatgacatcgtgctgccgggcgcgcacaatttagaaaatatattggccgctgtagccgcggcaaaaacggcgggcgcgtctaataaagcgattcagaaggtgctgacaagctttaccggtgtcaaacaccgtctgcagtatgtaacagcgatccggaatcgtaaattttataatgacagcaaagcgacgaatattttggccacaagcaaagcgctctccgcgttcaaagcaccggttattctgcttgcaggcggactggaccgcggcaacggttttgacgatctgaaaccgtatatggacaatgtcaaagcggtcctgacgttcggacagacagcgccgaagatagaaaaactgggcaatgagctgggaatacaacatgtcaaacgtgtcgataatgttgaacaagcagtatctgcggcgtttgcgctctcaaatgaaggagacgtcatcctcttgtcacccgcgtgtgcaagctgggatcagttcaaaacatttgaagaacgcggtgacatgtttatagatgccgtgcatatgcttaagtaagggcttgtctctgttcatcggcagccctaaatgacttatgcttggggtgtcgattgctttgactactaaaaaaacagcgcctgatttgttattagttattattacgttattgcttttaacaataggattaattatggtctacagtgcaagtgcggtatgggcggattataaatttgacgactcgtttttcttcgcaaaacggcagctgctgtttgcggggatcggcgtcattgccatgtttttcattatgaatgtggattattggacatggcgcacatggtcgaagctgcttctgatcatttgtttttttctgcttgtgcttgtgctgattccgggagtcggaatggtgcggaacggttcaagaagctggatcggagtgggagcgttcagcattcagccttcggagtttatgaaactcgcgatgattgcgtttctggctaaatttctttctgaaaaacagaagaatattacgtcattcagacgcggattcgttcccgcgctcggaatcgtgttttctgcatttattattattatgtgccagccggacctgggaacggggacggtaatggtgggcacgtgcatcgtgatgatttttgtatccggtgcgcgaatcgctcatttcgcgtttctcggactcatcggtttaagcggatttgcggcgcttgttctgtccgctccttatcggattaaacggattacctcttacttaaacccgtgggaggacccgcttggaagcggatttcagatcattcagtcgctctatgccgtaggtccgggcggactgttcgggatggggctcggccaaagccggcaaaagtttttttacctgccggagccgcaaaccgatttcatttttgctattttatctgaggaactcggctttatcggcggttcgctcatattgctgctgttcagtattttattatggcggggcgtcaggattgccctcggcgcgccggatttatacggaagctttgtcgccatcggtattatttctatgatagctattcaagtcatgattaatatcggcgttgtgacggggctgatcccggtaacaggaattacgctgccgtttttaagctacggaggctcatcactgacgctgatgctcgcagcggtcggcgtgcttttaaatgtcagccggtactcgaggtattgatctgtatcttgcctcatcactcatgatctattcgttatctataaaaaaacagacaacatcaataaccctgtcctaaaaaacagggttatcgctatgtgattaagggggacatacgaatgcgtattgcagtaagcggaggcggaaccggaggacatatttatccggctttggcctttattaaagaagttcagcgccggcatccggatgtggaatttttgtatatcggaacagagaacggtcttgagaaaaaaattgttgaacgggaaaatatcccgttccgcgccattgaaattacaggtttcaaacgaaaactttcttttgaaaatgtaaaaaccgtcatgcgtttcttaaaaggcgtgaagaaaagcaaatcatatttaaaagagtttaaaccggatgccgttatcggtacaggcggctatgtatgcggtccggttgtatacgcggccgcaaaaatgggaattccgacgatcattcatgagcaaaacagccttccaggcatcacaaataagtttctctcgaaatatgttaataaggtggcaatttgctttgaagaggcaaaatcacattttcctgctgaaaaagttgtgtttacgggaaacccgagagcctctgaagtcgtctcaattaagacaggccgctcattaactgagttcgggctgaaagataatcaaaaaacggtgctcattttcggcggaagcagaggcgcggctcccattaatcgtgccgttatagatatgcaggaagaattgaaaacgagaccttaccaagtgctttatattaccggggaagtgcattacgagaaggtaacggctgagctgaaaggcggaaaagccgctgataatatggtgacaaaaccgtttttgcaccaaatgccggagtacttacaatcaattgatgtcattgtggcaagagccggagcgacgacgattgcggagatcaccgctctcggcattccgagcgtgcttattccgagcccgtatgtgacagccaatcaccaggaagtcaatgcgaaggcgctcagccagcatgacgctgcaatcgtactgaaggaaaccgagctcagcggagaaaaactgatcgctgcgctggacaaaatcgtcatgaatgaagaaaccttaaaagacatgagtgagcggacaaaatcactcggtgttccggatgcggcagccagactgtacagtatcatggaagacataaaaaaatagagcaaatggaatgcggaggtttatgatggagaacgtaattcaggaattaagagaccgcgaagtcggcaaagtgctggaacaagaaccgctcgcgaaccatacaacgatgaaaatcggcggtccggcggacattttaatcatccccaaccgtgtggaagcggtcaaagatattatggatattgtgaagaaacatgatctgccatggacggttatcggccgcggttcaaatctgctcgtgcttgatgaaggcataagaggagttgtcatcaaactgggggcgggtctggatcatttggagattgacggtgatcaggtgacggtcggaggcggctattcggtcgtccggcttgcgacttccatgagtaaaaaaggaatgtccggtctcgaatttgcagcgggcatccccggatcaatcggcggggccgtctatatgaatgccggggcgcacggatctgatatgagtgagattcttgtgaaagcccgtatcttatttgaagacggcacaatcgaatggctgacaaacgaagagatggatttcagctacagaacgtctgttttgcagaaaaaacgccccggcgtctgtctcgaggcagttcttcagcttgagcaaaaggaacgggaagccattacggcgcaaatgcagcagaacaaagattacagaaaaaatacgcagccgtattcaagcccatgcgccggaagcatattcagaaatccgctgccgaatcatgccggaaacctcgttgaaaaagcgggattaaaaggacatcagatcggcggagcgaaagtatccgaaatgcacgggaattttatcgtcaatgccggcggagcgactgccaaggacgttctcgacctgattgagtatgtgaaaaagacaatccgtgagcagtatgatgttgacatgcatacagaagttgaaatcatcggagggaatcgttaaaaggttctctgatttacatgagctcatgtgatatacttttaacaaatgtcaaacggcatcacagcatgccgtttgtttttcaatcagacgaatgtcaagctgtttcattcttagtgaggtggacaggcagtgaacccaaatcatgaaagagaaaaaatcgtaaatattgaagagcggattccgaaaatcaaagagcagcggaaacaaaaagcaaaccgccggctgatttcattcattgtgctcttttttatgatggtgctgatcatcgtgtacttgcagatgccgatcagcaaagtgtcttctgtcaccgtttccggaaacgaaaacgtgtctgtaaaagagatcaacgcgctttctgatatacataacggacaaaccgagttctggagtctgaacaagaaaaaaacagaagaaaagattgagcagaataaactggtgaaaaaggcggatctttcaaaagtatttcctaataaagtcagcattcacattgaagaatacaagacgatcgcgtatctgcagcggaatgatgtgtattatgaagtgctggagaacggcaccgtgctgccgaacgaagtcacgccggatgacgcgggcccgattttggttgactggacaaacgcgaaaaagcgggtcaaaatggcggaacagcttgataagctttccggttcgctaaagcagtcgatttctgaaatctattatacaccggtaaaaatggatcaggaccggatcaagctgtatatgaacgacgggtatgtagttaccgcttctattaaaacatttgccgaccggatgaagacctatccttctatcgtttcccagctggacggcgggaaaaaggggattatccacttagaagtcgctacgtattttgaagaatttaacaaaggtaaatccggcaagaaaaaagaaaatgattaatagttctaaagaactaatttagaggtgattcaaaagaatctattataatcagcggggcagccgatataaccgatagcggaataattatgactatgtttgtttttgcctgggataggctgccggacaagcggaaaattctcaatgcaatgggcgtgtcttctttaatgagcattgcatttggaattttcctcctgtttcttcttttttcggatgtttctggcaatatctatagcttttctggaggttcatcttagtgtagactaatggaaagcgggtatatttgcatctggtttacacattatggcaccgtgacaggaaatcttacggtaaggtggtccgtctctaaaaaaaataaaaaaaatgcgatataaaagaggatatacatagaatataacgaatagtttcattaaacataaattgtgagaaatcagatagaaatttgttgatgctgttgtttttgttacacacttgtaaagccacatccattgtattgttgttccgcaaataatagaatagaatttgatcgaaatgtgaggaggtgccatagaatgaacaacaatgaactttacgtcagtcttgacatcggtacgtccaatacaaaagtgatcgtcggagaaatgacagatgattcccttaacattatcggagtgggaaatgtaccgtctgaagggttgaaaaaaggctcaatcgttgatatagatgaaaccgttcattctataagaaaagcgtttgaccaagctgaaagaatggtaggttttccgctgaaaaaagccattgtcggcgttaatggaaattatattcatattcaagatacgaacggcgttgtcgctgtttccagtgaaaacaaagaaattcacgttgaagacgtccgcagggtaatggaagcggcacaggtcgtgtcggttccgcacgagcagctgatcgttgacgtcattccgaaacagtttatcgttgacggaagagacgaaattaccgatccgaaaaaaatgctcggtgtgcgcctggaagtagaaggcacgctgattaccggctccaaaacgatcttacataatttacttcgctgtgtggagagagcgggcgttgaaattactgatatctgcctgcagccgcttgcggccggttcggcggctttgtcaaaagacgaaaaaaacctcggagtcgccatgattgatatcggcggcggctcgacgacggtggcggtatttgaacaggggcacctgaaggagacagccgtcattccgctcggaggcgaaaacatcacgaaagatgtatcgatcggattgcgcacttccaccgaagaggctgaaagagtaaaaaaacaattcggacatgcattctacgatgaggcttcagaagatgaagtatttgaagtcaccgtcataggaacgaatcaaaagcaatcttttacacagcaggaaattgccaatattattgaagcaagagtggaagagattcttgagattgccgcagccgaaattgagcatatgggaattacagatctgcccggcggctttgtgctgaccggcggacaggccgcaatgcccggagtgctttcattggcacaggaagtgctgaggcacaatgtaagggtcgcaagcccgaattatatcggtgtaagagaccctcagtatatgacgggtgtcggcttgatacaatttgcctgccgaaatgccagaattcagggaagaaaaataggctttcatatgccggaagaagccgtgcaggaaatcgcggtctctcacgaagaagaacatcatcagcggcctgaggcgcagcagcgtccaaaagcaaaacaaaaaacacaagccgaacacaacaaaccgagcaaaatgaaaaaactattaagcatgttttgggaatagattgatagtcattcggcagattaggaggatttagcatgttggatttcgaaacaaacatagacggcttagcatcaattaaagtaatcggagtaggaggcggcggtaataacgcggtcaaccgaatgattgaaaatgaagtgcagggtgtagagtacattgcggtaaacacggacgcgcaagctcttaacctgtcaaaagcggaagtgaaaatgcagatcggggaaaagctgacccgcggtctcggagcgggagcgaatccggaagtcggcaaaaaagccgctgaagaaagtaaggaacaaatcgaagaagcgctaaaaggcgctgacatggtgttcgttacagccggaatgggaggcggtaccggaacgggagccgcaccggtgatcgcgcaaatcgcaaaggacttaggcgctttgactgtcggtgtcgtaacaagaccgtttacatttgaaggaagaaaacgccagctgcaggctgcaggcggtatcacggcaatgaaagaagccgttgacacactgatcgttattccgaatgaccgcattcttgaaattgtcgataaaaacacaccgatgcttgaagcattccgtgaagctgataacgtgcttcgccaaggggtgcaaggtatctctgacctcatcgcaacgcctggtttaatcaacttggactttgccgatgtcaaaaccatcatgtccaacaaaggttcagcattgatgggtatcgggatcgctacaggagaaagccgtgctgctgaagccgccaaaaaggcgatctccagtccgttactggaagcggcaatcgacggagcgcaaggtgttttgatgaacattacgggaggtacaaacctgagcctctacgaagtgcaggaagcagccgacatcgtcgcttctgcatctgaccctgatgtcaatatgattttcggttcagttatcaatgaaaatctgaaagatgaaatcgtcgtcaccgttattgcgaccggttttatcgaacaggaaaaagatgactcaaaaccgcagcgtccgaatttaaaccaaggattgaagtctcaaagccaaaacgctgcgaaacgtgagccgaaacgagaagaaacacagcatcaaaacacggtgaaccgccatacatcacagccggcggatgatgctctcgacattcctacatttttaagaaaccgcaacaaacgcggctgatgtaaaaaaggacaagactacatggttttgtcctttttcttttttgtgcacagtcttccttcctatcccccatgatctatacagtgaaaaaagaaactttatacctatgacgaattgattgttttttagtttcatacggctttctacagaatgtgacaatatctgaatggaagattgtctacatttaacgtacagcatcgaaatgacaaacgattccaattatgaaggagggatacacattttataggtcgttaccaaataaggggggatacgattgaagaaaaaaacaagaaacagatggacaggctccgttttaagcgcgattgtcgtcagttcactgttgtttccgggtggagccggagcgaacagcacaccgggggcagtttctttcaccaaagatctttcttcctctaagagcattcagcataagatttccgattcagtcaagaagcgttttgaaaaaaatgataaagtcacgtttcttatcaaatttaaagagaaagccaatacgaaaaaagcggtcaaacaagcagaaaaaaatgccgagtctcaatcgctttccgcagcaaaaaccgaatatcaaaagcggtcagccgtcgtttcttctttaaaactggcggctcatgatgcgcagcagaatctgaaaacatatttggaaaaacaaaaaaagaaaggaaaggctgatcacatccattcctattatattgtcaacggaatggcagtcactgcttcgaaagaggtaatggaaaaagccgcctcatttcctgaagtagaaaaagttcttccgaatgaaaaacgtcagcttactcaacggcatttaaaagctccttttcaaatgaagaaaaaacaaaaagagattaaagcaaaggaaggcatcgaatggaatatcagccaaattgatgcgccgcaggcctgggcctcaggatacgacggaaccgggacggttgtcgcctccattgatacgggagttcagtgggatcatcccgcgcttaaggaaaaataccggggttacgatcctgaaaatcccgcagcgccgaatcatgaaatgaactggtatgatgccgtatcccataaagacgctccctatgatgatcttgaacacggcactcatgtaacagggaccatgacgggttcagaacctgacggctcaaatcaaatcggtgtggctccgggggcgaaatggatcgcagtaaaagcattttcagatgacggaggaaccgatgccgatattttggatgccggtgaatgggtgctcgcgcctaaagataaaaacggcacgccgcatcccgagatggcgccggatgttgtcaataattcctgggcaggcggttcgggaatggacgagtggtaccgcgatatggtgaatgcgtggagagcggcagggatttttcctgaattctctgcggggaatgaagacttatttacaccgggaggaccgggttcaatcgcaaatccggccaattatcctgaagcatttgcgacaggtgcgactgacatcgacaagaaactcgctgatttctcacttcaaggcccctccccgtatcatgaaacaaaaccggacatttcggctccgggagtgaatatccgttcttctattcctggaggaacatacgaaggcggctgggacggaacttcaatggccgggccgcatgtggcggcgacggcggctttgttaaggcaggcgaacgcctctattacggtcgatgaaatggaagacgttttgacgcgcaccgccgaaaagctgacagattccgtttttccggaatcaccgaataacggttacggccacggtctcgttaacgcttttgatgccgtttctgccgtaacggacggaatcggaagcgtagaaggcaaggtatcttctgcgggcgaagatcacaatccgcccagctttcgtcatgaaccggtctcagaggcttacaaagggacaagccttccgttaacggttacagcagaagatgatgtaagcgtaactgaggtgatcctctcctatcagtttgatgaaggagagtggaaaacgacagccgccgttcaaaaaagcggtgatgaaaaaaagggaacataccaggcggagattccggacataacgggaagcaagataagttataaatggaccataaaagatttcggaggtcattctgtagaatctgatacgtaccgggctgacgtgaaaccgagcattacggcgggatacaaagaggattttgaatcacagccggcgggctggtcaagttacgggacacatgaccaatgggaatggggtatcccgggttcagggccaggcgccgcattttccggagaaaaagtgtatgcgacgaatctgtccggcccttatgctgattcggccaacatgaatctggtgatgcctccgatacaagttccggaaacagggcggctgtttttacaatttaaaagctggcacaagctcgaagaattttttgattacgggtatgtgttcgttctgccggaagggaaatcaaattgggagcaggcggccgtttacaatggtgattccgcaggatggaatgatgaagaggcggatttatctgcgtataaaggccaaaacataaagctcatgtttaatatgcagtctgacgaagtactcaatgaagacggatggtatatcgatgatgtccggctttcaagcagccctctcgggaatgcggctaaaaaaagtaaacacaatagacaaacacctcccggccacctgaagaaaaaggccgtcagtccgaaacaggccaaaccggcagtgaaatcgcccggaaaaagagtgaaacgtgaaacaaacctcctgccgctcagagcgcaaatcagtgtcgccgagacggggaaatccgtatattccgaccctgcaagcggaagctacagcatgtcacataaggcgggaagctatacgctgaaagccgaggcttacggatttaagtccgcttcgaaacaagtttctattcaatcagacaaaaccgcacaggcagactttacactggagcaaatgccgtccggcacgctaaaaggaaccatcaccaatcagtccacaggcgaaccggtaaaaggggctgcgctttatgtggccgaggatgccgcaattgaaccggcggtgacaaacgataaaggggaatactcgcttaaggcgtacgaaggctcctacacaatcaaagtagcggcaaaaggcttttacaatagcgaattttctgtcgatatcaaaggagttgctgaaaaaaacgtcaagcttaagccgtatgtcggttatgaaggggaaatcgcctatgataacgggacggaagaagccgcgctgtcatattttaaagccggcagcaaatctgccgttaagatgaccctcaaagacggaaaagaacacggtatgctgacgggaggcctttttaaattttggggcgccgactggcctgatccgggcggtaccgaatttcaagcagaagtatatgattcatccggccctgctggagctcctggcagcaaaattgccggcccgttccaagctgaagcgcttcgaaacggcgagtggaccaatgtggatctcagctcaaaaggaatcgcggtcggaaaggatttttatcttgtgttccgtcagacgaaacccgatccttatacacctgccctgtcatctgatgacggcagtccgtactcgaatagaaactggcaatacctcgacggccgctggtcaaaagccgataaatcagacggaaactttatgatcagggctttggtcgactacgaagcttctgtgcctgagataacgtcgcctgaagaccggtcatttacaaacaagaagtcaatcacggtgaaaggaacggcttcaccaaaaagcgctgtccgtcttaccaataacggtaaaaccgccgcagaaacgaaagcagatgcagacggcaatttccaggccggtgtcacactcactaaagatgccaatcggctgacggcggcatctgtgacagacagcgggtcaaccgacgagtcacgccctgtcacggtcatactggatgaggataagcctgatgtgacgattgacagtccggcaaacggtgataaaacaaataaagaagcagtgactgtaaaaggaaaagtgcacgacgaccatttaaaatgggtaaaggtgaacggaaaaaaagctgaagtaaataacggttcttatcaagcgagaacccttctggaaaacggcagcaatgagatcaaggtcacggcctcagatgaagcgggtaacaaaacaacgaaaaagacggtaatcgatgtcaattacaatgctcccgtcatttccggattggttcccggagcggataaggaattaaaagccggagaatcagtgaaaatcgctttttcaagcggaaagaaattagacgcttccttcgtgatccgtctgcctctgacaaacgcccgggcagggagccaaaacgcaacagagcttccgctgagagaaatttctccgggacgatatgagggttactggacggcggcttcttccatcaaagcaagcggagcaaaaattgacgttatcgcaagagatgactacggaaatgaaacaagacagactgctaaaggaaaactttatatcaatgagtaaaacagagcgctgccagatcacggcagcgcttttttagttgaaggggacaatagaaaatcgaccttttcggccctcgacaaataaaacggttatcccttaaaaattgtactttaccctcaacattaattgacagactttcccacagagcttgctttatacttatgaaacaagagagagaaacagatatgtaagacaaaagaggaaaggggtcagatgtgaaaatctatctggatgtcatttggctgttgaacttttgttttgattctcttttgcttttattgaccgcctttattttaaaacgccaagtgaaaaaaagaagagtggccgccggcggttttatcgggtcagccattgtgcttctgatgtttacgcctgtttctccctttgtggagcatccggcgggaaaaatggcgttttcggtagtcatcgtgcttacggcttttggctttaaacggttccgatacttttttcaaaatttgttcgccttttatttcgcgacttttctcgtcggcgggggaatgatcggcgtacattccctgctgcaaacagaatcaattgtgcagcaaggcgtaatggtcacaagccagaccggattcggcgacccgatcagctggatgtttgtagttatcggatttccggccatatggtttttttcgaaaaagagaattgaagacatcgagacgaagtccattcagtacgatgaacttgtcatggtgcaggcggaattcagcggacagacaatccgcgcgaaaggattggtggattccgggaatcagctgtatgatccgctgacgaaaacgccggtcatgatccttcacattgacaaattcgctccgattctcagcgaaaaggaaacggacctcatcaaatccgccagtccgcttgaagtgatagagcagcttgatgattcgttccgtcatgcggataagctgaggctgattccatacaggggcgtcggccaggacaatcaatttttactctgtttaaagccggattacgtcacgattttaacaaaagacgagatgatcgcatgtgaaaaatgcctgatcggcatcagcacgaagccattatccgctgacggtgaatttgacggaatcgttcacccgaagatgctgacagggaaggctgtaaaacatgtttcctgacgaaaagtctgttattcatcatactcaaaacgcgttgtatttagaagggggaggaagatgaaaaaacttaagctgcgtctgacatatttgtggtataaatggctgatgaaactcggactgaaaagcgatgaagtgtattacataggaggaagcgaggcgctgccgccgcctttgtctaaagaagaggagcaggtgctcttattaaagctgccgagcggggatcaggcggcgcgggccatcctgattgagagaaacttacgtcttgtcgtttacattgcccgcaaattcgaaaacaccggcatcaatatcgaggacttaatcagcatcggcaccatcggtttgatcaaagcggtaaacacgtttaatccggaaaagaaaatcaaactcgccacctacgcatcgcgatgtattgaaaacgaaattttaatgtacttgcgccgaaacaataaaatccgttcagaggtgtcctttgatgaaccgctgaacattgattgggacggaaacgaactgctgctttcggatgtgctcggcacagatgatgatattattacgaaagacattgaagccaatgtggataaaaaacttttgaaaaaagcgcttgagcaattaaacgaaagagaaaagcagattatggaactgcgtttcgggcttgtcggagaagaagaaaaaacccaaaaagatgtagccgacatgatggggatttcacaatcttatatctcccggctcgaaaagcggattatcaaaagactgagaaaagagtttaacaaaatggtgtaaaattttttccatctgacagcccttactgctgcaaggattgccgccgccggatgtttatttctgtaaaatggcggtgcatatttttcccacccgaggagatacttaacgttgtacagcagctcctagtgggagggaaaaacgtgtcaagaaataaagtcgaaatttgcggggtggatacctccaaattaccggtgctcaagaatgaagagatgagaaagctgtttaggcaattgcaggatgagggcgatgattcagcgagggaaaagcttgtaaacggtaatctgcgccttgtcttaagcgtcattcagaggtttaacaacagaggagagtatgttgatgacttatttcaggtcggctgcatcggactaatgaaatccattgataattttgacctaagccataatgttaagttttcaacatacgctgtaccgatgatcatcggagaaatccgcagatatttgcgggataacaatccgatccgcgtctcgaggtcgcttcgcgatatcgcatataaagcgcttcaagtaagagagcggttaatcagtgagacaagcagggagccgacagcagaggaaatcgccaaagttcttgaagtgccccatgaagaaattgtgtttgcccttgacgccattcaggatccggtttcactgtttgagccgatttataatgacggcggcgatccgatctacgtgatggaccagatcagcgatgagcgcaacaaggatacacaatggattgaggagctcgctctgaaagaaggcatgagaagactgaacgaacgggaaaaaatgattttgcgaaagcgctttttccaagggaaaacccaaatggaagtcgctgaagaaatcgggatatcccaagctcaggtctcaaggcttgaaaaggcagccattaaacaaatgaataagaatatccatcaataacggaataagcctttaaaccttgtttaaaggcttttttcatgcgatggtttacgtttgcaaaaaagtgatgtattctaatgtgtaaaagtttttagaaaatttaaataaagtaaacgggggaaactgcaatgattttacagctggacagtgtgtcattaaaaagaaacgggaaatggattttgaaagatattaactggcgcgtcgagaaaaacgaaaattgggtgctgtacggattaaacggagccggaaaaacggctttgctgaatatgttatgctcttattacttccccacttcaggagagatgcaggtgctcggccatcaattcggcaaaacagagctcggtgacaggctcaggaggaaaatcggccttgtttcggcaggtcttcagcacaaattatatgccgcggactcggcttttgaaatcgccctcagcggcgcgtacgcctcaatcgggctgtacgaaactccgagtgagcaggtaagggaaaaagcgatcggtcttctgaaggatttgggcgccatcagttacgccgacagacggtatgaaacattatcacaaggggaaagacaaagagcgctgattgcgcgggcgcttatggctgatcccaaactgctgattttggacgaacccgtgacgggtcttgattttatggcaagggagcagctgctggacacgattacgtcgatcgccgaaaaagaaaatgcgccgtccatcctttatgtcacccatcacgctgaagaaattctgccggtatttgatcaggcgctgcttttaaaacaaggcgaggtgttcgcctccgggaaaatcagggacatgctttctgacgagcggcttacagcgtttttcgatacgcctgtcaatgtcttatggaacaatggccgcccgtttttaacacgtgcaaaagcggtatcatccgtcaaataacatcaattcaccctgggggtgctgctgacatgcagctgagagagacgttgtctcaacccttaacggacctgatccggatcatgccggcggagggaagcggtgaaaaaagcggaggaagatccgttttttacccgtttcattttaatgaaacgggttttttgatacagccaaaggggagatttccaatgcatcagattgatatgctgttacaccaggcggataaacggcggggcgatttaatacaaatagctgaaaggttgatcgcctttccgacaccggctccgcctgcaagaaatacaacagaagcccaaaagtgggtggccggctttttaaaagaaacgggctgctcggtcgatatgtgggatgtgtatccggaagatccgaatgtagtcggtgttttaaaagggacagattcaagcaggcatcaaagcctgattttaaacggacacattgatgtggcagaagccgggggcgaagactggaactctgacccgtttcagccgctcgtaaaagacggcatgctgatcggaaggggcgccgctgatatgaaagggggtttggcgtgtgttcttttctctctgaagctgatccatgatgccggcattaagcttccgggcgacctcattgtacagtctgtaatcggagaagaagtcggcgaggcggggacgctggaatgctgcaaacgcggctatcacgcggattttgcggttgtcgcggatacgagcagcctgcatattcaagggcagggcggtgtcatcaccggctggatagaattgaaaagcaaacaaacatttcatgacggcatgaggcgcaatatgattcatgcgggcggaggcacattcggagcgagcgccatcgaaaaaatggcgaaaatcatcactgccttgggagagctggagcgccactgggcggtaacgaaaagctatcccggcattgcgcccggcaccaatacgatcaaccccgccgtcattgaaggcggaagacacgcagcgtttgtcgccgatgaatgccggttatggatcaccgtccacttttatccgaacgaaacgcacgaacaagcagccgcagaaatcgaagactatattaatcgtgtcgctgacagtgatctgtggctcaaagaaaacaggccggtgttcaaatggggcggatcttcgatgattgaagacagaggagaggtgttcccggcgctggaaatcgatccggatcatccggcagtttctgtcttggctgcatcacactcagccgtcaaaaaacaggagcccgtcattgatgtttcccaaacggtaacagacggagggtggctttatcaggccgggattccgagcgtcatatacggccccggcgatttaaaaaacgcccactccgtaaacgaggaagtgtccgttgatgagcttatggactatacgaaaatcatgctgagatttattctcgactggtgcagccgcaaaaaagattgcccgatgtgacaaggttcagcccggccgttcatataataggaaaaagaacgggcaaagggcgtgatacggatgatcagcatatctgaatttcaaataaaagatgtggtaaacgtgtcgaacggaaaaaaactcggaagcatcggggatattgatattaacgtgacaacgggaaaaattcaggcgattattttaggcggcagcggaaaagttctcggttttttcggaaaagaagaggaaatgatcattccttggcgaaatatagttaaaattggggaagatgtcatcttagtgcgtgtaaatgaaccaaaggggggagcgtaatcctccctttacttgtaaaaagccggaaatctcaatgtttccggcacatttatttatctcatttttcaatcagccgctaaacgtatgcttaaaattgtgttaaaatgagtgggaaattacgcttttttaatgtttgtcgaaaggttggatctccatgaatacatatcacccgtttagtcttaccaccccctcggcactcatgatagaagactggaactgtgtgaatcagcttaacacaaaggtcatcgccggattcacaacgaaaaacggcggtgtcagcaatcctccgtatgagtcattaaataccggattgcacgtccgggacgaagctcatgatgttgtgacaaaccgtgaagtcatagcgtccttatgcggtactgatctggattcctgggtgttcgccgaccagacacatgaaaaccgcgtccggcgcgtgacagccggggataaaggaaaaggagcgagagactattcttccgcattccgcgggacggacgggctctacacgaaagatgcgaatctttttttggccctttgttttgcggactgtgtgcccttgtatttttatgacccggtgaaatccattatcggcgctgcccatgccggatggaaggggacggtcaaacaaatcggacgcatcatgacggaacgctgggtaaacgaagaaggctcccgtttaacagatattcaggctgtcatcggtccgtccatcagcgcgggaagttatacagtcgacgaccgcgtcatcaatgaagtgcgggcgctgccctttacggctgaatccgccatatgcgaaacggaaaaaggccagtatcagcttgatttaaaagaggtcaaccgtcttcttctgatacattgcggcattccggaagaaaacatttcagtcagcggtttatgcaccgaacgagagcatgaactattcttttcacaccgccgcgacaaagggaaaacgggacgcatgatgtcctttatcggaatgaaggaggcataagatcttgcgtgttgctgatcaattacgacatataaacgaaagaataaacgaagcatgtaacagatcgggccgaagccccgaagatgtaaccgtcatcgcggttacaaaatacgtatcagctgaaagggctcaagaggccgttgatgccggtattacaagtctgggagaaaaccgggatgccgagcttatccataagcaggaagtcatcaaaggaagcccggagtggcactttatcggcagtcttcagtccagaaaggtgaaggccgtcgttgaccgtgtatcttatattcattccttagacagactgtcattggcaaaagagattgaaaaacgggcgcagcatgcggttcgctgttttgtgcaggtgaatacttcgcttgaaccgtctaagcacggtttgaaaacagaggaggtcatcccctttatcagagagcttgctgagtttagaaacatttctgtagagggcctgatgacgatggctcccctgacagacgatacagaaacgatcagagcctgcttccggcaattgcgtgatctgagggatcaggtgcaaaaactgaatcagacaaacgcgccgtgccgggaactgtcgatgggcatgtcaaatgattatgaaatcgctgttgaagagggcgccacttttatcagaatcggctcttcattagtcggaaatgaaccggggggtgtaaacaaatgagcatgaaaaataaactgaaaaactttttctcaatggatgaggaggagtatgagtacgaatacattgaaacggagcaggatcatcaggaagagcatgaacagcagaaagataaacagcctgcttacgctcagaagccgcagggcaagcagaacgtagtaagcttgcaaagtgttcagaaatcctctaaagtggtgttgagtgaaccgcgtgtatatgcggaagcgcaggaaatcgccgatcatttaaagaacaggcgggcggttgtcgtcaatctgcagcgcatccagcatgatcaggcgaaaagaatcgtcgactttttaagcggtaccgtctacgccatcggcggcgacattcagagaatcggttcagatatttttctgtgcacgcctgataatgtcgacgtttccggcacgatttcggagcttataaatgaagacgaacatcagaggtggtaaagcaggatgattctttatcaaattttttccgttctgagttatttaatttacatctactcgtttgccctgatcatctatatctttatgtcatgggtgccgagtacgagagaaacggcggtcggacggtttctcgcagcgatttgcgaaccgtatttagagccgttcagaaggatcattccgcccattgccatgctggatatatccccaattgtagcgattatcgtgcttcggtttgccacgacggggctttggggcctataccgcatgatcgcaatgtatacttgaatgcgacagtttgatacgggcttggcaccagccaagcctctttacatagaaaggaaagaacatgagcgatatttaccagcacttcagacaagacgagcggccttttattgatcaggtgcttgaatggaaacagattgtcctggatcagtatcggatgaagctgactgatttcttagatcccagggaacaggtgattgtaaaagccgttatcggcgacgcctgcggtcttgcgtttttcggaggatatgacagagctgagcgcaaacgcgcgattttataccctgaatatatggaacctgaacaggatgattttgagctccgggcttttgacgttcaatacgctgaaaaattcgtcagcattgaccaccgctctcttctcggatcattaatggggatcggcttaaagcggcagaaatacggcgatctgattttctcagaggaagccgtgcagctcatcgtctccggtgaaatcgccgattttgtcagcactcagctgaccaaggcgggcaaagcgccggtaaagcttgagaaaatcgagctttccgctcttcacattcccgcttcagatgtcgaaataagggatgacacggtttcttcattgcgtctcgacgccgtctgcgcttcaatgagcaggcaatcccggcagaaagcgcaggcgcttgtgaaaaacgggctcgttaaggtgaattggaaagctattgaagatccgtcttatcaggttgctgaaggggacatgctctcgattcgcggcttcggacgatgcagtttggcaaaagttgacggaaaaacgaaaaaagacaaatggaaagttacatttgaacggcaaaaatgagtcgttttttcagtttttttctccatctgtgccgtatttgttttataatgtgaactagataaccgtactgaaatgtaaaaatggaggtggcaatatgccattaacgccgaatgatatccataacaaaacgtttacaaaaggttttcgcggatatgatgaagatgaagtaaatgaatttttaatgcaggtcagaaaagattacgaaatcgcactccgtaaaaaaacggagcttgaggcgaaagtgaacgagctggacgaaaaaatcggccactttgccaatatcgaagaaacgctgaataaatcaattctcgtagcccaggaagccgcagaagacgtaaagcgcaactcgcagaaagaagcgaagctgatcgtccgtgaagcagaaaaaaatgccgatcgcatcatcaatgagtcgctttccaaatcaagaaaaatcgcaatggaaatcgaagagctgaaaaaacagtctaaagtcttcagaacacgtttccaaatgctgattgaagcgcagctcgacctgctgaagaacgatgattgggatcatctgctggaatacgaagtcgacgcggtatttgaggaaaaagaataattttctgattttcttgacattcttcggcccgttcgaatataatacgttcataaattcagatgaaaagacgattgaaagggaccggcatgactcaaaacaggctataaagcgaaccggggaaggtgaaagcccgggatggccggaatcatgcagatcagccctttagtttcctttctgaaccgagagtaggaaaggacgttccatcacgttacgatgttcgagaggaaaagacggatgatccgttttttctaaaagggtggtaccgcgagataagctttctcgtcccttatgggatgagagggctttttttattttctgaaaaatgttgtggaggaatgaaaatggattacaaagatacgctgttaatgccgaaaacagattttccgatgcggggaaatctgccgaatcgtgagccggacatgcaaaaagactgggaggagcaggatatttaccgtcttgttcaagaacggacgaaagaccgcccgaaattcgtgctgcatgacggacctccttatgcaaacggagacatccacatgggccatgccctgaacaaaatcctgaaagacttcatcgtccgctataaatcaatgagcggctacaacgcaccgtacgtgccgggctgggatacgcacggactgccgattgaaacggcgctgacgaaaaacaaaaaagtaaaccggaaagaaatgtccgtcgctgatttccgcaagctttgcgaagattatgcatggcagcagatcgaaagacagcgcgaacaattcaagcgtctcggcgtcagaggcgattgggaaaacccgtatgttacgcttcagcctgaatttgaagcgcagcagatccgcgttttcggcgagatggcgaaaagaggctatatttataaaggtctgaagccggtcaactggtcgccttcaagtgaatctgccttagcagaagcggaaattgaatatcaggacaaacgttccgcgtctatttatgttgcgtttaaggtgaaagacggtaaaggcgttctggaaaacggagaaagcttcatcatctggacgacgacgccgtggacgatgcctgccaacctcggaatttccgttcatcctgatcttgaatacaatgtcatcaaggttggagacaagcgttatgtagtggcggctgaactgatcgaaaatgtagcggaggcatgcggctttgaaaatcctgaagttgtcgcatcatataaaggcagagaattagaatacatcactgcagaacatccgctgtacggcagagattcactcgtcatgctcggtgaccacgtcacaaccgatgccggaacaggctgtgttcatactgccccgggccacggggaagatgactttatcgtcggccaaaagtacggcttagaagtactgtgccctgttgatgaaaaaggaaacatgaccgacgaagcgccgggctttgaaggaatgttttacgataaagccaataaaccgatcacggagaagcttgaagaaaacggcgcgctcttgaaactcgagtttattacacactcctatccgcatgactggagaacgaaaaaaccgaccatcttcagagcgacagcgcaatggtttgcgtcaattaaagatttcagatccgatctgcttgatgccatcaaacaaacgaagtgggtgccggagtggggcgaacagcgcctttacaacatggttcgcgaccgcggtgactggtgtatctcaaggcagcgcgtgtggggtgttccgatcccggtattttatgcagaaaacggtgagccgatcatcactgacgaaacgattgaacatgtgtctgagctgttcaaacagcacggctcaaacgtctggtttgaaagagaggcaaaagacctcctgccggaaggatttacacatccgggaagcccgaacggaatcttcacgaaagagcaagacattatggatgtatggtttgattcgggttcttcccatcaggccgttcttgaagaacgagatgatcttgtccgtccggctgatttataccttgaaggctctgaccaataccgcggctggtttaactcatctctttccaccgctgttgcagtcaccggcaaagcgccgtataaaggcgtattaagccacggatttacacttgatgcaaacggccgtaaaatgagtaaatcactcggcaatacgattgacccgacaaaaatcgcaaaacagcttggagctgaaattctgcgtttatgggtatcttccgtaaactatcaggccgatcacccggtttctgaagatattctgaagcaggtcgcggaagtataccggaaagtccgcaacacgttccgcttccttcacggcaacctgttcgatttcgaaccaagcgtcaatgccgtggatgtaaaagatctccgcgaagtggatcaatatatgctgatcaagctgaataagctgatcgataaggtgaaaaaagcgtacgatgaatacgaatttgcggttgtttatcacagcattcacaatttctgtacgatcgagctcagctcattctatcttgattttgcaaaagatgttgtgtacatcgagcatgcggatcatccggaccgccgcagcatgcagactgtcttttatgaaacgctgctggcgttagtgaaactgacggcgccgattctcccgcatacggcggatgaaatgtggtctcacttatcatttgttgaagaagcgagcgtgcagctgacagatatgccggaaaccattgctgttccggacagtcaagcgacagaagaaaaattcgatcgcttcatggagcttcgaaacgacgtgctgaaagctttggaaacagcccgtaacgaaaaaattatcggaagatcattggaagcgagcctgactttgtatccgaacaaagaaaaccgcgacctcttgtcatccattaaagaaaacatcgcgcagctgtttatcgtctcagaactgacagtaaaagacgaaagtgaagcgccggaaaacgcgcaaagcttcacaacaggaaaaatgaccgtagaaaaagcggaaggccagatgtgtgagcgttcccgcataatttctaaagatgtcggagccaatccgaaatatccgacattatcactgcgcaatgcggaaatcgttgaaaaatattatcaaaaataataaatgagaaagcgcccggtgtcagccgggcgcttttttacatgccagcaatgtcatcgattagaacggcaggaaaattcttatgggcttcaaatggcgctctgagggcaacaataaagctataacatcaaaagcaggagttgtgatgaatgaatgatcaactgaccgcaatccacacggagcttctcatgatgaaagaagaacttcaatcaagattattcgaatattcttgctttcaaatgtcagcatctgttgaaccttcaatgaacgaccaagaagcaactctgatctatcatataaaagaagaacttcaggatgttcttcttgccctgtctaagtttgaaaacaatacgtacggttattgtgaaaaaacaggcgcccccattccgattgaaaaacttgcggtgttgccgacggccagaaccgctgatgatttttattatcccgctcaatttgaaaagaaaacccttccatattgggaacccggagattatgcatatgatcaggcgctgtatgagtgacagcgtctgtttgtatacgcttatgatctgcctttactctggcatcttttactgataaaattcataaaggataaaagtaactgtatactggaggaacgtgtgtgctttattatcttatcgctctttttattattattgccgaccaattgaccaaatggcttgtcgtcagccatatggaattgggacaaagcatacctgtcatcgaccaggtgctttatatcacatctcatcgcaacacgggagcggcgtgggggattttagccggccaaatgtggtttttctacgtcattaccatcgccgtgattatcggaatcgtttattacatacagcgttatgcaaaagggcagatgttactcggaatttctctcggcttaatgctgggaggtgcggccggaaactttattgaccgggcggcgcgccaggaagtggtggattttattcatgtcatcatcgtggattatcactatccgatttttaatatcgcggactcctcactgtgcgtcggtgtaatacttttatttattcatatgctgtttgacagcgggaaaaagaaggagcaataacatgaatcaatttgagataaccgttcagcctgaacaaaagagcgaacggattgataaatttttggcttcaacgggagaaaactggtcacgcactcaagtgcagcaatgggtaaaagagggactggtatccgttaacggcaaatccgtaaaagcgaattataaaatgcagcccggcgatcaggtaaacgtcaccattcctgaaccggaagaattggacgtgcttgcagagccgatggatttggacatttactatgaagaccaggatgtcttggttgtgaacaaaccgcggggcatggtcgtacatccggcgcccggccatgtgacagggacgctcgtaaacggactgatggctcactgcaatgatctttccggcattaacggcgtcatgcgcccgggaatcgtccatcggattgataaagatacctccggcctgttaatggtcgccaaaaacgatatggcgcatgaatcactcgttaatcagctcgtcaataaaaccgtgacgagaaagtacacagcggttgtccacgggttgatttcacatgatgacggaacgattgacgctccgatcggaagagataagaaagaccgtcaaagcatgaccgtaacaagagaaagcagcaaaaatgccgtcacgcatttccacgtgcttgagcgttttcaagacttcacgctcgtagagtgccgtcttgagaccggaagaacgcatcagatccgtgttcatatgaaatatatcggatttcctttggcaggcgacccgaagtacggaccgagaaaaaccattgatttcaacggtcaggcgcttcatgccggaatattaggttttgaccatccgcggacgggcgaatacatggagtttgaagcgccccttcctgaagatatgaaaaaactcattgaacatttgagaaatagccattgacagcgagtttcttttctggaataataaaaacaagctgaatagattctttaacacagtccagagaggctgagaaggataacggataggacagaagagatacacgtgtgtcttcgtcctggaaaggaacccctctatgctctggcaggaggggttttttcttcttatatacgaatggagaggtgtcacgagtgaatcaaaaagctgttattctcgacgaacaggcgatcaggcgggcgctgacaaggatagctcatgaaatgatcgaacggaataaaggaatgaatgactgcattcttgtagggattaaaacaagaggtatttatttagcgaagcggctggccgagcggatcgaacagattgaaggaaatccggtcaccgtcggggaaatcgatatcaccctttaccgtgacgatctcacaaaaaaaacgagcaatgaagagccgcttgtaaaaggcgcggacattccggccgatatcacagaccaaaaggtcattgtggttgatgatgtgctttataccggccggacggtgagagctgcgatggatgctctcgttgatgtcgggcggccgtcatcgatacagcttgccgtgcttgtcgacagaggacaccgggagctgccgatcagagcggactatatcgggaaaaacattccgacctcaaaagctgaaaaagtgatggttcagctgagcgaagttgatcagactgatatggtcgccatttacgaaaatgaataatcaccctttttaaatgcattccagagagtttgcaaagaggattttaaaacacaaagccgggcggatcgacgcggccgggctttgtatgcctctttgcgcaaaaagcaaagaggtttttttataccatttgaaagtcaaccgggaggaaaacgccatgagtaagaaaaaagtaaacctgggagtcagggacgtccccaatccattgtcctggctgtcattcagcctgcagcatttattcgccatgttcggttcaaccatactcgtgccgaaactggtcggaatgagcccggcagtggcgcttgtcacgagcggaatcgggacactcgcctatctcttggtgacaaaaggccagattcccgcttatctcggctcatcattcgcctttatatcaccgattatcttggtgaaggcgacgggagggccgggggctgccatggtcggcgctttcctggcggggattgtgtacggcctgatcgcactgctcatcaggcagcttggaacggggtggctgatgaagctgctgccccccgtggtcgtcgggccggtcatcatcgtcatcggcctcggactggcaagcacagccgtcaatatggcaatgtatgctgatccgaatgcgaaggaactcgtctacagcctgaaacatttcagtgtagccggcgtcactttggccatcaccattatctgcgccatctttttacggggatttttaagcttgattccggtattgatcggcattataggcggatatctgtttgcgctgacacagggcatcgtcaattttcagccggtcattgatgcaaaatggttcgccgttcctgaatttatcatccctttcaaagactacacgccgtcagtgacattgggcattgccgctgcgatggtgccggtcgctttcgtgacgatgtcagaacatatcggccaccaaatggtgctgagtaaagttgtcggacaggatttcattaaaaagccgggactgcaccgctccataatgggggacagcgtagcgacgatcatcgcttcgttaatcggcggcccgccgacgacaacatacggcgaaaacatcggtgtcctggcaattacgagagttttcagcgtctttgtcatcggcggcgcgggagtgattgcgctgtgcttcggatttatcggcaaagtttcagcgctgatcagctctgttccgtccgcggttatgggaggcgtttccttcctgctcttcggaattatcgcctccagcggcttaagaatgctgattgacaacaacattgattatgaaaacaagcggaatttaattatcacatccgtcatcctcgtgatcggcgtcggaggggcttttattcaagtatcaaaaggcgggttccaaatatccggcatggcgcttgcggcaatcgtcggagtcatcctgaaccttatcctgccgcatgcaaatgaagaagacgcgattgcatcagaaaaacaaaatcatatgtaaaccttttaaagaaagtccagagaggcttggaagggttataacgggaagaagctgtacggctcttctctctttaaccgcaccccgagtctatagaccggggtgttttttacggccttcaagcggaaacggaggagaaaaaacatgaatcatttaacggcgatgtctgaactgagcgcggctgaaattacagaactgctgcgagaggcaaaagcgataaaagagggtgcagtccgtcccgatctcgcgggaaaattcgttgcgaatctgttttttgaaccgagcacgagaacgcggttcagctttgaagtggcggaaaagaaactcgggatgaacgtgctcagcttagacggcacgagcacaagcgttcaaaaaggcgagtccttatacgacacggtcaaaacactggaatcaatcggagcggatgcctgcgtcatcaggcacagcacggatgaatattacaaagatctgaccggcagagtcaatattccgatcttaaacgccggcgacggctgcggccagcacccgactcagtcattgctcgatttaatgacgattcaagaggaatttgagacctttcagggcctgacggtttccattcatggcgatatcaaacacagcagggtggcaaggtcaaatgccgaggtgctgacaaggctcggcgcacgtgtgctgttttctggtccgccgcagtggcaggatgagaaaaacgccttcggcacctgtgttcagacggatgaagccatacaagcttcagatgtcgtcatgctgctccgcatccaaaatgaaaggcatcagacagaagccgaccaaaaaggctacctggaagcatacgggctgaccgcaaagcgggcggagagcatgaagcggcatgccatcatcatgcatcccgcaccggtgaacagaggagtcgaaattgacacaacattagtggaatgcggaaaatcaagaatctttaaacaaatggaaaatggtgtgtatatcagaatggcagtattaaaaagagcactgcaaaccaatgtgaaaaggggagaagcggcttatgtcttatctcattaaaaacggctggatgttaaatgaacagggagaaaaagcggcacaggatatccgggtaacgggtgaattcatttcggaaaccgggcttctgacagcgaaagacggagaaacggtgatcgacgctgagggactgttcgtttcacctgggctcgtagaccttcatgtccacttcagagaaccgggcggcgagaaaaaagaaaccattgagacgggctctaaagccgcggtgcgcggcggttttaccacagtcgccgccatgccgaatacaagaccggtgccggatacgaaagagcagatggaatggctgcaaaacaggatcaaagaaacctcatctgtcagggtccttccttacgcatcgattacgatcagacaaaccggcgaagaaatgacagattttgaggcgcttcatgaagcgggcgcattcgccttcaccgatgacggcgtcggcgttcagacggccggaatgatgtatgaagccatgaaacgggcggcttcaataaataaagcgattgtcgctcattgtgaggataactcgcttatttacggcggaagcgtgcatgaaggatctttttcaaaagcgaacggcctgaacggcataccttccatttgtgaagcggtacatattgcccgtgacgtcctgctggcggaagcggcgggctgccattaccacgtgtgtcatatcagcacgaaagaatccgtcagagccgtaagagacgcaaaaaaagcgggaatccgcgtgacggccgaagtatcgccgcaccacctgctgctttgtgacgaagatatcccgggacttgataccaattttaagatgaatccgccgcttcgcagcaaagaggacagagaggcgctgattgaagggcttttagacggtacgattgatttcatcgccactgaccatgcgccgcatacagaagaagagaaaaacacggacatgaagcttgcgcctttcggtatcgtcggtttagaaactgcctttccgcttctgtacacacattttgtgaaaaacggggcgtggacgctgaagcagctggttgatttcatgacggtaaaaccttgcgaggcattcggtcttccgtacggaacgcttgcaccgggggcgccggctgacatcaccctgattgatctggaaaaagaagcggccattgacaaagatacatttttatctaaaggaaaaaatacgccattcaacaagatgaagtgcttcggctggcctgttgcaacgatggctgccggtaaacttgcatacgaagaagggagactcgtcaaatgaaaagaagactagtgctggaaaatggagcggtatttgagggtgaagcattcgggagcctggagcatactgcgggtgaagtcgtattcaacacgggaatgaccggttatcaggaaattttatcagacccgtcttactgcgggcagatcgtgacgctgacgtatccgctgatcggcaactacggaattaacagagatgactttgaatccatcactccttttgtaaaagggctgatcgtaaaagaactgtgcgagctgccttccaactggcgttcggcttacacgcttgacgagtatctgaaaatgaaaaatatccccggcttacaagggatcgacacgcgaaaactcaccagaatgatccgcacggccggcgcattaaaaggaacgtttgcttcaagtgaggagaatgtcggagaggttcttgcaaggctgaaagaaacggaactgccgagaaatcaagtcgctcaagtatcggcgaaaacggcatatccgagtccgggccgcggcaaacgcatcgtgctcgtcgatttcggtatgaagcacggcatcttaagagagttaaacaaaagaaaatgcgatgtcatcgttgtaccgtacaatgtaacggcggaagaagtgcttcagctcaagccggacggcatcatgctttctaacggacccggagatccgaaagatgtgccggaagccattgaaatgataaaaggcatactcgggaaggtgccgttattcggaatctgcctcggccaccaattatttgcgctggcatcgggagcggaaacggaaaaaatgaaattcggacacaggggttccaatcatccggttaaagagcttgcgacagggaaagtcgctttaacagcccaaaaccacggatatacagtttcttcaatagatgagacagagcttgaagtgacgcatattgcgatcaatgatcaaacgatcgaaggactcaagcataaaacattgccggcatttacggttcagtaccaccctgaagcttcaccggggccggaagacgccaatcaattatttgacagattcattgacttgatcgaaacaactgagaaagaaggggaagcggtatgccaaaacgcgtagatattaaaaagattttagtgatcggatcaggcccgattattatcggacaggcggcggaatttgattatgcgggcacacaggcgtgtctcgctttaaaggaagaaggctatgaagttattctcgtcaactcgaatccggcaacgattatgacggatacggaaatggctgatcgggtatacatagaaccgctgacgccggagtttctcacgcgtattatcagaaaagaacggccggacgccatcctgccgactctgggcggacagaccggactgaatcttgccgtcgagctgtctgaactcggggttcttgaggaatgcggagtggaagtgctcggcacaaagctgtccgccatccagcaggcggaagaccgcgacttattccgtacgctgatgaatgagctgaatgaaccggtgccggaaagtgagatcatccgcactttacaggaagccgaggaatttgtcggccggatcgggtttccggttatcgtgcgccccgcttacacattaggcggaacgggcggcggcatctgctctaatgaagcagaactgaaagagatcgtcgaaaacggattaaagctcagccccgttcatcagtgccttctggaaaaaagcattgccggttacaaagagatcgaatatgaagtcatgagagacagcagagatcacgcgatcgtcgtctgcaatatggaaaatatcgatccggtcggcatccatacgggcgacagcatcgtcgttgccccgagccagactttgagcgaccgggaatatcagcttttgcgcaatgtttcattaaagctgatccgcgcgctcggcattgaaggcggctgtaatgttcagctcgcgctcgatcccgacagcttccaatattacattatcgaagtgaatccgcgggtgagccgctcatctgccctcgcttcaaaagcgacgggttacccgatcgcaaagcttgcggcgaaaatcgcagtcgggctttctcttgatgaaatgatgaaccccgtaacgggaaaaacatatgcggcttttgagcccgcgcttgactatgtcgtttctaaaatcccgcgctggccgttcgacaaatttgagtcggcaaaccgcaggctcgggacgcaaatgaaagccaccggagaggtcatggccatcggacgcacccttgaagaatcgctgttaaaggcggtccgctcactggaagccgatgtctatcacctggaactgaaggatgcggaagagatttctgacgggcttttggaaaaacggatcagaaaggccggagatgaacggctgttttatctcgcagaagcgttcagaagaggctacacagtggagcagcttcatgagttttccgcaattgacgtattctttttgcacaagctctctaagctggtcgcttttgaaaccgagctgaaagcggaaaaaggcagcctcgccgtcctgcagacagcgaaggaactcggtttctccgacaaatatatcagccgggaatggaatatgccggaacaagagctgtatcaaatgcgaaaagaagcagccatcaagcctgtatataaaatggtggatacatgcgcggcggaattcgaatcagaaaccccgtatttttacagcacatatgaggaagaaaacgagtctgaggtaacatcaagaaaaagcgtcgtcgtcctcggttccggcccgatccgcatcggacagggcgtcgaatttgactatgcgaccgttcattctgtctgggccatcaagcaggcaggctatgaagcgattattatcaacaacaaccctgagacggtgtccactgatttcagcatatcagacaaactgtattttgaaccgctgacggtagaagatgtcatgcacatcatcgatttggaacagccggaaggcgttgttgtccaattcggcggccagacggcgatcaaccttgcggaagaattgagcgcccgcggcgtcaaaatcctcggtacatcacttgaagatttagaccgtgcggaagaccgggataagttcgagcaggcgcttgaggcgctgaatgtgccgcagccgctcggaaaaaccgccgtgtcggtgaacgaagcggtcaaaatcgctgcatccatcggctatccggtacttgtccgcccttcgtatgtgctcggcggccgggcgatggaaatcgtctatcacgaagaagagctccttcactatatgaaaaatgcggtcaaaatcaacccgcagcatccggtgttaatcgaccgttatctgacggggaaagaaatcgaagtcgatgccgtatctgacggcgaaacagtcgttattccgggaattatggagcatatcgagcgggccggcgtccattcaggggattcaatcgccgtctatccgcctcagtctttaagcggagacattaagaaaaaaatcgaacaatacactgtagccttggcaaaaggccttaacatcatcgggttgctgaacatccagttcgtactttcgcaaggtgaggtgtatgtgcttgaggtaaatccgcggtcaagcagaaccgtgccgttcttaagcaaaatcactaagattccgatggcgaatctggcgacaaaggtcattctcggccaaaagcttgctgatttcggctatcaagaggggctgcagcctgaacagcagggggtattcgtgaaagcgcctgtcttctcattcgcgaagctgagaagagtggatattacgttaggccctgaaatgaagtcgacgggagaggtcatgggcaaagattcaaccttggaaaaagcgctctataaagcgctgattgcctctggcattcaaatcccgaactacggctcagtgctgttgaccgttgctgataaagataaagaagaaggactgctgatcgccaagcggttccacgccatcggctataaaatcttggcgacggaaggaacggcggcttatttgaaagacgctcagattccggctcaagtcgtcgggaaaatcggcgaagaagggaaaaatctgctcgatgtgatcagaaacggcgaagcgcaatttgtcatcaatacgctgacaaagggcaaacagccggccagagacggcttcagaatccgccgcgaatccgttgagaacggagtcgcctgcctgacatctttagatacggccgaagccattttgcgggtattggaaagcatgacattccgggcggatcatatgcctgcatccgaaaccaatcaaaaggcggcagtcacgatatgaaaaaagcgcatttgactgttcaatccaacttagaaattgccgaccggatttataagatggtgctgaaaggagagcttgtccggcaccttaccgagccgggtcaatttcttcatctgaaggtgagtgacgcggtcacaccgctattaagaagaccgctcagcattgcggacgtcaatttcgccgcggatgaagtatccgttatctacagagctgacggtgagggaacgcgtcttttgtccgggaaaaaagagggcggcaggatagacgttctcggccctctcggcaacggatttcccgtccggcggattgaacccggcaaaaccgcgctgttagtcggaggcggagtgggggttccgcctttgcaggaactgtcaaagcgcctgacggaaaaaggcgtaaacgtcattcatgtgcttggatttcaatcagcaaaggatgttttttacgaacaggaatgccgtgcgtacggagacacctatgtggcgacggctgacggaacatatggagagaaaggatttgtcaccgatgtcatccgtgaaaagcagctcgaattcgatgtcctgctaagctgcggaccgacaccgatgctgaaagctctgaagcagcagtacggccataaagaggtttatctttcgatggaagagcggatgggctgcggcatcggggcctgcttcgcctgcgtgtgccgcacgggtgaaagcgatacatcctatgtaaaggtctgcctggacgggcctgtatttaaagctgaggaggtggcgctgtaatgttagaggtgaatctgccgggtctccaattgaaaaacccgatcatccccgcttccggatgtttcggtttcgggaaagaatatgccggattttacgatttatcatgcctcggaggcattatgattaaagcaacgacgaacgaagcccgcttcggaaatccgacaccgagagtggcggagacaagcgcgggaatgctgaatgccatcggactgcaaaatcccggccttgagcatgtgctcaatcatgagctgccttggctcgaacaatttgacacgccgattatcgcaaatgtcgccggttctcaggtggacgactataaagaagtggccgagcacatcagccaagcgccgaatgtgcatgcgcttgagcttaacatttcatgtccgaatgtcaaaacgggggggattgcttttggtactgatcccgtcatggcggccgaactgacaaaagcggtgaaagaagtttccgcagtgcctgtgtatgtgaagctttcgcctaatgtcgcaaacataaccgaaattgccaaagcgattgaagcggccggtgctgacggtctgacgatgattaatactctcatcgggatgaggctcgatctcaagacgggccggccgattttagcaaataaaacgggcggactgtcaggcccggcgatcaaaccggtcgccatccggatggtatacgaagtcagccaggccgttcaaattccgattatcgggatgggcggcgttcagaccgcagaggatgcattagaatttcttcttgcgggagcgagtgcggttgccgtcggcacggcgaacttcgtcaatccgttcgtctgcccggaaatcatagaacagctcccccgtgtgctgcgccaacacggctttcaatctgtaagtgaatgcatcggaaggagctggaaacatgaaaaacaacctgcccatcatcgcgcttgattttgcatcaggggaagagactttaacgtttttagacttgtttgaaaaggaaaggctctttgtcaaaacggggatggaacttttttatcaggaaggccccgccatcattcaccaattaaaagaacggaactgtgatatatttttagatttaaagcttcatgatatcccgactacggtcaataaagcgatgaagcggctggcccgcctcggcgttgatctcgtcaatgtgcatgcggcagggggcgcacgcatgatgcgcgcggcccttgaggggcttgaagaaggcacgccggcaggcagaaaacgcccgtctttaatcgcggtgactcagctgaccagcacttcagagcaggtggcgaaggaagagcttctgctgcataagccgctgttagaaacggttgtgcattacggcaaaatggcggaagagtgcgggctggacggagtggtatgttcggtccatgaaacaaaagccatttatgaagcggtccggccttcatttctgacagtcacgccgggcatccgcacggccagtgacgcagctgacgatcaagtccggacggcgactccgtcatttgcgaaagaaaacggttcgtcagccatcgtcgtgggccgctcaattacaaaagcggaaaaccccgttaaagcatatgaagcaattaaactggaatgggagggcgttcgccgatgaaacaggctatcgcaaaacatctattacacattgaagctgtctttttacgtccgaatgagccgtttacgtgggcgagcggcattttatcaccgatctattgtgacaaccgtctgacattgtcgtatccaaaagtgagaaatgatgtggcggacgggctcggcaaactgctgaaggagcatttccccgaggcggagatgatcgcgggcactgcaacggcgggcattccgcatgctgcgcttctcgcagaccgtacaggcgcgccgatgtgctacgtcagaagcaaaccgaaagcgcacggcaaaggaaatcaaatagaaggcgccattaagaaaggacaaaaaacagtcgtgattgaagacttgatttctaccggaggcagcgtgcttgaagcagcggcggcccttcaaagagagggcgcggaagtcctcggcgtcatttccatttttacatacggactgccgaaagcaaaagaagcctttaaaaaagcgggtcttccttattactcgttaaccgattatgacacgctgattgaagtcgcgcttgaaaacggaacgattcattcagctgacattgaaaaactgaaatcatggaaactgaatcccgagtcaaaagattggtttaaaaaataatgacaataaaaacaggcctcagggcctgttttattattcctatcaaaaaactcgggttgacttctgttagaattgtgctaaaatttagtacaaatctaaaaagcttatcaagagcggctgagggactggaccgatgacgcccggcaacctgcgtgtattgcaaggtgccgcatccagaaaaatgcacagcattttgaagataagggctataccgggtcactgtctttcattccgctggattgaaagttttttatataaaaaaaagattgagggataagacaaccggcagagaacaacagctgtttgattgtctccgggaggaggaaagaaaaaatgctaacgtatgacacatgggaagagccggcgattacatttccggaagacgattcctataaaggcgcgctgtccgttttaaaatgggcatacggccactacggagaccagcttgtttacgcgtgcagcttcgggattgagggcatcgtcctgatcgatttaatttctaaagtaaagaaagacgcggaaatcgtgtttctcgatacgggtcttcactttaaagaaacatatgaaacgatcgaaaaagtgaaagaacgttacccggggctgaacattatcctgaaaaagcccagccttactctcgaggaacaggccgaggctcacggagataaactgtgggaaagagaaccgaaccagtgctgctacatcagaaaaattctgccgttaagagaagcactcgcagggcatccggcatggctgtccggccttcgccgggatcaagggccgagccgggcgaatacgaatttcctgaataaagacgacaagtttcaatcgattaaagtatgcccgctgatccattggacatggaaagacatctggagatatacttccaagcatgagctggattacaatatcctccatgatcaggggtatccgagcatcggctgtgaaccgtgcacttcacctgcgtttaccgcggaagatttgcggagcggcagatggaacggcatggcgaaaacagaatgcggactgcatgaataaaggagctgcccgatggaattagccgctattttattctgtctgttttttgccatgaatatcggagccagcggagccgcggcatcaatgggagttgcttacgggtccggcgccgttaaaaagaaaacgtatgcgctgatcatctgcgcggccggagtcctgtcaggggcggttatcggcggcggtgaagtcgttaagacgatcagcggcggaatcattcccgaacaaaccattacgctcaccattgtctgcattataatcggagcggcggcgctatcgttattcacggcgaatgtgctcggcattccgctgtcgacgagtgaggtcactgtcggggcgattgtcggtgtcggcgtcgcgtacaaagtattgtttttacagcatcttttggtcatcgtgattttttgggtgctcgtaccgttcgtcgcgttctgtttcacttttctcgtatcgaaggtattcagttctctgaatattcgagtcatttcgaaacggaaacagaagattttagggattgtgctgctttttgcggggttttgggaagctttttcagccggaatgaacaatgtcgcaaatgcggtgggccctttggtggcagcgggcgtactcagcgtgtcaaaaggaacgctgtacggaggcatctttgtcgctctcggcgctctgcttttaggacgtaaagtgcttgaaaccaacgggaaaaagattacgaggttttcagccggagaaggcatactgctttcaggaaccggcgcggggcttgtcattatcagttccgtcttcggtctgccggtcccattggcgcaagtcacatcatcatcaattatcggtatcggaatggccaaaaacgggccgaacgtttttcataaagaagtcgtgaaaacgatgctcaaagtttgggtcgtttcaccgtttttgtcactgtcgatttcgtatctgcttgtttccctgctgttaaaaggagattattattccatctttatgatggccagcgtacttttggcagctggcggagccgccagtctgatgaaagccatccgaaaagagaaacgctctgtccatgaacaaggcgggggcatttaactattaatctgagtttatttatctgttaactgggaggaatcatgtattatgagtttagcaccgcacggaggaacattaattaatcgggtgaatgagcagtatgatcttacatccgtccacaaagaaattgagcttgatttgatttcgttcgctgatttagagctgatcgggatcggggggtacagcccgattgaaggatttttcacagaaaaagattacgtatcagtcgttgaaaatatgcgtctggcatcaggggttgtctggtccctgccgatcacgcttccggtcgattcagaaaaagcggctgagcttgccgtcggcgacacggtgaaactgacttacggcggagaaacatacggcgtcgtcgacatcgaagatatttatacgccggataaacaaaaagaagccgttcacgtatataaaaccgatgatgccgcgcatccgggcgtgaaaaaattattttcacgcggcgatacgtatgtcggcgggccgatcacattaattaaaaaagcgtcaaagcagtttcctgagtttacatttgaacctgccgatacaagacgaagcttcgaagaaaagggctggaaaaccatcgtcggtttccaaacgagaaatccggtccaccgcgcccacgaatatatccaaaaaaccgcgcttgagacggttgacggcctgtttttgaacccgctcgtcggtgaaacaaaatcagatgacattccggcggatgtcagaatggaaagctaccaagtgcttctcgatcattattatccgaaagaccgcgttttcctcggcgtgtttttggcggctatgcggtatgcggggccgagagaagccattttccacgcgcttgtccgcaaaaactacggctgcacgcattttattgtcggccgcgatcatgccggcgtcggtgattactacggcacatatgaagcgcaagagctgtttgatcaatttacagcggatgaactcgggattacaccgatgaaattcgagcacagcttcttctgccagaaatgcggcaacatgggaacggccaaaacatgccctcatgacagagaagaccacgtcattctgtcaggaacaaaggtcagagaaatgctgcgaagcggcgtcatgccgccggcggaattcagccgtcctgaagttgtcgaggtgttgattaaagggctgaaaacgaaagaagaagcaggcgtttcttaaggaggaaaatagagtgacaaatcgtgatatcgtatggcatgaagcctcaataacgaaagaagaataccagcagaaaaacaagcataaaagctctatcctctggctgacgggcttaagcggttcagggaaatccacaattgcaaacgccgcagcgcgcgagttgtttgaacagggctatcaagtcattgtgcttgatggtgataacatccgccacggcttaaacaaggacttaggtttttccgatgatgaccgcaaggaaaatatacgccgcatcggggaagtggcgaagcttttcgttcagcagggaaccatcgtcatcacggcttttatttctcccttccgtgaggacagagatcaggtgagagagcttgtggcagagggcgaatttaatgaaatctacgtgaaatgcgacctcgatatatgtgaaaagcgcgatccgaaaggtttatataaaaaagcaagaaatggtgaaattccgttctttacggggatcgactcaccgtatgaagagccgaaagcgcctgagctcgtacttgattcaggcaaatttgaacgtgaagaatgcaccggaagactggttgactttgtgaaaaacagcttagcataataggtccaaaaaggccgcgcaatcagccggatatcccccgcaatggcgggatatggtaaaatagctgaagtgcggcctcgcggctgttctgggaagatttcaaaacggatcggggagacatgctatggggaaagtatttatcgttggagccggtccgggagatccggacttattaacggtgaaggcaatgaaagccatacagaaagcggacgttatattatatgacagattggtaagcaaagagattttacagtacgccggagaagaagcggatctgatttactgcggcaagctcccggattttcacattatgaaacaggatacgatcaaccgtttccttgtgaagtatgcgaaaaaggggaaaaccgttgtaaggctcaaggggggcgacccgtttgttttcggccgcggaggcgaagaagcggaggctctcgcacaaaacgccattccgtttgagatcgttcccggcattacatcaggaatcgcggctgctgcttatgccggcattccggtgacgcacagagaggcgagctccaatgttgcattcgttacggggcattataaacaagaagacgactttgaagaaaaatggaaagcgctggcgacgggcattgatacgctggtgatttatatgggaattaaaaatatccggcagattgaaagaatgctgctggaaaacggcagagacggcggcactccggcagcctttattcattggggaacgacggacaggcaaaaaacagtcgtctgcaccgtcggcacgctttcagatacagtgataaaagaagaaatcaaaaacccgagcttaattgttatcggtgatgtcgtcaattatcactgcaaactggactggtatgcatctgaacagaaaaatccggatttgagcgaggcgttgtaaatgaagcaggcgattttatacatcgggcacggaagcaggcttaaaaaagcgcagacagagtcggcggcgtttttaaaagggtgtctgccgcacgctgacgctcccattcaggaaatctgttttttagaactgcaggaaccgtctattgaagcgggttttgaagcttgtgtcagacaaggcgccactcatattgcggccgtgcctttgctgctgttgaccgctgcccacgcaaaacatgacattccggctgaaatcgaccgtgcggcggccctgcatcccggtataaaagtgacatatggtgttccgatcggagtggacgatgaagtcgtaaaagcggtccatcatcgcattgaagataccggagtgcccattgagcaggcgaaagtggtgctgatcggaagaggaagcacagatccggccgttaaaaacgcagtcagtgagattgccggaaaacttgaggcgattacacctgttaaagaagtcatcccttgttttttaacagcatgtgacccgcactataaagaagtgtttgccggccttgaagaggatgacggagcacccgtttttatcgttccatatcttctgtttaccgggcttttaatgaccgagattgaacgggaagttcaaaagcttcaaacgatcaatcaaaatgttcatctcgcttcatacttaggttttcacccgcatattaagcaggcgtttttgaaccgtgtgacagaagctgtccgaaaccccggcggtcagtttgattttaaggggggacagtatgctgcctctgcacattaatttaagcggaaaaagaattatcatcgcgggcggaggcaatgttgccttaagaaggctcaaaacagtgcttccggaaggcgcggatattactgtaatcagtcccgaggccctgcctgaaattaaacagctggcagatgaaggacgtatccgctgggtttcccgtaaaattgaaatgaaggatctcgcgcccgcttttttcatcattgccgcgacaaatgaccgcagcgtgaatcgggagatagccgcgggcgcttctgaaacgcagctggtcaattgtgtaagcgaggctgaacggggcagcgtgtatatgccgaagatcatccgcaaagggcgcattcaagtatccgtatcaacaagcggcgcaagcccggcacatacgaaaagactggctgaggacataaagcctctcattactgctgatttggctgaagaagtggatcaattatttgagaaaagaagaagatcataaaaaacaccttgtctgtcatcaggcagggtgttttttatactgtcctgacagtccgccgaatgtgaaaaattcaaaacgaaagcggtcaggattgcgaagtgatgaggaatatgtatgtgatcccgatgccgcctggattccgcccgcatacaaaggaaaggtcagagacccgcccggatgtgctcaggttcggagagggaaggtgaaagtatccgccgccaaatcaggtgtgaccgttttaatcacagacggcccggcggatcaggcagacatgacgggaaactgatcagatattgtaaagatgattctgacggctgggagagtttcgtctccgtttatacgtaataaaaaacacctccaagctgagcgcgggtttcagcttggaggtgcgtttattttttcagccgtatgacaaggtcggcatcaggtgtgacaaatacggtatgctggctgtcataggtgacaaatccgggctttgcgccgtttggctttttcacgtgtctgatttttgtataatcaaccggaacggagccggaatctttcgctttggaaaaataagcggcgatcgcagccgcctccagtatggattgttcatccggatcgctgcttttaatcacaacgtgggaacccggaatgtctttcgtgtggaaccataaatcatcccttgcggcagcttttgtcgttaagtactcattttgtttattgtttttgccgacaagaatcgtcaatccctgtgaagattcatattgctccaaaacaggaacgtgctgcttctgttttttctgtcctctctgctgtttcggccgcagatatttgccttccacaagctcttcccttatttcgtgaatatcctttgtggaggcggaggagagctgctggatcagctgatcgaaataagcgatttcctcctcggccagacggatctgttcttttaccacctcgacggaattcttcgccttttgatactttgtaaaatacatctgtgcattttctgacggtgttttgttcggatttaaagggatggtcaccgtcttactttcttcatcataataattgatgacttccgcttctttgtcaccttttttcagcatatacaaattcgccgtcagcagttcgccgtatagctggaattccttcgcattctctgagtagtcgagcgtcttttccagcttttttatcttattggcgttttttttccgttcatttgcgacaaaccgctcgagatcctgcgcctgctgtttgacgcggtcgcgttccgctttgccgaaataaaaccggtccaacagctcactcagtgagtgaaaggtgcgctcctctccgtttacatgtgtgagagacaggagataaaagtattcctttccgccggctgtcgtaatgttcggtgtaaacctgcaatctttcacggcatggaacatttcaagcagcgtcttcggcagcgttattttgttagcgagacccgctctgtgaacggcttcttttgcaaacagcggagaaacaccggagaaatgtctgacgatctgctggtcaagccgtccttcctgaaaactgagataacgcaaaacgtcctcttcatccgcggcaagcggcgaaattttttcctgagcgggaggaagcttgtaatcatatcccggcagaacggtccggtagctgttcatcgacggagataaatgtttcagcccgtcgatgatggctccttctccgtcagtcagaataatattgctgtgccgtcccataatttcaacatacagcgttcttacggtttcgtcgccgatttcatttctgctttttatgcggaatatcataatccggtctaatccggcctgctctattttctcaataaatccgccttctatatgctttctgagcagcatacaaaacatcggcggctcgctcggattttcataggcctggtttgtcatgtgcacccgtgaatagctcgggtgcgccgacaataataatttgtggttttttccgttggcgcggatatggaatatcacatcgtgcttaaaaggctgatggactctcgtgatccggcctccggcaatccggctgtttaattcatgtgtcattccgtatgtaaacatgccatcaaaagacatataaaacaccctttccttcttcctgcattcgataattatagcatgaaaaggggcgagtcagaataagcttgtttacagagtgacatctctaaagcgaggcaggggagtggacgagaagaatgaagtttcatgaaatgggacaaaccgatttgctgaaagcaacaaatacgtccattaaacaggggttgaccgaaaaagaggtgaaaaaacgccttgaaaagcacggaccgaacgagcttcaggagggcaagaggacaccggcgatcgtcgtgtttttcgcccaatttaaagattttatggtgctcgtgctgctggcggcgaccttaatatccgggtttttaggcgaatatgtagatgccgtagcgattatggcgattgtatttgtcaatggggttctcggtttttttcaagagcggcgtgcggaaaagtcattacatgcactaaaagagctgtcaacgccgtatgtgtcagcgttgcgggacgggagctggaagaaaattcagtccaaggagctcgttcccggcgatatcatgaaattttcaagcggcgaccggattggcgcggatgtgcggatcgttgaagcgaaaagccttgaaattgaggaatcggcgctgaccggggaatcaattccggtggttaaacaagctgataaactgagaaagccggatgtttcgttaggcgacatcagcaatatggcgtttatgggtacgatcgtaacgcgcggcagcggtgtcggcgttgtcgtcggtacaggaatgaatacggcaatggggaaaatcgccgatatgctggaatccgccggcagcctttcaacaccgctgcagcgaagacttgaagagctcggcaaaattttaattatcgtcgcgctccttttaacggtattggtcgttgcagtcggcgtcttacagggacatgatctttacagcatgtttttggccggggtgtcattggccgtcgccgcgattccggaagggcttcccgccattgttacggtggcattatcaatcggcgtccagcgcatgatcaaacaaaaatcaattgtcagaaagctcccggcggttgaaacattgggctgcgcctctgtcatttgttctgataaaaccggcacgctgacacaaaacaaaatgaccgtcacccatatgtggtcaggcggcaaaatttataaagtgtcaggcatcggctatgagccggagggcgttttcacccgagatgagcgggaaatcaagccgaaagatgagaaaattcttgaacagatgctggttttcggcgcgttgtgcaacacatccgaaatcgcactgaaagacggccgttatgtactcgacggtgatccgacagaaggagcgctgctgacggcagcaagaaagggcggctattcaaacgattggctcagcgggcaataccgcgtggttgccgagtttccgtttgactccgtccgcaaaatgatgaccgtcattatagaggataaggaaaaaaagcagttcgtcatcactaaaggagcgcccgatgtgctgattgaccgctcgtcacatctgatgcacggcgcaagaagtacgcctttttcaggagaaaagaaagcagaaacggaagcggttctgaaagagctggcgtcgcaagctttgcgtacgattgcgattgcttataaaccgcttaaggccggagaaaagccgacaatggagcaggcggaaaaaaatctgacgatgctcggcttgtcaggcatgattgatccgccccgtccggaggtcagacaggccattaaagaatgccgtgaggccggcattaaaacggttatgatcacaggagatcacgtcgaaacggcaaaggccatcgcaaaagatttgcgtcttcttccgaaaaagggacgtgtgatggacggcaagacgctgaatgagcttacggagaaagaacttatcgaaacggtcgatgatgtctacgtcttcgcacgcgtgtcacctgaacataaattgaaaatcgtcaaagcgtttcaggaaaacggacacgtcgtcgccatgacgggagacggggttaatgacgcgccggccataaagcaggcagatatcggtgttgccatgggcgtgacgggaacggatgtggcaaaggaagcctcttctctcattctggtggatgataactttgctacgattaaatcagccataaaagagggacggaatatctatgaaaatataagaaaattcgtccggtatttgctcgcctccaacgtcggtgaaattttagtgatgctgtttgcgatgcttctcgctctgccgctgccgctcgttccgattcagatattgtgggtgaacttagtcactgacggactgccggcgatggccctcggtatggatcagccggaaggagacctgatgaggcggaagccgcggcatccgaaagaaggagtgtttgcgagaaaactgggctggaaagtcgtatcaagagggtttttaatcggagccgcaaccatttttgcgtttatcatcgtctatcaccgcaatcctgaaaatctgccctacgcacagaccgttgcattcgcgactcttgtcctggctcagcttatacacgtgtttgactgccggagcgaaacgtctgttttctcccggaatccgtttgaaaatatctatttgctcggcgccatcatttcttctatcttcctgatggtcatcgtcatctattatccgccgctgcagccgattttcaaaacagtgccgattacgccgggcgattggatgctgattatcgggatgtctggcatacctacttttttgctggcgggttcacttttgacaagaaaaaaataattccatatgatataatcttaggggtaatagcatgtctattgcccttttattttgataacgggaaagaattgggtgtttcatatgatacggagtatgacaggcttcggcagcgcaagcagcacaaaaggcgatctctcggcaaccgttgaattgaaatccgtcaattaccggttcaaagaagtgaacgcccgcctgccacggcctttgctatatgtagaggataagctgaaacaaacgatattgcagcatatacagcgcggaagagtagagctgtttctcactgtaaacagtgacgcgctcataaaaagaagcctgaacatcgattgggagctccttgatgaatatgtgagcgccgcacacgtcatgaaagagcgctacagcctggccgcagaacccgatgcaatggatttctttagatttgaacacattgcgcagattcacgaagaacagatgcgtgatgacaagcttgaagaagtcatcagggaagccgctgagctggctgtaaaggaactttgtgatatgagggaaaaagaaggccggcttttggcggaagactgctttctgcacattgagcggcttgagacgctgtccgaacaggtgaaagagcgcgcttcggccgttgttattcaataccgcgagcgtctttacgcccgaatgaaggaatggacggaggacgcgctcgacgaaagcaggctgatcacggaatgcgccattttcgccgatcgttctgatataacggaagaaattaccagattaaagagccattttgttcaattccgtgatatattaaaagaaggcggggcagtcggccgcaaacttgatttccttgttcaggagcttaaccgggaagcgaacacgatcggctcaaaagccaatgatcatcaaatcacaaagcttgtcgttgaaatgaaaagttctattgaaaaattgaaggaacaagtgcaaaatatagaatagcgactgtgcgtattgtttacagacggtctcttcaggttacactagagacgtctattttacagggggaacgtagaagatgacgattaaactgattaatatcggatttggcaatatcatctccgccaatcggatgatttcgattgtcagcccggagtctgcgccaataaagcgaatgatccaggatgcaagagaccgcggaatgctaatagacgctacatacggacgaagaacccgtgcagttgtcgtcatggatagtgatcacattatcttatctgccgtccagcctgagacagttgcacacagactttctgtgaaagaagaaattatggatgaagggcaggggtaattgccgcatgaaagaaagagggttattaatcgttctctcaggtccctccggagttggaaaaggaacggttcggcaagcaatattttcacaacaggacacgaaatttgaatactcaatttcagtcacgacgagaaacccgagagagggtgaggtcgacggcgtcgattatttctttaaatccagagaagaattcgaacgcatgattgaaaacaacaaactgcttgagtgggcagaatatgtcggcaactattacggaacgcccgttgattatgtcgaacagacgcttcaagaaggaaaagacgtcttcttagagattgaagtgcagggcgcgctccaagtgcggaatgcatttccggaaggcctgtttatcttcttagcgccgccgagtctttctgagctgaaaaacagaatcgtgacaagagggactgaaaccgacgatttaatcgaaaacagaatgaatgccgcaaaagctgaaatcgaaatgatggacgcgtatgattatgtcgttgaaaacgacgatatccaaacggcttgtgataagattaacgcaatcgttctcgccgagcacttaaaacgtgaacgcgtcgctccgagatataagaaaatgctggaggtagaataacttatgttagatccgtcaattgactctttaatgaataaattagattctaaatatacgctggtgactgtgtctgcaagacgcgcgcgtgaaatgcagatcaaaaaggaccagcagattgaacataccatttctcacaaatatgtaggcaaagctttagaagaaattgacgcgggcctgctttcgtttgaaagagaagacagcgaataacaagcacacgtagcaacctatctctacataggttgttatttttttccgtttgggatttgtccaatgctttcataaaggggagaagacttcatgaaaaaccgaaacattttgctatgcgtaagcgggggaattgccgtttataaagcttccgcactcacgagcaagctggttcaggccggcgcaaacgtcaaagtgattatgactgagtccgcgcgtgagtttgtttctccgctgacatttcaggcgctgagccggaatgaagtgtatacagatacatttaatgaacaaaatccgaaggtgatttctcatattgatgccgctgactgggcggatttaattattgtcgcgcccgctacggcaaatatcatcggcaagcttgccaacggaattgctgacgatatgctcacaacgacggtgctggcggctgaggccccggtctgggtggcgcctgcgatgaatgtccatatgtatgatcatccggcggtgaaacggaacatctctgtgctttatcaggacggggtccgctttatcgagccgagtgaaggctatttggcatgcggatatgtcggcaaaggaaggctggaggagccggagcttattgttgaacgtgtcagagagcattttaaggagcctgaagacgatgcgccgctgaaaggaaaacatattgtcattacggccggtccgacgcgcgaagccgtggaccctgtccgattcttcacaaataaatccaccggcaaaatgggctacgctgctgctgaagccgccgtccgtctcggggcgcgggtgacgctgatttcaggcccggtgtcaatagaggcaccagtcgggctgtatcagtttcttcctgtgcaatcggcagctgatatgagagaagccgtgctttctgtgtttgattcatgcgacatggtgattaagacggcggccgtggccgattttacgccggcggctgtttccgatcacaaaatgaagaagaaagacggttcgctcgtgatcgaattcaaccgtacagcagacatactgaaagaactcggcgaacggaaaacacaccagctgctggtcggatttgcggctgaaacgcaagacgtcgaacgctatgcgcgcagaaaactcgaacagaaaaaccttgatatgatcgttgcgaatgatgtgaaagcggaaggggccggatttggcacggatacgaatgtcgtcaccttctatttccgagacggaagaaaacgggagcttgcgcttatgtctaaacttgacgtttcctttgaaatgctgaaggaaatgaccgctttgaaagtcgaggaccgaaaacccgtatgaatgtagcagaagtcattgtcgatgtcagctccaaaaacattgacagaccctttgattacaaaattcccgatcatttaaaagggatgatcgaagtcggcatgcgggtgattgtcccgtttggcccgcgcaagcttcaaggatttgtgaccggtttgaaagattcgtccgaattaaacggcggctcaatgaaggaagtcgagaagcttcttgatttgacgccagttctgactgaggaactgatgcagctgtcttcatggctttctgacaaaacgctgtcgtttaaaatcacggcgcttcaggcaatgctgcccgccgcactgaaggcgaagtacgagaaagagctgaaagtcgttgacgaagcagcgctgaccccggacatcaaacagcttttcaggaatcaaaaaagtcttctgtactcggatattaccgatgaaagcattctttcgtcacttcagaaattcgtgcgcaaaggaagcattgatgtcacatataaagtcgcccaaaaaacgaataaaaaaatgatccgcatgatcgaagcgggggcagacaaagaagaactcgcccggcacgcagattcattgacaaagcaggcttctaaacagctcgccgtgcttacttattttatcggcgggggagaaaagatttccgcggctgaactttgcaaaaagaccgattccagttccgcgacgctgaaaacgcttcttaaaaaggggcttcttacggaaagctttgaggaggtttaccgcgatccttatcaggacagaatgttcaaaaaaacagagccgctctctcttacagaagagcagcaggccgcttttgagccgattaaacaagccgtagccgatcatgtccaccacgtctttctgcttcacggcgtcacgggaagcggcaaaacggaaatttacctgcaatccattgaaaaagtgctggcaaaaggacaagaagcgatcgtgctcgttccggaaatctcgttgacaccgcaaatggtgaaccgttttaaaggccgcttcggctcacaggttgcggtcatgcacagcggattatccacaggtgaaaaatacgatgaatggcggaagattcagcgcaaggaagtccggcttgtcgtcggagccagatcggccatctttgccccgtttgaaaatctcggcatgatcattattgatgaagagcacgaatcttcctataagcaggaggaaatgccgcggtatcatgcaaaggatgtagccatccgccgggccgagcatcacagctgtccggtcgtcctcgggagcgccacgccgacattggagtcatttgcgcgggcgaaaaaaggcgtttatgagctgcttccgttaaaacatcgcgtaaaccgccagctcatgcctgacgtttctctcgttgatatgagagaagaactgagaaatggcaacagatcaatgttttcaagagagctgatggaacagctggaagagaagcttgcaaaaaaagagcaggccgtcctttttctgaataaacgggggtattcctcgtttgtgatgtgccgggactgcggttatgtgccgcaatgtccgcattgcgacatttccatgacttatcaccgctacggacaaaggctgaaatgccattactgcggccatgaggaacctgtcccgggaacatgcccggaatgcggcagcgaacatatccgctttttcggcacgggcacgcagcgtgtggaggaggagcttaccaaagtgctgcctcaggcgcgtgtgatcaggatggatgtggataccacttcaagaaaaggcgcccatgaaaaattgttgtcagcgttcggtgaagggaaggcggatatcctgctcggtacgcagatgatcgcaaaagggcttgattttccgaacgtgacgcttgtcggagtattaagcgcagatacgacgcttcacatcccagatttcagggccgcggagaagacattccagctgctgacgcaggtaagcggacgggccgggcggcatgaaaagccgggaacggtggtcattcaaacgtatacaccgtctcattacagcattcagctgacgaaaacgcacgactatgaaactttttttcagcaggaaatggcgcacagacgggcccagtcatacccgccgtattattacgtggcgctggtgaccgtttctcatgaagaagcggcaaaagccgcggtcaccgcagaaaagattacaaactatttaagagcgggatgcgggcctgatacgaaaattcttgggccggcggcttccccgattgccaggatcaaagatagatatcgctatcaatgcgtgataaaatacagacaggaaaacgagttgcagattcagttgaaaaagatactggagcactataaacgcgacattgcgcaaaagcatgtaatgatttcaatcgatatgaatccgtacatgctgatgtaacattagtttttggagggcaaaattttggctgtaaaaaaaatcgtcacacacccggcggaggttctggaaacacccgccgatgaagtgacagtgtttgataaaaaattaaaaaaactgcttgacgatatgtacgatacgatgctcgaaatggatggcgtcggtctcgccgcgccgcaaatcggcattttaaaaagagcggccgtcgtggacatcggtgaagaaagcggccggatcgaccttgtaaatccggttattcttgaaaagagcggtgaacagaccggagtcgagggctgcttaagttttcccggggttttcggtgatgtcacccgcccggattacgtaaaggtaaaagcccacgaccgtaaaggaaaaccgtttattttagaagcggagggttttttggccagagccgttcagcatgaaatggatcatttagacggcattttattcacatcaaaaattacggcttactacactgaagaagaactggcagaaatggaaggatgattggatgacaaggatcgtttttatgggaacgcccgacttttcagttcccgtcctgcgcacgcttattgaagacgggtatgaagtggttggtgtcgttacgcagcctgaccgcccgaaaggcagaaagaaaatcatgacgccccctcctgtaaaggctgaagctgaacgtcacggcattcccgtgcttcagcccgaaaaagtaaggctcgaagaagaaatagaaaaagtgctcagcctgaagccgggcctgattgttacggcggcattcggacagatcctgcccaagcagctgctggacggcccgacatacggctgtatcaacgtacacgcgtcactattgcctgaattaagaggcggagcgccgatacattattcgattctccaaggcaagaagaaaacaggcgtgacgatcatgtatatggttgaaaagcttgatgcgggcgatatgatttctaaaatcgaagtggaaattgatgaaacggataacgtcggcacgctgcacgacaaattaagcatagcaggggcaaagcttttgtcagagaccgtcccgaacgtcatttctggaaatattaaaccgatcaaacaggacgaatcaaaagcgacttacgcgcctaacattaagcgtgagcaggagcggattgattgggcaaagcccggagaagagatctacaaccagatcagaggtttaaacccttggcctgtcgcctatacaactttgaacggtcaaactattaaagtatgggcttctgaaaaagttgctgcaaaaactgatgctgcgcccggaacagtcatccgcacggagcaaaacggcattgtcgtcgcatcaggaaacagcaccgcccttttaatcactgagctgcagccggcgggaaaaaaacggatgaagggcgaagattttgcaagaggcaaaaatgtgcagtccggtgacgtgttaggagcagcaaatgaagaaaattaatgtccgggagctcgcccttgaagcgcttgagaagcttgagcaaaatcaggcatacagcaacctgcttcttacatctgttatcaaaacgaacacgctcagcgatcaggacagaggactgctgacagagcttgtctacggaacgctgcaaaataaaatcgccttagactatatgctgaagccttttatccgcaagccgaataaggtgaagccgtgggtgattcagctgcttcgtctgtccgcgtatcaaatggagtatttagaaaaaattccggatcgcgccgccatccatgaagcggttgaaatcgccaaaaaacgcgggcataagggcattgcgtcctttgtcaacggcattctccgctccctgcagcgtgagggggcgccgtcattcgctgaaattgaagacccggttctccgtctttctacagagacaagccatcccgaatggctcgtaaaagagtgggtcgaggcgtacggctttgaggcggctgaaaagatctgccggattcatctcattccgccgaagcagacgctccgtgtcaatcacataaagagcgacagggaaacggtgctgaatgagatggagaatgccggtctggaagcggaagccggagacctttctcctgatgcgattaagcttttgaaaggaagcatcgcgaacacggcatttttccaaaacggccgggtatccatacaggatgaaagctcaatgcttgtcgcgcgggcgctggacccgaagccgggcgaaaccgttttagatgcatgcgccgcaccgggcggaaagtcggctcacattgcggaactgatggagaacgaggggagcctcacatcgcttgatcttcaccgccataaagtgaagctgattaaagagggcgcagaacggctcggacttacgatcatcgacgcgcaaacgatggatgcgcgaaaagcgggagaggcctttggagcagaacggtttgaccgtattctcgttgatgcgccttgctcaggtttcggtgtcatcagaagaaaacccgatatgaaatatacgaagacgccggaggacagcagacggctgtcagaaatccagctcggcattttaagggaaatcgccccattagtaaaaaaaggtggcacactcgtatacagtacgtgtacaatggatcggacagaaaatgaagaagttatgcatgcgtttatacaagaacaccctgagtttgaacccgatttgtctcttgaaaagcggctgcctgaaaaggcgagaccctttgttcaggatggaagccttcaaattcttccgcattatttcggaacagacggtttctttattagcagcatgagaaagaagggataaaaaatgacacaattaaaaaagacaagcgtacggaaagagctgcggactgagcagccgtccatttactcttttgaattagatgaaatcaaacaatggctgaccgagaatggcgaaaagccgttccgcgcagcacagatttttgaatggctctatgaaaagcgggtttcttcatttgatgaaatgacaaacctctcaaaaagcctgcgtgaaaaactcgagagcaattttgtgctgacaacgctgaaaacggctgtaaaacagacatctcaagacggcacgatgaaatttttatttgagcttcatgacggttatacgattgaaacggttttaatgagacacgagtatggtaattctgtatgtgtaacgacacaggtcggctgccggatcggctgcacattttgcgcgtcaacgctcggcggtctgaaacggaatcttgaagcgggagaaatcgtcgctcaagtcgtgaaagtgcaaaaggcgcttgatgaaacggatgaacgcgtcagctcagtcgtcatcatgggaatcggagagccgtttgataatttcaatgaaatgctcgctttcttaaaaattattaaccacgataaagggctgaacatcggagcgcgtcatatcacagtttccaccagcggaatcattccgaagatttacgatttcgccgatcaaaaaatgcagatcaatttcgcgatttctctgcatgctccgaatacggaaatcagaagccgtctgatgccgattaacaaagcctataagcttcctgaccttatggaggccgtcaaatattacatcgagaaaacaggcagacggatcagctttgaatacgggctgttcggcggcgtaaatgatcaggtcgaacatgcagaagagcttgcagaactgttaaaagacgtgaaatgccatgtcaatttaattccggtaaactatgtgcctgaacgggattacgtccgtacaccgagagatcagatttttgcattcgaaaaaacgttaaaatcccgcggtgtaaatgtcacgatcagaagagagcaaggccatgacattgacgcggcctgcggtcagcttcgcgcgaaggagcgtcaagacgagacgaggtgaagaggttgattacagccttgaaaacagatacaggtaaagtccgccggcataatgaagatgcggcgggcattttcacaaaagaagacgcggtgcttgcggttgtcgccgacggcatgggcggtcatcttgccggagatgtagcgagcaggatggcggttgcggcgatggaagagcagtggaaccggaccgaaacggttccttctctgccgtccgcttgcgaggattggctgaaagaccggattcatgaggcgaatgtcaaagtacatgaccacgctaaagcgaatgaagaatgccggggaatgggcaccaccattgtctgcgccttattcacggggaagtttgtcactgtggctcatatcggagacagccggtgctacctgcttcaagagggggaattcactcagctgactgaggaccattcgcttgtgaatgagctggtcaagacgggggaaatttcgaaagaggacgccgagcaccatccgcggaaaaatgtattgacgagagcgctggggacagatgaaaccatcagccccgacgcccgttcttttgaactgtctgacggcgatcagctgcttttatgctctgacggactgtcaaataaaatagaagatcacgagatcaaacaaatgcttcaagccgaatctgatcctcaggaaaaagtagaccttctcatcagcaaagcgaatcaaaacggcggcgaagataacatcacggctgtgttgattgagttttccgcagatgaaaaagagggtgaagacaagtgctaaccggcaagcggatcagcgggcgttatcatatcctccggcccattggcggcggcggaatggcaaacgtttttttagctgaggacatcattctcgaacgtgaagtcgcaattaaaattctgcggtttgactttgtgaatgacattgattttatcaggcgtttcagaagagaagcacagtcggcatcaagcctcgatcatccgaatatcgtcagtatttacgatatcggggaggaaggcgatatttattacattgtcatggaatatgtggaaggcatgacattaaaggaatacataaccgcacacggaccgctccatccgaaagaagcgctgtccgttatggagcagatcgtctcggccatcgcccatgcccatcaaaaccatatcgtgcaccgggatattaaaccgcacaatatattgatagatcatttagggcatatcaaggtgacggatttcggcatcgccacagcacttacatctacgacaatcacacatacgaattctgtgctgggctcggttcattatttgtctccggagcaggcgagaggcggcctggcaacgaaaaaatcagatatttacgcgctcggcatcgtgctgtttgagcttttaacaggcaaaatcccttttgacggagaatcagccgtcagcatagcgctaaagcacctgcaaacagaaacgccttccgccagaaagtggaacccttccattccgcagagcgttgaaaacattattttaaaggcaaccgctaaagatccgtttcaccgctatgaaagcgccgaagacatggaggcggacatcagaacggcttttgacgccggcaggctgaatgaacaaaaattttccgtgcaggatgatgaggaaatgacaaaagccattcccgttattactgacggcgcaaaagccgctcctcaggcggaaacgccgggggagacggatgataaggaacagcagccagccaaaaagaaaaaacggaaatggccgtgggttttgctggccgtctgtttcattttcattatggcggctgttcttgcggtcaccgtgttcccgtctttatttatgcctaaagatgtaagcgtccccgacgtacggggcatgaagtacgaaaaagcggaagccctgcttgaaaagaacgggctccgggctgatcctgatataacggacattgaagatgaaaaaatagaagaggaattaatggtcaaaacggacccaaaagcggggtctaccgttaaagaaggttcttctgtaaaactgtacaaaagcatcggaaaaccgaaaacccagctgatcgacgtgaaaggacggcagatcggcgacgcaaaaaaagcgctgaaggaaaaaggcttcaaacatgttaatgtaaaagaagaaaacgatgacagcgaggccggcaccgtaattgatcaggacccgtcagccggcaccgatatggtcgcaagcgacgatgaagtcaatctaacggtcagcctcggcccggcggacgttacgctgagggacttaaagacttacagcaaagaagcggcttcagggtatcttgaagataacggcctgcagcttgttgaaaaacaagcccattcagatgacgtgccggaaggacaagtcatgaaacaagagccgtcagccggcactgcggttaagccgggaagtaatgttgaagtgacgttctcgctcggacctgaagaaaaaccggcgaaaacggtaaaagaaaaaatcagcattccttacgaacctgaacatgaaggggacgagcttgaagtgcaaatcgccatcgatgataaggaccacagcatctctgatacgtatgactcatttaaaataaaagagccgactgaaaaaacaattgaactgaagattgatcagggacagaaggggtattatcaagtgatggtcgatcataaagtggtcagctacaaaacgattgaatacccgaaagataatgactgacaaggagggaccctatgcctgagggcaaaattataaaagcgttaagcggattctattatgtcttggatgaatcacaggacaagatcattcaatgcaggggccggggcattttcagaaaaaataaaataacgcccctggtcggcgattatgccgtttatcaggctgaaaatgataaagaaggctacctgctggaaatcaaagaacgaacaaatgagctgatcaggccgccgatttcaaatgtcgatcaggccgttctcgtcttttctgccgttcagccggcgttcagcacgtctttattggaccgttttctcgtccttgtggaagccaacggcattcacccgatcatctgcataaccaaaatggacttagctgcagacggggaatcgaaagaggcgatactttcttacgtgaaagactatcaggcgatcggttatgacgtatatgtgacgtcatcaaaagaaaacagcggcttaacaggcattgtgaaacacttcgagaacaaaacgacggtgtttgccggtcagtcgggagtcggaaaatcttcgcttttaaatgcgatcagcccggagcttgagctgaaaacaaacgagatttccgcgcatttgggacgcggaaaacatacgacgcgccatgtggagctcattcatacatcaggcggtctggttgcggatactccggggttcagttcgcttgaatttaccggcattgaggaagaagagctgggcagcacgttccctgagatcagagaaataagcgcctcttgcaaattcagaggctgtctgcatcttaaagaaccgaaatgcgcggtaaagcaagcggtggaagaaggagagattcagccgtaccgctatgagcattacaaagaatttatgcaggaaataaaagagagaaagccgaggtattaatatgattaaggttgcgccatcaattctttccgccgattttgcttcactgggcgaggaaattaaagacgtggaaaaaggaggggcggactatatccatattgatgtcatggatggccatttcgtccctaacattacaatcgggccgcttatcgttgaagccgtccgtccggtgactgatctgccgctggatgtccatcttatgattgaaaacccggaccgctacatcccggcattcgcaaaagccggtgcggacatcctttccgttcacgctgaagcgtgtccgcatcttcaccggactattcaattgataaaagagcaaggggtaaaagcgggagttgtgcttaatccgcatacgcccgtccaaatgattgaacatgtgatcgaggagcttgaccttgtgctgttaatgacggttaaccccggttttggcggacagcgcttcattcattcggttctgccgaaaatccgtcaggtcaaacagctggctgaggagaaaggcctgtctgagcttttaatcgaggtggacggaggcgttaataaagaaacagcccctttatgcgctgaagcgggcgccaatctgcttgttgccgggtctgccgtatataatcagccggatcggaaaaaagccatcgccgacatccgaaacgcatcataaacatgctgaaaaagagcccggtgaaagccgccggctcttttcgcgtctaagagagaggatagcatatgaagacaatcaatatcgttgcgggcggcccgcgggagcttattcccgatctatccgaatacacagacggagatacgacgtgggtcggagttgataaagggacggttgctcttttggaggccggaatcattccgcaggaagctttcggtgattttgacagcattacggaagaggagctcatgcagattcaaaaagcggcgccggccctccatgtgtatcaggcggaaaaagattataccgatcttgaactcgctcttgactgggctttacaaaaagaaccggaaaacattcgggtattcggtgtgacgggcggaagagccgatcactttttagggaacatccagctgctgtataaagccttacataagcataccgatgtcgagctgatcgaccggcagaatgacattcagatgttcgggcccggccgttatacaattgaaaaaaaagcgcgcagacgctatatttctttcattccgtttacggaagcggcagacggcctgacactcgacggttttaaatatccccttgataattgtcatattcctctgggttccacactatgtattagtaacgaactcattcattcacgaggtactttttcgtttgcaaaaggcatattaataatggtaaggagcgcggattagaaaagcggcttctgccatatgcggaaaaaaccatgaatcctaaagtgatgaacgcagcggatacgggacttataggaggggacaaaatgaaattttataccattaaattgccgaagtttttaggaggaattgtccgggcgatgctgggctcatttagaaaagagtaagcccaagaagctgaaattgccctctttgaacgcataaaaaacgcctgccgcataaaagggcaggcgttcatttttgcttatacacgctcaactttaccggattttaaagcccgggcagatacatacacttttttaggtttgccgtcaacgaggatgcggaccttttgaaggttggcgccccaagtacgcttagaagcgttcattgcgtgagaacggttgtttccggcttttgtttttttacctgtaataaaacatttacgtgccatttgtttccctcctaactgcgcgaaacatctttttaaacatagtgtctcagatgctttcgttatacaatactttaaataatttaccacagctaaaaaccgtttgcaactattgtttcccttactttcaagaaaaatcacttgacatgtaaaaccaatcacatttccgcgctgaaggccgctgtctgtatcttttcttttcataatgggatacatatagtagaataatgataactctatgcatctgaaggaggaacctgtgtgtccattgaaatgaagacaaaatacggacagattgatatatccaacgaagtcatcgcaatggttgccggaggcgctgccattgactgttacggaatagtggggatggcctcaaaaaaccagattaaagacggtttgtctgaaatcctccggagagagaacttcgcaaaaggcgtacatgtccgtcaggaagccgaacaaatacatatcgacatgtacattattgtcagctacggcactaaaatatccgaagtagcccacaatgttcagacgaaggtaaaatacacagtaaatcaaacaatcggacttgcagttgattctgtaaatatttatgtccaaggcgtacgagtaacgaacccgtagtgaggaggatgagtattgtctagacgaaacttagatgggagagcttttgcggcaatgattctggcgggggctgagacattgtctcaaaatgcatccgcggtggatgcgctgaacgtgtttcccgtgcctgacggcgataccggaacaaatatgaatttatcgatgtcatccggtgcaagagaggtagagcacattgactcacccgacatcggcaaagtcggcatcgccctgtcaaaaggcctgcttatgggagcgagaggaaactcaggggtgatcttgtcccaattgttcagaggtttcacaaagagcattgaaaacaaaaaccaaatagatgcccgagagtttgccgcagcactccaagcgggagtggatatggcatataaggcggttatgaaaccggttgaaggaacgattttaaccgtggccaaggatgcggctaaaaaagcggtcgcctcggccaaagaagaaaccgatattatttcggtcatggaggccgttattgaagaagcggaagcgtcgctcaaccgcacgccggatctgcttcctgttttaaaggacgtcggtgtcgttgacagcggcggaaaaggtctgctttgtgtatatgaaggctttttggctgctttaaaaggagaggccgtaccgaaaaaagcggttcttccggcactcgatgatatggtgaatgccgagcatcataaaagcgcgcagagcatgctgagtacagaagacattgaattcggattttgtacggaagtgatggtgaggctggatcaagataaacggacgttcaaggaagaggcgttcagaaacgaactgagccgtttcggcgattcattgctggtcgtggctgatgatacgctggcgaaagttcatattcatgccgaagaaccagggaacgtactcaatctcgcacagcgttacggcgatttgattaaaattaaaattgaaaacatgagggaacagcatacttcaatcatcagccaagaacatgatgaaaaaaagccggccggcgttatgaaagaagcccgcaagccttttggcatcgtgactgtggcaatgggagagggcatttctgaattgtttacgagcatcggcgcttcacacgtaatcgaaggcggccagacaatgaatccgagcacggaagatattgttgaagccgttcagtctgtcaatgcggagacggttttcattcttccgaacaattccaatattgtgatggctgccaatcaggcggcgagcgtggctgaagaaaatgtcattgtcattccggcaaaaacggtccctcaaggcatgaccgccctgcttgcgtttaaccctgaccagccggctgatgtaaatgaagccaatatgcttgaggccatccggaatgtgaaaagcggccaggtgacatattcagtcagagacacccatattgacggcaaagatattaaaaaaggtgattttatcggcattttaaacagttcaattatcggcagcgccgaagatcggataagtgcggcgaaattgctgctggatgaaatgatcggggaagaagatgaaatcgtcaccatcctgtacggagaggacgcgccggaagaagaagctgagaaactcgctgagtatattgctagcgtctgtgaagatatcgaggttgaaatccataacggcagacagcctctgtatccatatatatttgcggcagaatagaagggcttatcaggcccttctattcttatgcctttatttacctgcggcagtgcggcagtgtgcctgcttgccaattgagaaatgttcaattagtctaaagaaaagcgctgaatgaagtgatgttaaggaggagcaaaccagcatgaagtatagaagcgtttttgatattatcggcccggtcatgatcggtccgtccagttcacataccgcaggcgccgcccggatcggcagagtggccagaagcttattcaggcgggagccccgccggatcgttgtgtctttttacggatcatttgcagaaacgtataagggtcacggcactgatgtcgcgattatcggcggcctgcttgattttgatacatttgatgaacggattaaaacagcgattcaaattgcggaagagaagggcatatatgtagagttccgtacagaggatgccgtgcccgttcatccgaatacggcgcgtatcgtcatttctgatgatgagggagagcttgcccttaccggtatttccatcggcggcggaaaaatagaaatcacggagctcaacggctttgagctgcgactttccggaaaccacccggctattttagtcgttcataatgataaattcggcacgattgcaggcgttgccaatgtgcttgcgaaattctccatcaacgtcgggcatatggaagtggcgcgtaaggacgtcggccagcttgcgctgatgacgattgaggtcgatcagaatattgaagaagaagtgcttgacgaactttcaacacttcctaatattatacaggttactaagatagctgactaaaaagtcaggaggaaaatgacatgtttcgtaatgtaaaagaattaatagaaatcactcaagaaaaacaaattccgatttcggaagtgatgatcacccaagagatggaagtgacgcaaaaaacacgggaagaaatctttcaaggaatggagcgcaatctctccgtcatggaagcagctgttgaaaaagggctgaagggcgtcacgagtcagaccggtttaacaggcggagatgccgtgaaacttcaggcatacatccaatcgggaagaagcctgtcgggcaatctgattttagacgccgtttctaaagctgtggcgacaaatgaagtcaatgcggcgatgggaacgatctgcgctacaccgaccgccggctctgccggggttgtgccgggaacgttattcgccgtaaagcataagctgaaccctacgacagaacaaatgatccgttttctgtttacagccggcgcgttcggttttgtcgtagcaaataatgcgagtatttcaggagcggcaggaggctgtcaggcggaagtcgggtcagcatcaggcatggcagcggctgcgattgtggaaatggcgggcggaacgcctcagcaatcagcggaagcaatggcgattacactgaaaaatatgctcggtctcgtatgtgacccggtcgccggattggtagaagtgccgtgtgtcaaacgaaacgcaatgggagcatccaacgcgatgatcgcggcggatatggcgctggccgggattacaagccgcattccttgcgatgaggtgattgacgcgatgtacaaaatcggccagacgatgccgacagcactgcgtgaaacgggacaaggcggtttagctgcgacaccgacgggaagagaattagagaaaaaaattttcggaggagcgctgaaatcaagtgacacaccatcagcaaactagtatagcggaaattaagggcattgggccggaaacagaaaaaacattgcacgaacttggtatctatgacatttctgatcttctgaattatttcccttaccgttatgacgactatgagctgagggatttagaagaagtaaaacatgaagaaagagtgacggtagaagggaaggttcattcagaaccttctcttacctattacggcaaaaaacgaaacaggctgacattcagggtgcttgtcggcaattatttaattaccgcggtctgctttaaccgtccctacttaaaaaagaaactgacgttaggttctatcgtcacgatatccgggaaatgggataaacacagacagaccgtttccgtgcaggaattaaaaactggtcctcatcaagaagataaaagcattgagcctgtttattccgttaaagaaaacgtcaccgtaaaaatgatgagacggtttattaaggaagcgctgcagcatcatttggacagtgcagccgatccgcttcctgaaaaattgagaatccgctataagctgcctgattacaaacatgccctgcagacgatgcatcagcctgaaacgagggaatcgttacagcaggcaagacgccggtttgtttacgaggaattcttattatttcagctgaaaatgcaggcgttccgtaaagcggaaagggaacagtcaaaaggcatcagccatgtgtttcctgctgaaaagctcgccgctttcacagacagcctgccgttttcactcacgaccgcacagacgcgcgtgcttcgggaaattaccgctgatatgacatccccttaccgaatgaaccgtctgctgcaaggtgatgtcggttcagggaaaacagccgtcgccgccatcgctttgtacgctgcgattctgtcggggtatcagggggcattaatggtgccgactgaaattctggccgaacagcatgcagattctctcgtatcgttgtttgcaaatgaagatgtaaatatcgcgcttttgacgagttctgtaaaaggaaagcggcgcagggagcttttggagcggcttgctctcggagagattgatattttagtagggacccatgctttaatccaggatgaagtggaattcaaagcgctgagtcttgttattacggacgagcagcaccggttcggggtcgaacagcgcaaaaaactcaagaataaaggtcaggatccggatgtgctgtttatgacagccaccccgataccgagaacgttggccattaccgtcttcggagaaatggatgtttccgtgatagatgaaatgcccgcggggcgaaaacaaatcgaaacgtattgggtgaaacacgacatgctggagcggattttggcttttatagaaaaagagctgaagcagggaaggcaagcctatattatctgcccgctcattgaagagtcggataaactggatgtacagaatgcgattgacgtatataacatgctgtctgacgtataccggggtaaatggaatgtcggcctgatgcacgggaagctccattctgatgaaaaagatcaggtgatgagagaattcagcgccaatcaatgtcaggtacttgtgtcaacaaccgtcgtagaagtcggggtgaacgtgccgaatgcgacgattatggtcatctatgacgccgaccgtttcggattatctcagctccatcagctccgcggccgggtcgggcggggagaccaccaatctttctgcatcttgatggccgatccgaaatccgaaaccgggaaggaacggatgagaatcatgtcagagacaaacgacggctttgagctgtctgaaaaggaccttgaactgcgcggccccggtgatttcttcggaaaaaaacagagcggtatgcccgagttcaaggtggcggatatggttcatgactacagagctttggaaacggcccgccaggatgcggtcaacctggtgtcttcagaggctttttggaaagatgacgaataccgcatgctgcgcggtcaattactttcaagcggcgtcctagaaggggagaaattaagctgattctgtaaaattcggcggctttcaaaaaacaatcattgcattccaatctatgagattatatactactattagtacctagtcttaattgtccggatggtgtttacagatgagaagaagcaagaaagaacgccaaaaattattgcagcagacgatcaaatcgacacccttcatcacagatgaagaattagcggggaaattcggcgtcagcattcagacgatccgtttagaccgcttagagctctcaataccggagctgagggaaagaattaaaaacgtggcagaacaaacgcttgatgatgaagtgaaatcattgtctttagacgaagtgatcggtgaaatcattgatctggagcttgacggccaggccatttccatattagaagtaagacgcgaacatgtcttcagccgcaatcaaattgcgcgggggcatcatttgtttgcgcaggcgaactcactcgccgtagccgtcattgatgatgagctggcgctgaccgcaagcgcaaatatccgctttacaagacaggtgaaagaaggcgagcgcgtcgttgcgaaagccaaagtgacggcagtcgaaaaagaaaaaggcagaacggtagttgaagtcaacagctatgtgggagaagaagtcgtgttctccggcagctttgacatgtaccgttcaaaacaatcataaaggtggagcatgcatgagaatagctgtagatgcaatgggaggcgacaacgcacccaaagctgttattgacggagtaatgaagagtattgaggcatttgacgatcttcatattacgctggtcggtgacaagacaacaatagaatcacacttgccaacaacatcagaccgcatcactgtgttgcacgccgatgaagtgattgaaccgacggatgaaccggtccgcgccgtacgcagaaagaaaaactcttctatggtgctgatggcgcaggaagtggctgaaaacagagcggacgcctgcatctcagcggggaatacaggcgcactcatgacagcgggactgtttattgtcggcagaattaaaggaatcgaccggcctgcgcttgcgccgacgcttccgaccgtttcaggcgacggtttccttcttttggacgtgggagccaatgtcgatgccaaaccggagcatctcgtccagtacggaattatgggatctgtatatgcccggcaggttctcggaatcagctcgccccgcgtcggcttgttaaatgtcggcacggaagaaaagaaaggaaacgacctgacaaaaaagacgtttgaattattaaaagaaacaaacgtgaattttgtcggaaacgttgaggcgagagacttgctcgaaggcgctgctgacgtcatcgtcacagacggctttacgggcaacgtcacgttgaaaacattggaaggttcagcgttatcgattttcaaaatgctgaaagatacactgacttcaagttttgtttctaagctcgcagcgggagtgctgaagccgaagctgatggaaatgaaactgaaaatggactattctgagtacggcggggcgagtcttttcggtttgaaagcgcccgtcattaaagcgcacggctcttctgacgcacgcgctgtttaccatgcgctgcgccaggcgagagaaatggtcagccaaaacgtggccgcatttatagaagaagaagtaaaagaagaaaaaacagatgagtagtctggaggttaccgcatcatgagtaagattgcatttttatttcccggacagggatcacaatatatcggtatgggaaaagacctgtacgaacgcgaagaaacgtcaaaacgtatttttgatgaagcggatgaaacgcttgaaacaaagctgagctcgctcatttttgaaggtgacgctgaagaattgacccttacatacaatgcgcagcccgcgctgttgacaacgagcatcgccgtattggaaaagtttaaagaatcaggcatcacccctgatttcaccgccggccacagcctcggagaatattcggcgcttgttgcggcgggagcgatgacatttaaagatgccgtttacacggtaagaaaacggggagaattcatgaatgaagccgtgccggccggagaaggcgccatggcagctattctcggaatggatgcggagtccttgaaaaaggtgacggatcaagtgacggaaaacggtcatctcgtacagcttgcaaacctgaactgccccggccagatcgtcatttccggaacggcaaaaggcgtggagctggcttcagaggaagcgaaaaacaacggagcaaaacgggcgatcccattagaagtaagcggaccgttccattctgaattaatgaagccggcagcgcaaaaactcgaggaggtgctcagcgcctgtgagttgaaaaatgcggctgttcccgtgatttcaaacgtttcggctgacgttatgacagaaaaagacgatatcaagaaaaaactgatcgaacagctgtattcgcctgttcgctttgaagaaaccattaacaaactgattgacgaaggcgtcacgacgtttgttgaaatcgggcccggaaaagtgctttcaggccttgtgaaaaaagtgaaccgccgccttaaaacaatcgcggtttctgaccatgaaaccatcgaactggcgattcaaacgctgaaggaggagaatcaggatgcttaatgaaaaaacagcagtggtaacgggggcgtcccgcggaatcgggcgggcgatcgcgcttgatcttgcgaaaaacggctgtaacgtagtagtcaactactccgggaatgaagcgaaagcgaacgaagtcgtagatgagatcaaatctttgggccgaaacgcgatcgcggtaaaagccgatgtatcaaattccgaagaagtacaaaacatgatgaaagaggctgtcgctgcattttcttcaatcgacattctcgtgaacaatgcggggatcaccaaagacaatcttctgatgagaatgaaagaaaatgaatgggatgatgtcatcaacattaacttaaaaggtgtattcaactgcacgaaagccgttacaagacagatgatgaaacagcgctccggccggattatcaacgtatcatcaatcgtcggcgtcagcggaaaccccggccaggcaaactatgtggcggcaaaagccggagtaatcggcttaacgaagtcatcagccaaagagcttgcgagccgaaatattacggtcaatgccattgctccgggctttatttccacggatatgacggacaagctttctaaagaagtccaagatgaaatgctgaagcagattccgctcgcgcgtttcggtgatccttccgatatcagcagcgttgttacgttccttgcttctgaaggatcgcgttatatgacgggccaaacccttcatattgacggcggaatggtgatgtaaagatttgtttttaaaatttcatcctagtttctctagttttttaaaaacgaatcctctataatacttgaggggaggtgaattgctatggcagatacattagagcgtgtaacgaaaatcatcgtagaccgccttggcgttgatgaagctgacgtcaaacttgaagcttctttcaaggaagacttaggtgctgattccctagatgtagttgagcttgttatggaacttgaagatgagtttgatatggagatttctgacgaagatgctgaaaagatcgcaacagtcggcgacgctgtgaactacatacaaaaccagcaataagctgatgctaaaagtcccgcctgacagcggggctttagccctttaatcgttcggttaccggcgtctgacgctgtacgcgctgccgattccgtttacggcggggagcgcggtgaacctgatgtgcctatggaggttactatgtcaaaacactcacattttaaagataaaaaaaagttctataaaaaaatagagcaatttaaagagttccaagaacggatttcggttcattttcaaaacgagaaacttttgtatcaagcatttacacattcatcttatgtgaatgagcatcggaaaaagccgtatgaagacaacgaaaggcttgaatttttaggtgacgctgttttggaactgacgatctcccaattcttatttgccaaatatccggccatgagtgaaggagatttgacgaagctgagagccgctatcgtatgcgagccgtcactcgtctcacttgcccacgaattgtcattcggcgatcttgttctcttgggaaaaggagaagaaatgacgggcggcagaaagcgtcctgcgcttttagcggatgtgtttgaagcgtttatcggcgcactgtatctggatcagggccttgagccggttcagcaattcctgaaagagtacgtgttccctaaaataaacgatggtgctttttctcatgtgatggatttcaaaagccagcttcaagaatttgtacagcgggacggaaaaggatcgcttgagtacaaaattctcaatgaaaaagggcctgcccacaaccgggaattcgaggcgctggtctctcttaaaggtgaggcgctcggcatcgggaacggacgttccaaaaaagaagccgagcagcatgcggcacaggaagctcttgcaaaattgcaaaaacatcatacgaaacaataaaatccccctgtatccctagggggatttcagtatgtctgcgcctgatataagcgggtgattatgataatattgagatacttatacgataaggaggatctgggatgttcctcaaacgtttagacgttataggatttaaatcatttgcagaacggatatccgttgactttgtaaaaggcgtcacggccgttgtcggtccgaacggcagcggaaagagcaacattaccgaagccatccgctgggtgctcggcgaacaatcggcacgctcgcttcggggcggaaaaatggaagatatcatttttgcgggaagtgattcgcgcaagcggctgaaccttgccgaagtcacgttaacgcttgataatgaagatcaatttctcccgatcgattatcatgaagtcagcgtgacgagacgggtgtatcgttccggagaaagtgaatttctcatcaacaatcagcagtgccgcctgaaagacatcattgacttatttatggactccgggctcggaaaagaagcattctctattatcagccagggaaaagtcgaagagattctcagtagcaaagcggaagaccgccgcagtattttcgaagaagctgccggcgtgctgaaatataaaacaagaaagaaaaaagcggaaaacaaactgtttgagacgcaggataacttaaacagggtggaagatattctccacgagcttgaagatcaggttgaaccgctgaaaatccaggcatcaatcgccaaagactacttagaaaaaaagaaagagcttgagcatgtcgaaatcgcccttaccgcctttgacatcgaacaactgcatggcagatggtcgggtttaaaagacaaggtgcaggctgctaaagaagaagaattggcggaatcatcggctctgtccgcaaaagaagcgatgatagaagagacgagagataaaatccacgcgcttgatgaatccgtcaacgaactgcagcaggttctgctcgtgacaagtgaagagctggaaaagctggaaggccggaaagaagtgctgaaagagcgtaaaaaaaacgccgcgcaaaaccgggaacagctagaggaatccgttacacattacacgaacaaagaagccgaactgaaagcggacattgaaaagcagtctgccgtctatgataaacttcgtgcggaagtgaagcggttaaacgcccaggtgaaagaaaagcagcaggctctcagtctgcataatgaaaatgtagaagagaaaatcgaacaattaaaaagcgattactttgaattgttaaacagccaggcgtcgattcgcaacgagctgcagcttttagatgatcagatgtcccaatctgcggtccagcaggcgagactgaccgcaaacaatgaaaaataccttgaagaacgtaacgatattgcagtccgcaaagcggcgtgcgaagaagaattggccgccgttgaagaggatattcacaatcaggtcgtccgctttcgcgaagtccagacagcatatgaacagaaaaaacgccagtatgaaaagaaagaatcagcgctgtatcaggcatatcaattcgtccagcaggccagatccaaaaaagatatgcttgaaacgatgcaaggcgatttttcaggattttaccaaggcgtaaaagaagtgctgaagcagaaagagcagcttggcggcatccgcggcgccgttctcgaactgattgccaccgaacaaaaatatgagacggcgatcgagattgcactcggcgcagcggcgcagcacgttgtcacagacgatgagcaggcggcgcggaaagcgattcaatatttaaaacagaattccttcggccgcgcgacgttcctgccgcttacggttatgaaaccgcgccagctccaaacccgtgatgaacagacggcttcaaagcatccgtctttcctcggcacagcgagcgggcttgtcacatatgatgcggcgtatcggaatgtcattcaaaaccttctcggcaccgtgctgatcactgaagatttaaaaggcgcgaatgaactggccaagcttctcgggcaccgctaccgcatcgtgacgcttgagggcgatgtcgtcaatccaggcggatcaatgacagggggcgcggtcaaaaagaaaaacaattctctgctcggcagaagccgcgagcttgagacggtgactgcgcggcttgccgaaatggaagaaaaaacagctctgctcgaaaaagaggtcaaagcgctgaagcaggccattcaagagcttgaacatacgctgagcggcctccgtgaagacggtgaagctttcagaacaaagcagcaggatgtaaaaggcaggctgtatgaactcgaagttgctgaaaagaacatcaatacccatctggagctttacgatcaggagaaagcatcactgacggaaagcagccgggaaaaagagacgcgcaaatcagctctggaagaacagctgagtgaggcatccggccagctgaaagagcttgaggaagagatggaaaggctgacaaaacaaaagcagaccctatcctcaacaaaagaaacgctctctcatgaactgacggaatgtaaagtggccgctgcgaaaaaagaacaggcgtgctcgagtgaggaagacaatctcaaaaggctgaaaaaagagcttgaagaaacgcagctcgctctgaaagaaacacgggaagatttaagcctcctgacctcagagatgacgtccagcacaagcggagaggagcagcttgaagaagcagcccatcataagcttcacgataaaacgagaacgatcgaattgatcgccagccggcgcgaccagcgtgtgaagctccagcgggcgcttgatacgaacgagcttgagctgaaagagatgaagcgtctgtacaagcaaaaaacggacattctgaaagatgaagaggtaaaactcggccggatggaagttgagcttgataatctcttgcaatatttacgcgaggagtacagcttatcctttgaaggggcaaaagaacaatatcagcttgaactcgagcctgaagaggcgagaaaacgagtcaaactgatcaagctttcaattgaagagctcggaacggtcaatctcggcagcatcgatgagtttgaaagagtaaacgaacggtatcagtttttaacagagcagaaaaatgacctgacggaagcgaaaaacacactgtttcaagtcattgaagaaatggattctgaaatgacgaagcgattccatgaaacgtttatccagatccgttctcaattcaacgatgtgttccgttctttattcggaggaggacgggctgaactgaagctgactgatccgaatgatcttcttaattccggggtggacattatcgcgcagcctccgggcaaaaaactgcaaaacttaaatcttttgtcagggggagaacgggcgctgactgccattgcccttttattctctattctgaaagtaaggcccgtgccgttctgcgtccttgatgaagtggaagctgcgcttgatgaagccaatgtattcaggtttgcgcaatatttaaaaaaatacagcggcgacagccagtttatcgtcatcacccacagaaaaggcaccatggaagaagcggatgtcctctacggtgttacgatgcaggaatccggcgtttcccgaatggtttcggtcaaactggaagaaacaaaagaattcgttcagtaacgaggaaagaggttgaaagatgagcttttttaaaaaattaaaagagaaaatcacgaaacagacagactccgtctctgaaaaatttaaagatggtcttgaaaaaacaagaaattccttctcaaataaagtgaacgaactcgtctcccgctaccggaaagtcgacgaggatttcttcgaggagcttgaggaagtgctgattggcgctgacgtaggttttacaaccgtcatggagctgattgatgagctcaaaaaagaagtgaagctgaaaaatatccaggaccctcaggaagtgcagtccgtcatttctgaaaagcttgtcgacatttataacagcggtgacgaacagatttctgaattaaatattcaggacgggcgcctgaacgttattctgcttgtcggggtaaacggcgtcggaaaaacgacaacgatcggaaagcttgcccataagctgaagaatgaaggcaaatcggttgtgctcgctgccggagacaccttcagagccggggcgattgaacagcttgaagtgtggggagagcgtacaggcgtgcctgtcattaagcaggctgccggaagcgaccctgcggcggttatttatgatgccgtacacgcggctaaagcaagaggagcggatgtgctgatttgtgatacggccggccgccttcagaataaagttaacttaatgaaagagcttgaaaaggtcaaacgcgtcatcgaacgcgaagtgcctgaggctccgcatgaggttctcctcgcgcttgacgcgacgacaggtcagaatgcgatggcgcaggcgaaagaattctccaaagcgacgaatgtgacgggtatcgcattaacgaagcttgacggcaccgcaaaaggcggtatcgtcctggcgatccgcaatgagcttcacatccccgtgaaactggtcggccttggagaaaaggttgacgatctccagcggtttgatgcagaatcttacgtatacggtctcttttcggatttagttgaaaaagccgaggattaatgaataaaaaacgagtataaaatggacggttttatactcgtttttttatacgcattgatagatcggaatggaggggacagttgttggacaaatggctgaaagctgaattggaaagtaagatcggcgcgataaaccatatgttgctgctggatgaacagggaggcacttcaaccgttcgaaaaatagtgaccggtcaagacgcatttttgctgaaaagttcttttcaacagaagtatcgggaatggttaatgagagaagccttcgttttacaacaactgacggaaactcgtcgtctgcctgttcctatttattatgggatgatacaggaacagcatgccagccatatcatcatgtcatttgaggatggaatcaccctgacttcggctttaagaaaagccaaaggggatactgaaaagaaaaagctgatcaaaagtttcggccagtttctgcagcggctgcatgaaaccgaaatggtctctggtttacagccggaaacagactggctcgatctgcaaatcaaacgagccggggaatatgtcaaaaaaggacaagctgaaggaagtgcagagcttttgaaggaattggacaggtacaggcctgttcctgttcagcagacaatgattcacggtgactgcacgactgataatgtgctggtgagagacggagaggtctatctgtttatcgatgctgcgggaatatcggcgggagatccgcgttatgatgaatcattagcgatcagtcgttttgtcacaaatgaagcatgcctcaatgctttttacgaaggttattgccgctatcgtgtatcaaaacaagaattcgagtattttaacgacggtctgtatgaatttttttgaaaacttattatgtaaaaagagcatcatgctttgacaagataaaaacttgacacacgctctgaaaccatgtaaactaagtttttgtaaagggatttgacttaacaaaggggagagctcaaatgtcgctcgaaaaaacgacgagaatgaactatttgtttgacttctatcagtcgttgctgacgtcaaaacaaaagagctatatgtcgctttattatctggacgatttctcccttggtgaaatagccgaagagtatgacgtttcaaggcaagccgtttacgataacatcaaacggactgaagcgatgcttgaacaatatgaagaaaaactgctcctttttaaaaagtttcaggagcgtaaagaaatgtttacaaagctgaaagagcttgcttccggcttgcaggaagaggaaaaaatgacggctctgattgaagcgcttgagaaattagattaggaggcggcaaacaatggcatttgaaggattagccgaccgactgcaaaagacgatttcaaaaatccgcggaaaaggaaaagtcagcgaacaagacgtaaaagagatgatgcgtgaagtccgtcttgcgcttcttgaggctgacgttaactttaaagtcgtaaaggattttgtgaaaaaagtaagtgaacgggctgtcggacaggacgtcatgcagagtctgacacccggtcagcaggttattaaagtcgtaaaagaagagcttaccgagctgatgggcggcgaagaaagcaaaattgccgccgccaaacgcccgccgaccgttattatgatggtcgggctccaaggtgccggtaaaacgacaaccacggggaagcttgccaacctgctgcgcaaaaaacataaccgcaaaccgctgctcgtggctgcggatatttaccgccccgccgcgattaaacagctggaaacactggggaaacagcttgatatgccggtcttttcgcttggcgatcaggtcagcccggtggaaattgccagacaggcgattgaaaaagcgaaggaagagcatcatgattatgtgattttagataccgccggacggctgcacatcgatcatgaactgatggatgagctctccggtgtaaaggaagtcgcaaatcctgaggaaattttccttgtcgtcgactcaatgaccggtcaggatgcggtaaacgtcgccaaaagctttaatgaccagctcggtttaacgggcgtcattttaacaaagcttgacggggatacccgcggaggtgcggcgctttctatccgcgcggtcaccgaaacgccgattaaattcgccggaatgggagaaaagctcgatgctcttgaagcgttccatcctgaacggatggcatcccggattctcggaatgggtgacgtgctgacgctgattgaaaaagctcaggcgaccgttgatgaagacaaagccaaagagcttgagcagaaaatgagaacgatgagcttcacattggatgattttctggagcagctcggccaggtccgaaacatggggcctcttgacgaactgctgcaaatgatgcccggcgcaggcaaaatgaaaggcttaaaaaacatccaagtcgatgaaaaacagctgaatcatgtggaagcgatcattaaatcaatgactgttcttgaaaaagaacagccggatattattaacgccagccggcggaagcggattgccaaaggaagcggaacatccgttcaggaagtcaaccgtcttttaaagcagtttgaggaaatgaaaaaaatgatgaagcagatgaccaacatgtcaaaagggaagaaaaaaggctttaaattaccttttatgtaatcggttatacatgataaaaccgttgttaagaaaaaacactttacaaacacttttatcattgttaatatactatcttgttgaaatattttcggaggtgctagtaaaatggcagtaaaaattcgtttaaaacgtatgggagcaaaaaaatctcctttctatcgtattgttgtagcagattctcgttcaccgcgtgacggccgtttcatcgaaacagtcggcacatacaacccggttgcaaagccggctgaagtgaaaatcaacgaagagcttgctcttaaatggcttcaaacaggagctaaaccttctgatacagtccgcaacttgttctcaagccaaggaattatggaaaaattccacaacgctaaacaaggcaagtaatgactgatcagaacttggaagatttgattgtcagcattgtggctccgcttgtcgaccatccggaagacataacggtcacaaaggaagagactgatcaaaagattgcgctgcgcttatctgtcaataagtcagataccggtaagattatcggaaagcaaggccggactgcaagagcgattcgaaccgtcgtttttgcagctggcgcacagtcttctaagaaagttcaatttgaaatatttgactgaaaaagggagagggccggcacctcccctttttttacacgtaaaaaaggcaaatgaacagaaatatgttggaagagtggggagtctggtcctatgcagattattcacagggtaaccgttatgcaggttctgaccgagcaaagcaaggaaaagcttttggcctcttttgcagaaaaaaagcaaacgcttgaacgagaatgcagccagctctattttcagcttagaaaacatgaaaaagatcagcagaatcccgatgtagcggaatcttttaaaaaagccattgaaaaaagacaagacaaaatcaaaatgatcgatttccaaataagccagacagagtcgctcccgcttggaagcgaagtgaaggaaaaggagatcgatgcgctgctttcaatcaatgtcggtgataactggcatgaaaaaacagcggcaaataccatcgtcataaaagacggggtagtaattgaaatccgcccgaggtgataatatgacaaacagatggtttaatgtaggcaaaattgtaaatacccacggcattaaaggcgaagtgcgggtcatttctaaaacggactttgccgaagaacggtacaagcccggcaatacgctctatttgtttgcggaaggggctgcggagccaatcaaagtaacggtcagcgcccacaggctccacaaacagtttcacctgctgcaattcaaagaaatgccgagtctcaatgaagtcgaacacttaagaaacatggtgatcaaagtccctgaagaagacttgggagagcttgaagaagatgaattttattttcatgaaatcatcggctgcgaggttgtgtcagaagacggggaactgattggcacagtgaaggaaatcttgacgcccggggctaatgacgtatgggtggttgcaagaaaaggcaaaaaagatgcgctcattccgtatattgcttctgtggtaaaggatattaatataaatgagaagaaaattaagattcatgtaatggaagggttaatagacgaatgaaaatcgactttttaacactgtttcccgaaatgtttcaaggggtgctcggctcatccattctgcaaaaagcacaggaaaaagaggctgtccgttttgacgtcatcaatttccgggctttttcggataataaacaccaaacggttgatgattacccgtacggcgggggagccgggatggtgttaaagccgcagcctgtatttgatgcggttgaaaagctgacagccggtacggacgccaagccgcgcattattctcgtctgcccgcaaggtgagcgttatacgcagaagaaagccgaggagctggcggaagaggaacatctcatgtttatttgcggacattatgaagggtatgatgaacggatccgggaacatcttgtcactgatgaaatctccatcggggattttgtgctgaccgggggagagctccctgccatgatgattgccgacagcgttgtcaggcttttgccgggcgtcctcggaaaagaagcatcccacgtggaggattccttcagcacggggcttttagagcatccgcactatacgaggccagcagattataaaggcttaaaagtgcctgagacccttctgtccggcaaccatgccaaaatacaagaatggcgcaataaagaatcaatcagaagaacctttttaagacgtccggatcttcttgaaaactatcctctcactgatgagcaaagaaaatggatttccgagtgggaaaacgaatagattctattgcgcaggtgatgaagatatgataagatactacttgtggcttaaggaggcttatccttcagaagcttgaaaacgatgttccgctgtgccttgcagttgtggccaagagcatctgttggaaggagttgaaaacgatgcaaaaactaattcaagatatcacaaaagaacagcttcgcactgatcttcctgcgttccgtcctggtgacactttacgtgtacacgtaaaagttgttgagggtaaccgtgagcgtatccagatcttcgaaggtgttgtgatcaagcgtcgtggtggtggaatcagcgaaacgttcacagttcgtaagatttcttacggtgttggcgttgaacgtacattccctgtacacacaccaaaaatcgcgaaaatcgaagttgtacgttacggtaaagtacgtcgcgctaagctttactacctgcgtgaacttcgcggaaaagcggctcgtattaaagaaatcagacgataatgataacgaacgaaaagagcttgttacccgtaacaggctctttttttatatgaaatttgtaaaagcggaacaagcaacgtaaaatacataagagatcatcggaacatccggttccggtaaataaggcaggtgtcgaagtcacatgaccattcaatggttcccgggccatatggctaaagcgagacgggaagtaacagaaaaactgaaattaattgatatcgtatacgaattggtggatgcgagaatcccgatgtcatcgagaaatccgatgattgaggagattttaaaaaataagccgcgcattatgcttttaaataaagccgataaggcggatgcggctgtgactgcccagtggaaggaccactttcaggaacagggcattccctctctttcaataaactccgttaacgggcagggactgcatcaaatcgtgccgtcctcgaaagagctgctgaaggataagttcgataaaatgaaagcaaaaggcattaggccgagagcaatccgcgcattaatcatcggcattccgaatgtcggcaagtctacgctcattaaccggctggccaaaaaaaacattgccaagacgggagacaggcccggcattaccacttcacagcagtgggtaaaggtaggcaaggaattagagctgctcgatacaccgggaattttatggcctaaatttgaagatgagcttgtcggcttgcgcctggcgatcaccggggcgattaaagatacgattatcaacctgcaggatgtggctgttttcgggctgcgctttctggaagagcattatcccgaccgtttgaaggagcgctacggacttcaggaaatccctgaggatatcgccgctcttttcgacgcgatcggtgaaaaacgcggctgtttgatgggcggcggaatggttgactatgataaaacaacggaagtcatcattcgggacatccgtacggaaaaattcggcaggctttcatttgaagcaccatcagaataaagacgcgcagcgatgcgggtctttattttttccgcagaataccgatatacataatgtaagggagaagagaacgtgaatacattaaccgtaaaaagcgtaaaagaacgcctgcaagaggtcagggacgaaagcgaccccttccttgcccaatgtgagaaagacccgagaaaaagcgtacagacgcttttagagcaatggctgaaaaagcacgcgaaggaaaaagctcttaaagagcaatggctgaacatgacggcatacgaaagactgtcatccaaaaagggcttccgcctgattgcgggtgttgacgaagccggaagagggccgcttgccggaccggttgtcgccggcgccgtcattttgccggcagaatgcgagattctcggtctcacggactcgaagaaattgtcggaaaagaagctcgaggagtattacagccggatcacggaagaagcggcggctgtaggagtcggcattgtccatgcggacgtcattgaccggatcaacatttatgaggccgcgagactggcgatggtaaaagccgtcaatgctttaacggaaacacctgattatctgcttgttgatgccatgacccttccgcttgacattccgcagtcttcagttataaaaggggatgccaaaagcgtgtcaattgccgccggagcctgcatagcaaaagtaacgcgggaccgtctcatggctgagtacgccaaaacctaccccatgtacggctttgaaaaaaataaaggctacggaacgaaagaacatcttgaagctcttcaggcatacggaccgacaactattcaccgaaaaacgttcgctcccgttcaatcttattgttagaaaagaggcttaagacatgaacattagcggcgaaatccaagcggctttcagacagctgacggcggaaatccctccggaccggcaggacggcgataaagacagcggtactcaaaggctgctgttagggaaggttctccgtttgctggacgatcaaagcgctcttatccagatcggcggccggacgatgcagggaaaacttgaaaccgcccttcgtccgcaggcgtattactggttttcttatgacaaacagccggcggaaaaaacgggccggcttcatgtcatcgaccaattcgaaggaagcccgaaaaccgttcaggaagcagcgggtagactgttaaacgctctttccgtcaaaccgggccctgtgtctctgcagattgccgaaacgtttatgcagcagaagctgccgatgacggaaaacagcctcaaagcctgcatccgctgggctgaatcgcttccggccgccgaattgaaaaaagcggcggaaacaatcgtatttgcgctgaaacgggaactgcccgcacatccggaagtcttgtcagccattcatgccgttaaatatccggttccgacccgtcgcctcctctcaggactgcttcaggcaatcaatcaggctccgcaatcggcaaaagagctgtctgtgctcaaagaggcggtttctgacgtattaaacgcggaaacggatcttcatgcagaacgtctcttgaagaagcttgccgaggctgcacgcatgccgatcccagaaaccgggctgatggatgaagaagaacggacggaatccaaacaatcaccatttgtccgagagactcgtgaaaacggaaaggcagtctcaagccaaccttctcctccgagtgcgcggacagatccggaacttcctgaaaaaacggcaaaacagattatagagaaattaatgacatcggcagaaaaaactgaaaaccgccccgtaaaagtaacggcggagatcattaaggctttcatttctcaagaaaaaacatttaaaacagcacctgttcttcaaaaagcacatctgacagaacaggaggcggctgttttcgaaaaagccgttcagctcaccgaattgaaatatgcggaaaaacatgatgtattaagccttttgcagaaaatcaaaaaaggattgggcacgcgtgatgaattatcattcattacagcgcttgaaaaaggcgtatctcttcagccggagaaacaagcgctgaaaaccgccctccaagccgtccggacgcttcaagaagcgccccaatccgttaaacaagaggctgaaccgcttattcataaattaaacggccagctgtttattgagcagcataacccttcttttacgcagatggtgctgtcatttccgctgggagcgtccgcgtatgagaatgatatcacagttctctttaaaggacggaagaagccggacggaaaactcgatccgtcacattgcaggctcctgtttttgctgcatcttgaaacactgcaagaaaccgttgtggactgcatgattcagcaaaatgtaatgaccattacggttgagactgattttgagcttcagtcggccatcgatcctctcgtaccggctttaaaagaagccgtaaaagaaacgggcttcagcctgtcaggcgtcacggctaaaaaacggcgcccgaaagaccagagcgctcttgtggaagagtttatagaaaaagacggcggaagaaaagtggatgtgaaaatatgaaagagcaaacgccgttaagaagagctgtcgccctgcattacgaccggcagaaagaccaagccccgaaggttgtcgcaacaggcagggggcatgtggcggaaaatattataaaagaagctgagaaggctggggtccccattcaggaagacagaacccttgtcgaattaatgcgccatttgacggttgacgatcagataccggaggcgctctatgaaaccgtggccgaaattttttcatttgtttacagactggacgaaaccctgaaaaacgaaaaataaggaccattcatttcccggactccgtttaaatttatattttcaataaaataaaagttagaatgtttggaaggatataaagattttgttttgaaccctagacaattcttccagtattatatagaatgaaagcgcagtctatttttagttttgctacataagttaggaggatgggaaatgaatatccatgagtaccagggaaaagaagtcctcagaaaatacggggtgtctgttcctgaaggtaaagtggcttttacagcagaggaagcagttgaaaaagcagagagcctgtcaagctcggtttatgtcgtaaaggcgcaaatccatgctggcggccgcggcaaagctggtggggtaaagattgcaaaaacaaaagatgaagtgaaagagtatgccgaagaactgttaggcaagacgctcgtcacacatcaaacgggtccggacggacaagtaataaaacgcttacttattgaagaaggctgcgatattaaaaaggaatactatgtcgggcttgtacttgaccgcgctacttcaagaatcgttttaatggcgtctgaagaaggcggaacggagattgaagaagtagcggaaaaaacacctgaaaaaattaaaaaagcggtaattgatccggctgtcggcctacagggctatcaggcaagggaaattgcattcgcaattaacatcccgaaagagcttgtcggcaaagccgctaaatttatgctcggtttatataaagcatttgttgagaaggactgctccatcgccgagatcaaccctctcgtcgttacgggggacggaaacgtcatggcgctggatgctaagctgaacttcgacagcaatgcgttatacagacaaaaagacattatggaatacagagatttagatgaagaagatccgaaagaaatcgaagcgtcaaaatacgatttaagctacatttcccttgatggaaatatcggctgtatggtaaacggcgcgggtcttgcaatgtctacaatggatatcattaaacactacggcggagaacctgcaaacttccttgatgtcgggggcggcgcaaccgcagaaaaagtgacggaagcttttaaaatcattctttccgatcaaaacgtaaaaggaattttcgttaatattttcggaggcatcatgaagtgtgatgttatcgccgagggcgttgttgaagcgacgagacaagtcggattgacattgccgctggtcgtgcgccttgaagggacaaacgtagatttaggaaagaaaatcctgaatgaatcaggcttaaacatcacatctgcggaatcaatggcagacggcgcacagaaaatcgtatccttagtttaggaaagaatgaaaggcaggggaccagataatgagtgtttttatcaataaagatacaagagttattgtacaggggattacaggttctaccgctttatttcatacaaagcagatgctggaatacggcacgaatatcgttggcggtgtaacacctggaaaaggcggaacggaagcggaaggcgtaccggtattcaatacggtcgcagaagcggttcatacaacgggcgctgatgcgtcagtcatctacgttccggctccgtttgcggcggacgcaattatggaagcggttgacgcggaaattgatcttgtcatttgtatcactgagcacattccggttttggacatggtgaaagtgaagcgctttatggaaggcaagaaaacgagattaatagggccgaactgcccgggtgttattacacctgaagaatgcaagatcggcattatgccgggatacattcataaaaagggtcatgtcggcgttgtatcccgttcaggaacattgacatacgaggccgtccatcagctttcagaagccggcgtaggccagtctaccgctgtagggatcggcggcgatccggtcaacggcacgaactttattgacgtgttaaaagcgttcaatgaagatcctgaaacacatgccgttatcatgatcggagaaatcggcggcacagctgaagaagaagcggctgagtgggtgaaagcaaacatgacgaagcctgttgtcggctttatcggcggtaaaaccgcccctccgggaaaacgcatgggccatgcgggcgccatcatctccggaggaaaaggcacggcagaagaaaaagtcaaaacgatgaacgcctgcggaattgaagtcgcggaaaccccttctgtaatgggtgaaacgctgattaaggtgttaaaagaaaaaggcttatttgaaacgtgcaaaacgcactgatcgaagcaggggcagccgtaacggctgttcctgtttttgctgaaaaaagaggaggttgccagatttggatcaagcatcgcgctgtttaatggtctgcagtattaatcaaatcatttccccgtctcttctattaaaatggtggaaagctgatcactctctgtcttttttaccggatccgcatccattaactgctttatcagaagggaaaacagtgcccgaagcaatttttcgggaaatagagcgcaaggatccggaacttgatgaagttctgtccgattaccgccgcgaaggcattactgtcattccgatttcatcaagccgctacccaacatggcttaaatcgatttatgatccgccggctgtcttgtatgcaaaagggaacacgccgcttcttgaaaaaggcagaaaaatcgggattgtaggaacgcggaaaccgacggaagacggaataaaagcggctgggcatctttccgccgaactctcaaaaaaaggctgggtcattgtaagcgggcttgcatccggtatagacggattgtctcataaggcgagcatcagggcaaaagggcttacgatcggcgtgatagccggcggattccatcacatctatccccgggaaaatctcctgttagcagaatacatggctgaacaccatctcctactctcagaacatcctcctgaaacaaagccgaaaaaatggcattttccgatgagaaaccgcataatcagcggactaagtgaaggaattgtggtcgtacagggaaaagaaaaaagcggttcattaatcacagcttaccaggccctcgatcaaggcagagaggtatttgccgttccaggttccatatttaatccatattccggaggacctataaaactcattcaagaaggggcgaaagctgtattatgcgcagaggatattgacggagagctgaccgcccgatgcgttcagtatacggaacccttttgaaatatcgtttgacaaacggtattgtaatatttaataatagtgaggatttaaagttgcatattattttcatgtataaaatgacgttcatcataaagaatgaaatgttgaaagccataaaaaggcagctctaaaatgaattgatacttgaaaagagagagaacacctcttgagggggatgaaaatgtctgattatctagtcatcgtggaatcgccggcaaaggcgaaaacgattgaacgttatttagggaagaaatataaagtcaaagcttcaatgggacatgtccgggatcttccgaaaagtcaaatgggagttgacatcgaacagaactttgaaccgaaatatattacgatccgcggaaaaggccctgttttaaaagaattaaaaacagcggcaaagaaagcaaaaaaagtctatctcgcagccgaccccgacagagaaggggaagcgattgcatggcatctcgcacacagccttgatctggatctcagctcggactgccgggtcgtctttaatgaaataacgaaagacgccattaaagaatcatttaaacatccgcgcatgattaatatggatcttgtcgatgcgcagcaggcgcgccgcatactagacagactcgtcggatacaaaatcagcccgattctttggaaaaaagtaaaaaaaggcctcagtgcgggccgtgtgcaatccgttgcgctccggctgatcatcgaccgggaaaaggaaatcaatgactttaaacctgaagagtactggacgattaccggctcatttttaaagggaaaagagacgtttgaagccggatttttcgggaaaaacggcaaaaagcttcctttaaaaagcgaagaagacgtaaaagccgtccttgctcagctgaaaggcaataagtatacagttgacaaggtgacaaaaaaagagcgcaaacgaaatcccgctctgccgtttacaacgtccactctgcagcaggaggctgccaggaagctgaatttcagagcgaagaaaacgatgatgatcgctcagcaattatatgaaggaattgatctcggcaaagaagggacagtcggactcatcacgtatatgagaacggactcaacgcggatttccaatacagccgttgaagaggcgtcagcttttattgatcaggcgtacggaaaagagtacttagcgggaaaacggaaaccggcaaagaaaaatgaaaacgctcaagatgcccacgaagcgatccgcccgacttcagtactcagaaaacctgccgacttaaaagcggtgcttggaagagaccagctcagactatacaagctgatttgggagcgctttgttgcaagccagatggcgcctgccgtccttgatacgatgagtgtcgatctcagcaataacggattgacattccgggcaaacggaagtaaagtcaaattcgccggcttcatgaaagtctatgtagagggtaaagacgatcagctggaagaaaaagaccgcatgcttccggaccttaaagagggagacacggttttatcaaaagatattgagcctgagcagcactatactcagccgcctccgcgttatacagaggcgcgcctggttaaaacgcttgaagaactggggatcggccgtccttcgacatatgcgccgactcttgacaccatccagcgccgcggttacgtgggattagacaataaacggtttgtgccgactgagcttgggcagatcgtgctggatcttatcatggagtttttcccggaaatcatcaacgttgaattcacggctaaaatggaaagagaccttgaccatgttgaagatggccagacagaatgggttcaaatcattgacagcttctataccgatttcgaaaaacgcgtgaaaaaagcggaagctgaaatgaaagaagtggaaattgaacctgaatacgcagatgaagattgtgaattatgcggctcccggatggtttataaaatgggccgatacggtaaatttatggcgtgttccaacttccctgactgccggaatacaaaaccgattgtcaaacaaatcggcgtaaaatgtccgaagtgccatgaaggaaacattgtcgaacgaaaatcaaaaaagaaacgcgtcttttacggctgtgaccgttatcctgaatgcgacttcgtatcttgggacaaaccgattgaacgaaaatgcccgaaatgtgaaaatatgctcgtagagaaaaagcttaaaaaaggcatacaagtccaatgcgtcgaatgcgattataaggaagaaccacagaagtagcggtgagcagagccttgctcaccttctttgtgtggaagggacaaacaacaggagatgaaaagaaatgaaccagcaaacagttaatgtaatcggagcaggccttgccggaagtgaagcggcatggcagcttgcaaaacgaggaattcaagtaaaactatacgaaatgcggcccgtcaggcagacggcagcccatcatactgataaattcgctgaactggtatgcagcaactccctccgttcaaatacactcgccaatgcggtaggcgtattaaaagaagaaatgcgggcgcttgactcagcaatcattcaatctgctgataaatgctcggttcccgcagggggagcgcttgcagttgaccgccatgaatttgcgcaaagcgtgacggatctcgtgaaaaaccatccgaacgtaacggttcttactgaggaagtaacagagattccggaaggcccgacggttatcgcgaccggaccgcttacgtcagaatcgctttcacagcagctgaaagagctcacgggagaagagtatctgtatttttatgacgcggcggcgccgattgtcgaaaaagacagccttgatatggagaaagtgtacttaaaatcccgttacgacaagggagaagcggcatacttaaactgcccgatgacagaggaagagtttgaccgtttctatgaagcattgacgacggctgagacggttcctttaaaagaattcgaaaaagaaatcttctttgaaggctgcatgccgattgaagtcatggcgaaaagaggcaagaaaacgatgctgttcggaccgatgaaaccggtcggactggaagatccgaaaacaggcaagcgcccttatgcagtcgttcagctcagacaggatgacgcggcgggaacgctttataatattgtaggttttcagacacatttaaaatggggagaccaaaaagaagtgcttaaactgatccccggccttgaaaatgttgatatcgtcagatacggcgtcatgcacagaaacacatttatcaactcgccgagtcttttgaacccgacatatcaatttaaacagcggaacgatctgtttttcgcgggccaaatgaccggtgtagagggttatgttgaatctgccgcttcaggtcttgtagcgggaatcaatgccgccaaacttgtgctcggtcaggatcttgtgacattcccgcaggagacggcgatcggaagcatggctcactacattacgacgacaaatcagaagaacttccagccgatgaatgcaaacttcggcctcttaaaagaattgcctgtaaaaattaaaaacaaaaaagaacgaaatgaagaatacgctaaacgcgcaattgagactattcaaactatttcgaaaacgatatagcttttcattgcaacttcgatgcattatatgataccatttaaaagcccttcggagagggaggtcttcataatgactgagaatgttaacttttttttaaagttattcgttgaatatttacaaattgaaaaaaattattcacaatatactattgtgaattatgttaattcgattgaagaatttgggatgtttctgcatgctcaaaatataaatggaatgaaagaagctgcatatcatgatgtgagaatatttttgacagaggcttatgaaaaaggcctgtcaagaaaaacaatcagcaagaaaatttcagctttgagaagcttctataaatttttaatgagggaaaagcttgttgaagagaatccgtttcagcttgttcatctgccgaaacaagagaaacggattccgaagtttctttatgaaaaagaacttgaggaactattcgctgtctcagacagaagtcagccgtcagggatgcgcgatcaggccctgcttgagcttctttatgcgaccggaatgagggtcagtgagtgctgtacgctcactgtcggcgatcttgacctgttcatggatacggtgctcgttcacgggaaaggcaagaagcagcgctatatcccgttcggctcatatgcccgtgatgcgctggagctgtatatcaacagcggaaggcagtgcctgcttgaaaaagcaaaagagcctcatgatgtgctgtttgtcaatcaaagaggcggcccgctgaccgccagaggaatccggtatattttaagcgggcttgtaaaaaaagcatccggcactttacatatacacccgcatatgcttcggcacacgtttgcgactcatctgctgaatgaaggggctgatttaagaagcgtccaggagcttttgggccattccaatctgtcttctacgcagatatacacgcatgtatcgaaggaaatgctgagaaacacatatatgtcccaccacccgagagcttttaaagaaaattaaaaggaggcccttctcatgtcatcttttcatgcgacaacgatttttgccgtccagcataacgggaaaagcgctatgtcaggagacggccaggtcacattcggtcaggctgtagtcatgaaacatactgcgagaaaagtgagaaagctgtttaacggaaaggttctggccggatttgcgggatctgttgcagacgctttcacactttttgaaatgtttgaggcgaagcttgaagaatacaacggcaatttaaaacgggcgtcggttgagcttgcgaaagaatggcgcagcgataaagtgctgcgcaagctggaagccatgctgattgtcatgaaccaggataccttgcttctcgtatcgggaacaggtgaagtgattgagccggatgacggcattttggcaatcggctccggcggaaactacgccctgtcagcaggaagagcgctgaaaacctatgccggagagaatctgtccgccaaagatattgcaaaagccgctttgaaaatcgcaggcgagatttgtgtgtacacaaacgatcagatcattttggaagaacttgaatagaaaggacttgaggcgcatggaaaacaaaccgttaacaccgagacaaatcgtagatcggttggatcaatacattgtaggacagcaggatgcgaaaaaagctgtcgccgtggcattaagaaaccgctatcgcagaagtcttcttgatgaaaaactgagagacgagatcgttcccaaaaacatcctgatgatgggcccgaccggggtggggaaaacagagatcgccagacggatcgccaagcttaccggtgcgccatttataaaaattgaagcgacaaaatttacagaagtcggctatgtaggcagagatgtcgaatcaatggtcagagaccttgttgagacatccgtgcggctcattaaagaagaaaaaatcagcgaagtgaaagaacaggctgaagaaaatgcaaacaaacgtatagtgcggcttctcgttccgggaaagaaaaaacaagcgggtgtgaaaaatccgtttgaaatgcttttcggaggaagccagacggcaaatgatgatgatgccgaccagcaggaagaagcaagccttgaagaaaaaagaaaacgcatggcgcatcagctcgcattgggagagctcgaagaccattacgtctccgtagaggtggaagagcagcagccgtcgatgtttgacatgctgcaaggctccgggatggagcagatgggcatgaatatgcaggatgcgctgagcaatctgatgccgaaaaagaaaaaacgccgcaaaatgacggtcagagaagcaaggaaggttctgaccaatgaagaggcaggcaaattaatcgatatggatgaagtcggccaagaggccgtgttaagagctgaagagggcggcattatctttattgacgaaatagataaaatcgcaaaaaacggaggggcttcttcctcagcagatgtatcgagagaaggcgttcaaagagatatccttccgattgtcgaaggatctaccgtcgtcacgaaatacggctccgtcaagacagatcacgtgctgtttatcgcagccggggcattccatatggccaaaccgtctgatctgattccggagctgcagggccgctttccgattcgtgtagaattgagcaagctgacggtggatgattttgtgaagattctcgtcgaacccgataacgcgctgttaaaacaatatcaggctttattgcagacagaaggtatatctcttgaattttctgacgaagctattcgtaagatcgccgaagtggcttatcatgtgaatcaggacacggacaacatcggagcgagaaggcttcacacgatattggaacgtctcttggaagacctgtcgtttgaagcgccggacgtgacgatggaaaaagtcgccatcacgccgcaatacgttgaagaaaagctcggaacgattgcaaacaacaaagatctaagtcaatttatattgtgaaaatttaataagaggaattctaggaggattatttatcatggctttactacaaaaaacacgaattattaacagcatgctgcaggctgcggcaggcaaacccgtaaactttaaagaaatggctgaaacgcttcgtgacgtcattgattctaatattttcgtcgtcagccgcagaggaaagcttttgggctactctattaatcagcagattgaaaatgaccgcatgaaaaaaatgcttgaagaccgccagttcccggaagagtacacgagaaatctgttcaatgttccggagacgtcttcaaaccttgatatcaacagcgaatacacggcgtttcctgtggaaaacagagacctgttccaagcgggcttaacaacgatcgtgccgatcatcggcggaggagagagactgggcacgctgattctgtcccgtctgcaggatcaatttgaagatgatgatctcattcttgctgaatacggagcaaccgttgtaggaatggagattttaagagaaaaagcggaagaaatcgaagaagaggcgcgaagcaaagcggttgttcaaatggcgatcagttctctgtcttacagtgaacttgaagcgattgagcatatctttgaagagcttgacggaaacgaaggcttgctcgtggcaagtaagattgcggaccgtgtcggcattacgcgttcagtaatcgttaacgcgctgagaaagctggaaagcgcaggcgtcattgaatccagatcactgggaatgaaggggacgtacattaaagttctgaacaacaaattccttattgaattggaaaaccttaaatctcattaagacaaaagcaggatccctgaaaatggggtcctgctttttttatggacaataggtgaaaagttgcagtttaaagttgcttattggaagctgatctgagataatccatcttgctgtgtgaaaaaaggaggaagatacagaaattctgctattttcagtcttatattaaacaaatgcttgtagtccaaatactctaggacttaatacctacatgcaaaatagatataattgagcactttttttagcctaacttcatagactttaagcctgttatttcttacaataagcatatggttttacaattctcgacaaggatttttaggagaaaaatatctgaaatggaggtaagtggatttggacttattttctggaactatacaaaatcttgagaatgccttggggagagcggacattaagcaaaaagtcttaactaataacatcgccaatatagatacaccgaactataaggcaaaaaaagtctctttccgaaatttgttagatcaggaaacatccaatcgtgaggcggtaaaaaccgactatcggcacgttgactttacgggttcaggggacgattattctatcgtgtccagcagtgatacatcgtaccagcaaaacggaaacaatgtcgatatcgacaaagaaatgacagatttagccgaaaaccaaattaattatcaggctttggttgaaagaatgagcggcaaattcaattctctgaaaaccgtcttgacaggaggaaaataatgagtggctttcaaagcttaaatatttcgggctccgctttaactgcacagcgtgtccggatggacgtcgtatcgtccaacctggccaatatggatacaacgagagcgaagcaggtaaatggcgaatgggtgccttacagaagaaagctggtatctctccaatcgggaggcgagtcattttcgtcccttttacattccaagatgaacggaacaggaagcgctggaaatggcgtaaaggtatctggcgttacggaagacccgtccgcttttaatctcgtttatgatccggagaatcctgatgcgaataaagacggatatgtgcaaaaaccaaatgtagacccattaaaagaaatggtggatcttgtcagcagcacgagatcatatgaagcaaacgtaactgcattaaacgcctccaaaggcatgcttttgaaggctttagaaatcggaaagtaaggtgatgtaagtggttaacgctattactccttttcagcttcaacaaacccaaaacactcaaaacgtaacgaatcaattaaaccaaactcaaaaaactgattcttcaaaccaaacaagcttttcggagcttttaaaaaactctattgattcgttaaatgagtcacaagtaaaatctgaccaaataacgaacgaactggctgcaggaaaggatgtaaaccttgacgaggtcatgatcgctgcccaaaaagcaaatatctctctgacggccgctaccgaattccgcaataaagccgtggaagcctatcaggaaatcatgagaatgcagatgtagtggtcagattgaagagaatgactggaatgaccgggggttaacatgaatcgtactctaatgcaaatgaaaaccaaaacggcagcgttttggaacaacagatcaaaaacacagaagatactcatggtaagcggcttggccgcattcattattttactcatcgtcgttattatttttacttcgtctgaaaagatggtgcctctttataaagatttgtccgcggaagaagcggggaagattaaagaagagctcgatacgaaaaaggtgtcttctgaacttgctgacggcggcacggtcataaaggttcctgagagccaagtggattcgcttaaagtccagcttgccgcggaaggcctgccgaaaacgggatcaattgattattcgtttttcggacaaaatgcgggcttcggcctgacagataatgagtttgacgttttaaaggttgaggcgactcagaccgaattgtcaaacctgataaatgaaatggacggtattaaaaactcgaaggtcatgatcaatatgccgaaagaagccgtgttcgtcggtgaagatcagccggcagcgtccgcatccatcgttttgcagatgaaaccgggctactcgcttgatcaaaaccagatcaacgggctgtaccatctcgtttctaaaagtgttccgaacttaaaagaagataatatcgtcataatggatcaaaattctacatattatgacaaaagtgacagcggtgcagggtccgtttctgacagttatgcatctcagcaaggtattaagtcgcaggtcgaaaaggacattcaaaaacatgttcagtcactgctcggcacaatgatggggcaggataaggtcgttgtttccgtaacggcggatattgactttacgaaggaaaaacgcactgaagacactgttgaacctgtcgataaagataacatggaaggcatagcggtaagcgccgaaaaagttgcggaaacgtataaaggcgacggcgcagccaacggcggcacggccggaacgggaagcaatgacaccgcgaactatgccgagacaaacggcggttcaaacagcggggactacgaaaaaagcagcaataaaatcaactatgaagtcaaccgcattcataaagaaatcgcggaaagcccgtataaagtgcgtgatttaggcattcaggtcatggtggagccgcctaatccgaaaaatgccgcttccttatcagcacagagacaggctgatatacagaagattttaggaacggtcgtcagaacgtctcttgataaaaacgaaacgcaaaatcaaaacctgacagacaatgatatcaacaataaaatcgttgtatccgttcagccgtttgacggaaaaacaagcctgaacacagattcggcacaatcttcaggtcttccgatctgggtatacattacaggcggcgtactgcttgcggccattattctgcttattattctcctcatcagaaagaaacgctcacaagaggatgaatacgaagaatatgaatatgaaacaccgccggagccggttcgattgcctgatatcaacgaagagaaaattgaaacggaagaaacagtcagacgaaaacagcttgaaaaaatggctaaagaaaaaccggaagactttgctaaattgcttcgaagctggctggacgaggattagggggaatggaaaatggcgaaacgtgatcagaacaagcttacaggaaaacaaaaagcagccatcctcatgatttccttaggccttgatgtatcagcttctgtgtacaagcatttgtctgaagaagaaattgaaagattgactctcgagatttcgggagtcagaagcgtcgatcatcaaagaaaagatgaaatcattgaagaatttcataatatcgcaatcgctcaggactatatttcacaaggcggtttaaattacgcccgccaagtgcttgaaaaagcgctcggagaagataaagcggtaagcattttaaacaggctcacctcttctttgcaggtaaagccgtttgattttgcaagaaaagcggagcccgaacagattttaaatttcattcagcaggaacatccgcaaacgatggcactgattttatcctaccttgacccggtgcaggccggacagattttgtctgagctgaacccggacgttcaggctgaggtggcaagaaggattgcggttatggacagaacgtctcccgaaatcataaatgaagtggagcgggtccttgaacaaaagctgtcctcctcctttacgcaggattatacgcagaccggcggcatagaagccgttgttgaagtgttaaacggcgtagacagaggaacggaaaaaacgatccttgattcattagaaatccaagatcctgaattggcggatgaaatcaaaaaacggatgtttgtctttgaagatattgtcacccttgataaccgtgcgattcagcgcgtgatcagagacgttgaaaacgacgacctcctgctttcattgaaggttgcgagcgaggaagtcaaagagatcgtcttcagcaatatgtcacagcgtatggttgaaacgtttaaagaggaaatggaaattatggggcctgtgcgtttgcgtgatgtggaagaggcgcaatcaagaatcgtgggcgtcgtccgcaagctggaagaagccggagaaattgtaatcgcgcgaggcggaggagacgatattattgtctaatatcattaaacagcaatcatcattttctcctgaacaaaaacggcgcaagctttccttgcaggaagtcaggaaaacacattcccagccagaccgggaggaacttgaaaatccggaggcgctcatggcctttgccaaggccgaagccgacagggtgtctgaagaagcgaaaagtcaattggatcacactcttcggcagattgaagaagagaaaaaccgctgggcggaagaaaaacaaagattgatggaagaagcgaaggcagaaggatataaagaaggcatagcattgggaaaagccgaggctcaagctgaatatgccaatctcatcagccgggccaatgccgttatgggaatggcgagacagtcagtcgaggaaaaactggaaagcgctgaggaagaaattattgagctttccgttgcgctcgctaaaaaagtatggcggcaaaaaagtgacgataaagaggctttccttctgctggtcaaacaggtagtagccgaagtaaaagattatgatgacatctccatctatgtggaccctgaatattatgagacggttcatcagcatatggacgaaattcagcagctgttatacaaagaatgcagattaagcttatatgccgatgaaaaagccgcgaagggaacgtgctcgatagaaactccgttcggacgtgttgatgcaggcatagacactcagctgatgcaattaaagcaaaagcttttaacggcgcttgaggcgggagcggagcaatgaagacacagtatttaatagactcaattgaaacagcggatccgtacaaacgctacggcaaggttaaacgggtcatcgggctgatgattgaatcaaaagggcccgaaagctcaatcggagatgtttgtctcatttatccgaaaggccatgcaaaaaaagcgattaaagctgaggttgtaggcttccaggatgaaaacattctgttaatgccttatctggaagcagccagtatcgcgccgggcagcattgtggaggccactggcgagtcgctccgcatcaaagtaggggcggggttaatcggacaagttgtcgacgcgttcggcgaacctcttgacggccgggcgcttccgaaaggtttgtcccccgtttcgacagaacagcagccgccaaacccgatgaaacgcccgccgatacgggaaaagatgggtgtcggcgtcagatcgattgacagtctgctgacggtaggaaaagggcagagaatcgggatttttgccggaagcggagtcgggaaaagcaccttgatgggaatgattgcgaagcagactgaagctgatttaaacattatcgcacttgtcggtgaacgggggcgcgaggtgcgtgagttcattgagaaggatttaggcgaagaaggcctgaaacgctcgatagtcgtagtcgcgacctctgatcagcctgcgttaatgcgattgaaagcggcgtatacggccaccgccattgcggagtatttccgcgataaaggccggaatgtgatgttcatgatggactccgtcacgagggtcgcgatggctcagcgggaaatcggcctggcagcgggagaaccgccgacaacaaaaggatatacaccttctgtgttcgctattttgccccgtttgctggaaagaacgggcgcgaatgaacaaggaacgataaccgctttttatacggttctcgttgacggagatgacatgaacgaaccgattgccgatacggtgcgcggaatattagacgggcatatcgttctcgaccgggcgcttgccaacaaggggcagttcccggccgtgaacatcctgaaaagcatcagcagggtcatgtctaatatttcagatacagcgcacatagaggcggccaacaaattccgcgatcttctgtcaacttatcaaaactctgaagatctcattaatatcggagcttacaaaagagggtcatcaagagaaattgatgaagcgattcagttttatccgcagcttattcaatttttaaaacaaggaacggaagaacctgctcaactggaagacagcattgcggcattgacgagtctgacaggaaatgaggaataaacatcatggcttaccaattcagatttcaaaagctgctggaattaaaagaaaatgaaaaagaccaaacattgactgaatacagacaatcggtttctgaatttgagacagtggctgaaaaactatatgaaaatatgagcaaaaaagaattgctcgaaaaagacaaagaatcaaagctgaaatgcgggatgagcgttcaggaaatgagacattatcagcaattcgtttccaatcttgagaacaccatctatcattatcaaaagcttgtcattatgaaacgaaatgaaatgaatgagaagcaggaacagctcaccgaaaaaaacattgaagtaaagaaatttgaaaaaatgcgggaaaaacaatttaatatgttcgcacttgaagataaagctgcagagatgagggaaatggacgacatttcaatcaagcagtttatgattcaggggcattaggagcgaatgaaatggccgataaagaaaagagatctggaaagttcggttcaatcctgctttttatcatgatcccgctgatttttctgatcatcgtcgcaagcatcatcctttgggctgccggcgttgatgtgatgaagccgattcaggaaacagccgctaaaacgcctgttttaaaagaattggttcccgaaacgaaagaaatgaaaagcgcggcggaaaagcagaaggaagacagaacggcttctcttgaaaagaccataaaggaacaaaaaagtgaaattaacattttgaataaagatttagacacaagcaagtccgaaatcgataatctgaatcagaaaatccgttcgctgaaacaggaagctgaacagcagcagaaaacgaagacggatgaaacaaaaaaagacgcttcggattcagccggaaaagataaaatgatcaacatctataaaagtatggacagcggtaaagcggcaagcattatcgtaaagctgaaagaaaaagaagccctcgatattttaaatggattaagtaaaaagcaacttgctgaaatcttgacgaaaatgactcctgaacaagcggctaaatatacagaaaaactatccgctgacggaaataaggagtgatgtaagttgaagctgcttgaattaacgggtaatcgtacgcagactgcgcaaaacagcaatgtgaagacgaatgtaaacagcttaggtctatttcagaactggctcctgtcggaaatcacttctccccggcagcccggagatgaaacaaaaacaagtgacgcagagctgaatgatgccctatcgaaaatcggtgattggctgaaagccggcccggaagataaagaattgcagcttaaacagctgcttgaggcggtaaaagctcttgaaggaaagcagacggctgaaacagctcttcctttattgaaacagcttgccgaatccgttgaagacatgttagcgggaaaacagcagggggcgaagcctgaaacgaatgagccggattcttccgcaaaagacggggattccgtcaaggatgcgcttgagaagggcttgcttttcattcaagaagccgtatcccagctcttcacatctcagcaggaactgcctgacagcacgcaggcaaaggcggtttaccgggaaggcgcccgtttattagaggcattgaaaaaacaaggcgttccggaccgcgtgattcaagacctgcggcagacattttttccgaaaaacgaatctgcatctaaactttacgccatgacagccgctgagctgaagagctttcaaagcgtcgcggagcagcttgcgggcctttctcaaaagggaacaaaggaatgggatatggctgaaactgagctgaaagcttttgtgttatctcaatcatctgaatcatcccaagagtcagccgggaaaacggaacagcaaaacggcggcacggtttctcaagcaaaggcgcctgacagcaaattgtctgcacatatactgttttcgggaacgagaagccttgccggcattcagcaagcgtccgcaggagctgaacagcagccggcagaaaataaaccgttaacggatcaggttatcagcggctggaaacagatgaaatacacgcctttcgggaaagcaaccggaagctttacgattcgtcttaatcccgagaacctcggatttgtcacaattaaggtgacaaacgaaaacgggatgtttcaaagcaaaataatcgcatccagccagtccgcgaaagagctgctggaacagcatcttcctcagctgaaacagtcgcttccgaatatgtcggtccaggtcgaccgttttacagtcccgcttcaaagcggggatcagcagcctgtttacgggcagacggcagatcacaataaacagcagcatcagggacagagagagcagaagaaccagcagcagtcaggcgatttcggagatatgctggaggagctttctctcaatgaaatggaggaagaatagttgacatcagtaaactcggattatgccgcggcgggcgcttcaaccacttcaaacgcgaagagcacctccgcagtaaacagcagtacgaatttagggaaagacgaatttctgaagatcttaatgacacaggttcaaaaccaggacccgctcaatccggttgatgacaaagaattcatcagccagatggcgacattttcttcattggagcaaatgatgaatatgaatacgacgatgactaaatttgtagaaaatcaagatccgtttacgatgtatgtgaactggatcggcaaaaatgtcacattcagcgacagcgacgggaaggatcagacaagcccagtcaattcagtcaagcattcaaacggcaattacgtgctcgtgcttgaaaatggcaaagaggtcagtccgtggaatgtcacggccgtcagcgaaacatctaaataaaaagaaacccagggggaatttaacatgttacgttcattgtattccggtatcagcggcatgaaaaactttcagacaaaactagatgtaatcggcaataacatcgccaacgtcaacacagtgggatttaagaaaagccgcgttacatttaaagatatgatcagccagacagtcgccggcggttcaaacgtgaccaattcaaaacaaatcggcttgggtgccgcgacttcttccattgatgtcgttcattcaaccggcgccccgcaggctacacagaataaaaccgacctagccattgacggagacggatactttcagattaatacaggttcgggaatcgtttacacacgtgcggggaatttcggaaaggacaatcaaggcaaccttgttacgactgacgggtactaccttgaaaaaatcggaggcggcaaaatcaatattccgactgatgcgaaagattacagcatcggtgcagacggaaccgttacatacactgatgcaggggatgcggttcatgatgccggacaaatcggtctggtcacgttccctaacagcgccggtctggaaaaaatcggaggcaatctttacagagaatcattaagttcaggagctgcgagcgcagtcaccactccgggcgaaaacggaacgggtaagcttttggcaggctatcttgaaatgtcaaacgtagatctgacagatgaatttaccgaaatgatcgttgctcagcgcggtttccaatcaaactcaaaaatcattacgacttcagatgaaatccttcaggagctggttaatctgaaacggtaaggagggaggagaggcggttaggccgcttctccggattgcatgattcaagtcacccgtttaaacggccagccttttacgctgaatgcgctgtttatcgaacagattgagtgcttccccgacacgacgattacactgtccaacggcaaaaagttcgtagtgaaagaaccggaagaagcagttctcaaaaaagtcatatcgttttaccatagcatacaaatattttcactggatcagggaatagaggaagaagaatgaagaaaaaattagtcatcattttgctgattattttaattgtcatcgccggcctcggaacggcagcatattttgtcgtcagcggacactccggcaaagataaaaagccgacaattgacgaagtcgttgcagccactgtgtctgtcgacgatatcacgacaaacttaaagtctgacagcatcatccgtatcggcatcaagcttgaaaccgactcggctaaagcgaaggaagaacttgaaaaacgcgattttcaggtgaaagacaacatcatttccattttagctgacacaagcgccggagagattgagggagataaaggaagagaagcgtttaaacaatcattaaaagagaaagtaaacagctatctccaagaaggaaaagttcagaaagtgtacattacctcctttaatctgcaataaaaacaaatttgacagaatacggaggtgaagaaaatgtcaggagaagttctctcccaaaatgaaatagacgcactgctttccgccatttccacgggtgaggcggatgcggaagagctgaaaaaggaagttaaagagaaaaaagtaaaggtatatgattttaaacgggctctcagattctcgaaagatcagatacgcagtttaacccggatacatgataactttgcgaggcttctcacaacacacttttccgccaagctcagaacgtatattcatatatccgtcagctcagttgaccaggtgccgtatgaagaatttatccgttccataccgaacatgacgattttaaatttattcgatgttcatccgatggaaggcagaatcatgatggaggttaatcccaccatcgcatacgcaatgctggaccgcgtcatgggaggcatcggcatcactcataacaaagctgacagccttacggaaattgaaacgaatattatttctaacttatttgaaaatgcactgggcaactacaaagaagcttggcaatcaattgctgatattgaccctgaaatgactgaatttgaagtgaatcctcagtttgtacagatggtttccccaaatgaaacagtcgttgtcatttctctcaatacacagataggtgaaatcagcggtgtcattaatctttgtattccccatgtcgtacttgagccgattatccctaagctttccgtacattattggatgcaatcagaccggaatgaagcgaagcccgaagaaacgaagctgcttgaaaagcgcatcatgacggctcaaattcccgttgtggctctcttgggcgcttctgaactgacaatagaagaatttttaagtttggaagtcggggactgtataactctggacaaatcagtgactgatcctcttactgtattggtcggaaacaaaccgaagtttttagggcaggccggccgggtgaatcgaagacaggcagtgcaaattttagatcacgacataagaggtgaacaagatgaacaatagattatctcaagatgaaatcgatgctcttcttaacggcacaagcagtcagtcagaggatacagaacagcctcaaggggcgaacttgtctgaacttgagcgcgatgcgatcggagaaatcgggaatatttcgttcggcagctcggctacggcgctgtccactcttttaaatcaaaaagtggacattacgacgccgagtgtgaccgtcatttcaaaaagcaaaatcagtgatgaatttcctcatccgtatgttgccattgaagtgaactacacagaaggctttgacggcagcaatttgctagtcgtcgaacaaagcgacgcggccatcatcgcggatttgatgatcggcggagacggccggggcgccgatccgtcactcggtgaaatccacctgagcgccgtgcaggaagcaatgaatcaaatgatgggctcggctgctacgtcaatgtcgaccgtattcagtaaaaagattgacatttctccgccaagggttgaacttctggatgtgacggaagaaaaagggaccgacagaatacctgaggatgacctgctcgtaaaagtgtcattccgtctgaaagtcggtgaattaatcgattcgagcatcatgcagctttatccgattacgtttgcgaaagatctgatcgcagaactgatgactgcagaccagcaagagtcagaggccgcagaaaccgtctcagaaccacaggaaacatacgaaacgccgcagccggaaccgcaggcaaaacctgagcttccgaagagacagggaaccgcaaaaaaagctgcgcctgttcaagtcgctccggtagaattccaggcgtttgatcataacgaagcggcgcaaggatcaaggaataaccttgatatgctgatggatattccgctttccgttacggttgagctcggcagaacgaagagaagcgtcaaagaaatccttgaactttctgcgggaagcattattgagcttgacaagctggctggtgaacctgttgacatcctggtcaaccagcggatcgtggcaaagggcgaggtcgttgtcatagaagaaaacttcggcgtgagagtcactgatattctaagtcaggcagaccgccttaacaatttaaaataagcgaacatagaggagagaaacagattatggcacacagaattttaattgtagacgatgcagcatttatgagaatgatgatcaaggatattttagtgaagaacggttttgacgttgtagctgaagcttcagacggagcgcaggcagtcgaaaaattcaaagagcattcccccgacctagtgacaatggatattactatgcctgaaatggacgggattacagctctaaaggaaattaaacagatcgatccgcaggcgaaaatcatcatgtgttcggctatgggccagcagtcaatggttattgacgcgattcaagccggcgcaaaagactttatcgtgaaaccgttccaagcggaccgcgtgcttgaagccattaataaaacattaagctaaagggtgtacgactgttgaaaaagagtcatggtttactagctttgatttgttgtttcgttttactcaatgtacatccgttccctgcttttgcggcggagtctgacaattccaccgtcaacgaatggtttgacaaacaatcaacaaacaaaacagagaaaaaaagcgatacatcgaaacaaacggctgatcaagagataggggatgcttctgcatcttctgtctccgcttttgattttgtaaagatgatcggggcgttattatttgtcattctgctgatctatggatttgtcaaactgatgaatagaagaaaccgtctgctgaagccgtttcaatatgtagaaaatatcggcggaacgtcagtcggccaaaaccgttccgtgcagctgattaaagtgggaaacagcgttctcgtagtcggtgtgggcgaaacgatacagcttttaaaagaaattgaagatgaaaaagagcgcgaggcgattctgagccaatacgaagagtcgatgtcttcaaaagtggaatggaccaagctcgtaaatccgcgtaaggatggagaaaaaaagccgcaaacgatgcttccgtcgttttcaaaagcgctgaaagaacagctgaacgagctgaaacaaagccgttctgaaggaaagaagaaaggcccttatcatcatgaatgaattcgttaatctttttaattcaagcagtccgaccgaagtcagctccactgttaaattactgctgcttttgactgtcttttcagtagcgccggggattctgattttgatgacctgctttacgagaatcgtcatcgttctgtcttttgtgagaacctcactggcgacgcagaacatgcctccgaaccaggttttaatcggccttgcgctgttcttgacgttttttattatggcgccgactttttcagagattaataaggaagccttaacgccgctgatggacaacaaaatcagtctcgatgaagcatatacaaaagccgagaagccgattaaagagtatatgagcaagcatacaagacagaaggatctggcgctgtttatgaactatgccaaaatgaaaaaacctgaatcgattcaggatattcctttgacgacgatggtccccgcttatgcgatatcagaactcaaaaccgcttttcaaatgggctttatgatttttattccgtttttaattatcgatatggtcgtggcgagcgtcttaatgtcaatgggaatgatgatgcttccgccggttatgatctctctgccctttaaaatattgcttttcgttttggtcgatggatggtatttaatcgtgaaatctttgcttgacagcttttagggtaggtgctaattgtgagttcagaatttgtaatttccatggcggaaaaagccgtatatgtaacactaatgatcagcgggccgctgcttgcgatcgcgctgatcgtcggtttgctcgtcagtatctttcaagcgacaactcaaatccaggaacagacgctagcgttcattccgaaaatcgtggcggtgatgcttggactgatctttttcggtccttggatgctgtcgacgattctttcgttcacaactgatctgttctctcatctgaaccgatttgcagggtagaatcaaatgaattccatcattgatttatttcccgcttttttattggtctttatcagaatctctgctttttttgtaacggtgccggtgttcggacatcggaatctgccggcggttcaccggatcggctttgctttttttctttcggtgatctgcttcagcacgctgaaacatgcgccggaaatagaaataggggaacagtatatgctgcttgtcataaaagaggccgttgtgggcttgagcctcgggctgattgctttcatgatgatgacagccattcagatagcgggttcctttattgattttcagatgggcttttccatcgccaatgtcattgatccgcaatcaggaacgcaaagcccgctgatcggacaattcgtttatacgctggcgctgttatttatgctcagcgtaaacgcccattatcttttattggacgggatttattacagctttcagtatatcccgcttgatcaggcatttccgtcgtttggaaatgatcactttgggctttttatcgcaaaaagcttcaatgccatgttcattattgcttttcaaatgtctgcgccggttgtggccagtctgtttttagttgatttggcgctcggtattgtggcgagaacggtgccgcagctgaatgttttcgttgtcgggcttcctctgaaaatagccgtgagctttattatgctgatcgtttgtatggcggtgatgtttgtcgtcgtccgcaacatcttcagccttaccgttgaaaccatgcggaatctattggcattggtcggtgtgacatgatgagactcagactgaatctgcaattctttgccggtgaaaaaacggagaaagccactccgaaaaaacggaaggatacaagaaagaaaggacaggtcgcgaaaagtacggatgtgaatacagccgtttctttactgattatctttctttcgctgatcgcgctcggtccttatatgcgggacaggctgctgtcctttattaaaacgttttatacgaaatcgatatcattacatctgtcagcatctgccgtgcatgaactgttcgtggatacggtgaaagatatcagcctcaccctcgcgccgattatgctggtcgcgcttgtggcaggtgtcgtgagcaattacatgcaggtgggttttctgttttctgcggaagtcctcaagcctgacttgaataagctcagcccgctgaaaggatttaagcggatttacagcatgagggcgattgttgaactggtcaaatccattttgaagattactgtggtcggttttgccgcctttatggtgctctggctgcattatggcgatattctccgccttccgcttttaacgcctgcggaagtgctcactttcgtttctaagctcacgctttggatggggcttgcgggatcaggggctctaatgctgctggccgggcttgattacttatatcagcgttttgactatgagaaaaatatcagaatgtcaaagcaggatataaaagatgaatacaaaaaatcggagggtgatccgattatcaagtctaaaattaagcagaagcagcgggaaatggcgatgaggcggatgatgcaggaagtgccgaaagcggatgtcatcattaccaacccgacccattatgcgattgctttaaaatatgatgaaaagaaaatggacgccccttacattgttgccaaaggggtcgaccatctcgcattaaaaatcaggcagatcgccaaagaacacgatgtcatgacgattgaaaacaggccgctcgcgcgtgcgttatatgatcaggttgacattgatcaggctgtgccggaagagttttttaaagtcattgcggaaattttggcttatgtatataaaacgaaacaaaaagtatagtgaatttcagattcaaaaggagagaaaaacagcatgtcaacaagagatttatcggttttaataagtgttgtcctcattgtggcaatgctggtgattccattccctccatggttgttaagtattttgatcatcattaatatctctcttgcgttgatcgtgcttctcaccacaatgaatatgcaagaaccgctgcaattctcgatattcccgtcattgctgctgttattgacgctgtttcggctttcgctcaatgtgtcgacgacacgttcgattctttctcacggagaagggggaaaggttgttgagacattcgggaatttcgttgtcggcggaaatgtgctggtagggcttgttgtcttcattatcttgattattattcagtttatcgtcattacaaaaggcgccgagcgggtatcggaagtggcggcgagatttacgctcgatgcgatgcccggaaagcaaatgagtattgacgcggatttaaatgccggcatgattacggagcaggatgcaaagcacagacgtgaaaaagtcgcccgggaagcggatttttacggcgccatggacggtgcgagcaaattcgtcaaaggggatgccatcgcggggatcatcatcgtgatgatcaatattattttcggaatcgtaatcggtatgctgcagcaggggatgagcatacaagaagctgcgtctcactttacaatgctgacggtcggtgacggtatcgtttctcaaatgccggccttgctcatttcaacggctacggggattgtcgtgacgagagcggcatctgaaggaaacctcggtcacgatattacaggccagctgtttgcttatccgaagctcttgtatgtagccgcgggaactgtacttttgctcggtcttcttacaccgatcggcattctgctgacggggccgatcgccggtctgcttgcattcggcgcttatatgctgtccaaagcggataagccgagcgaagaagaggaagaaattcttgaagaagaggctcaggcggatgaactgaaaagcccggaaagcgttgtgcagcttttacatattgatccgattgaatttgagttcggatacggactcgtgccgcttgcagacgcggggcagggcggtgatcttcttgaccgcatcgtcatgatcagacgtcagcttgcgcttgaattgggacttgtcattccggttgtgcgcatcagggataatatcgcgctccagccgaatgaatacagattgaaaattaaaggcaatgaagtcgctaaaggagagctcctgctggatcattacttagcgatgtcaccgacgcctgaagatgacgtcattgaaggcattgaaacgattgaaccgtcgttcggacttcccgcaaaatggatcagcgaagctgcaaaagatgaagcggacatgctggggtatacagttgttgatccggcgtcagtcgtatctacgcatattacagaaaaaattaagcagcatgctcatgaactggtcggcagacaggaaacaaagcagctgatcgatcatctgaaggaaaattatcctgtgcttgttgaggaagtcacgccgaaccctctttctgtcggcgatattcaaaaggtgcttgccaaattgctgagagaaaaagtttcaatcagaaacttggtgaccatttttgaaactcttgccgattacggaagattaacgacagattcagaccttttgacagaatacgcgagacagtcgcttgccaaacaaatcacggcacaatatgcgagagagcatgaaacgctgaaggtcatcacatgctcaggccgggtggaaaaagcgattgcagacggggtacagcagactgaacagggcaattacctgtcactcgatcctgaggtttcagacagcatcatccgttctgtcgctaaagaggccgagcagctttccatccgacaggagtcggcgattcttctttgctcgcctgctgtcagaatgtatgtaaaacagctgttagaacggtatttccctgatcttccggttctttcttataatgagctggaagcaaatgttgaagtacagagcattggagtggtggatatttaatgaaaataaaaaaatttacagccgcttcaatgcaggatgccgcgaagcaaatcaaaaaggaactcggcaatgatgccgttattttacattccaaacaagtaaagaaacgaaaatggctggggctgcggtcgcagcaggccgtcgaagtgatagcggttttagatcgtgacgtcagggaagcgagaaaaacgccgccggctgccgctggagaaatgaaaaagacggaaatggcggagaaagctgagcctgttcagccgccgcgtcttccggatcaaagtatttccggcgaacttgcgcatttgaaagaagtgctccctgaaccattaaaaaaagccgagagactattgaagcaagccgggcttcctgatcatacgcaaaacgccgtactcagtgaattgctcagttcttcaattgtttccggagatttaactgaagataatgtcagctcaaaactgcaggatttgttggtgaaaaaactcccttcggcagacaggtggcaggaagggattcaatcaaaatacgtcgtgcttttcggttcaaccggggccggcaaaacgactacacttgcgaaactcgcggcctcatcaatgctgacagagcataaaaaaattgcctttatgacgacggatacttaccggattgccgcggtcgagcagctgaagacatatgcggagctgcttcaggctcctcttgaagtatgttattcaaaggaagaatgtctgaaggcactggaaaaattcgctgaatatgaccatgttttcattgatacagccggcagaaactttaaagaagagcagtatattacggaattacaagagatgattccgtttgaatcaggcttacaatcttttctcgtattatcggcatctgcaaaatatgaagatatgaaacaggtgctgaaacagttttccggtgtgccggtcaatcaattcattttcacgaaaacggatgaaaccgcctcactcggctccgtgtttcaagtgctgtcggaatcaagaatcggcgccgcctatttgacaaatggacaggatgtgcctgaagacatcctatcggcttcaccaaaagagtttgtaaggatgcttttggcatgaaacccgatcaggcagagtcattaagaaggaaaatgagagagcggcaaatgatcaagccggagctttatgagaaaaaagcgaagacattagccgtcatcagcggtaaaggcggcgtcggaaaatctaatttaacattaaacatggcagttgccctgcaggaaaaaggaaaaaaagcactcatcattgatcttgacatcggaatgggcaacattgatgtgctgatcggcgctgcttcttcccgcaccattattgatgtgatggagaatcggcatgcattggctcaatcactttcctccggtccgaaaggccttcgctacatatccggaggaacggggcttgaggcgatctatcaagcagacagagagaagtggtcggcttttatgaatggtctttccgctgtattaagcgattttgattacgttctgtttgatatgggagcgggactttcaaaagaacagctgccgtttattttatcggcggaagacattctcgccgtgacaacgcctgagccgacggccattatggatgcctacagcgcgatcaaacatcttttgctcgcggatgaacggctgaccgtaaacattgctgtcaatcgcgcccgcgcccaaaaacaggcgctggacacgtacaaccgcctttctcatgcgattcacacgtttttaggcgcggaggtgcgtttcgccggctccatacccgatgatccgctagtaagtcaagccgtcattgaccaggtgccttttttaataaaaagtcctcaagcaaaagccagcaggtccgtccgtcttctgacggatgtcttgtttcaaacggaagaaaacaaaccaagagaagagaaaccggcatttattgagagattatcttcttttttattgaggaggactttacagtgattcgtgtgcttgtcgttgatgactcagcttttatgagaaagatgattaccgattttctggctgcggaagtgcagatagaagtcatcgggacagccagaaacggggaagaggcgctgaagaaaatagagcttctcaaaccggatgttgtcacgcttgatattgaaatgccggtcatgaacggaacggatacattgcggaagatcatcagcatatataaacttcccgtcatcatggtatcgagccagacacagcaagggaaggaccgaacgatcaactgcctggaaatgggcgcttttgattttatcaccaagccttccggatcgatttcacttgatctttataaaattaaagagcagctgattgagagagtgattgcagccgggctgtcccgcgcccaaaaacctgaggcggcagtgaaagagccttctatcccggaacgtccggctttggcgggatttgaaagaccgaaagcaaaatccgccaagcaggccgtattcatcgcgacctctacaggcggaccgcgtgccctgcaaaaggtgattccgaaactgccgaaggatttaaaggcgcctgtatttgtcgttcagcacatgcctgaaggcttcaccgcttcacttgcagacagactcaaccatttgtcagatattcaggtcaaagaagcggaaaacggtgaagaagcgaaagacggatgggtgtacatcgcgcccggcggaaaaaatatgacggttgcagaggaaggcggaaggctccgcatcattcttgacgttcatgatacggaaagccggcataaaccgtcagccgattatttgtttcggtcggcaagccgcttatccgattacgaaaaggtagccgtcattatgacaggcatgggcagcgacggaaccgaaggcgtaaaagaaatgctcagaacaggcggcgttaaaacgattgcggaatcggatgaatcctgtgttgtgttcggaatgccgaagtcagcgataaaggcgggcctcattcatgagattaaacatgtggaagatatcgcggcatccatcaccggatgtgtgaaaaaagagagggtgtgaatcaattggatatgaatcaatatttagatgtctttattgatgaaagtaaagagcacttacagacatgtaacgaaaagctgctgctgttggaaaaagatccggcagaccttcagcttgtgcatgacatcttcagagctgcccatacgctgaaaggcatgagcgcaacgatgggatatacagatctggcgcatttaacccacctgatggaaaatgtgctggacgccatccgcaacggagaaatgcccgttacatcggattggctggacgtgctgtttgaagcgcttgatcatcttgaagagatggtgcagtccattattgacggaggagacggcaaacgtgatatttctgaagtaagtgcgaagctcgacgtaaatgcggtgcatgagactgcggcttcagccgaaacagcagaaccgccggcttcaaaacaacagacttcaactgaatggaattatgatgagttcgaacggactgttattgaagaggcggaagagcaaggattcagccgctatgaaataacggtttccctgaatgaaagctgcatgctcaaagccgtgcgcgtgtacatgatatttgaaaagctgaatgaagccggggaagtcgcaaaaacgatacccgccgcggaagtacttgagacggaagatttcggaacggattttcaggtgtgtttcttgacaaagcagcctgctgaagaaattaaagaactcatcagcggcatttcagaagtggagaaagtcgaaatttctgccggtgcgccgttaaaaacggccgaaaaaccgcaagcggttgaaccggtgaaggaaactccggttaaaaaggctgaaaaacagccgaagccgcaagcgaaaacggaagaacagccgaagcatcacagcggctcgaaaacgattcgtgtcaacattgaaaggctggattcttcaatgaatctttttgaagaacttgtcattgaccgcggacgtcttgagcagatcgccaaagagcttgaccacaatgagctgactgaaaccgttgaacgcctgaccagaatttcgggcgaccttcagtctattattcttaatatgcggatggtgccggtagaaaccgtctttaaccgtttcccgagaatgatccgccagcttcaaaaggaattaaacaagaaaatcgaattgtccatcatcggagctgaaacggagctggaccgcacggtgattgatgaaatcggcgatccgcttgtgcatttaatcagaaacagcatcgatcacggcattgaatcgcctgaagtgcgggtgaataaaggaaaaccggaatcgggtcatgtcgtgcttaaggcatatcacagcggcaatcatgtctttattgaggttgaagatgacggggccggcctgaacagaaagaaaattcttgaaaaagcgctcgagcggagtgtaatcaccgaacgtgatgctgaaacgcttgaagataatgagatttacgagcttatttttgctcctggcttctcgactgccgatcaaatttctgacatttcaggtcggggcgtcggtctggatgtcgtaaaaaataaactcgaatcactcggcggctctgtcagtgtcaaatccgcggaaggtcaaggttctcttttcagtatccagcttccgctgacactttcaattatatccgttcttctcattaaactggaagaagagacgtttgcgataccgatttcttctattatagagacggctgttattgataagaaagatatcctgcagacgcatgacagagaagtgattgatttcagaggccaaatcgttccgatcgtctatctgaaaaaagaattcggcattacggattcaaaacaggatgccgatcagttccatgtaatcgtcgtgaaaaagggcgataaatccactgcttttgtcgtggactcttttatcggacagcaggaagtcgtactgaaatcactcggcgactatttgacgaacgtctttgcgatttccggcgctacgattctcggaaacggagaagtggcgctgattattgattgcaatgcgctgatctactaaaacgacacgaggaggtgcccgcatgactgctgaaatcaaaacaggtgaaaaaatgattgtgtttatgataaacgggaaagaatacgctatctcagtttcccaggtgaaatcaattgaaaagtggcaaaaaccgacgagggtcccgggggtggaatcttatatccgcggcgttatcaatctacgcggagtgattaccccggttcttgatttaagaaaacgtctgaaccagcctgaacaggacatcacagaagagacacggattatcatcatttcttaccgtgacgccgatgtcggatgggtcgtggatgaggccaatgacgtcatcaccgtgcatgaaaatgaaattgaatccgcgcctgaaagccagacaaaggaaacggatgtgtggattaaacagatcgtcaagcaagataacaggctcctcaatattatcgatgcgcatgcggtgctggataaaggtgcttcggcatctgcgtccggagagccgaatgcttaaaggggaaaagacaacatgagtaagtttgaagcgatcaaagaagagcagatggatattttgcgggaagtcggaaatatcggggcgggtcactcggcttctgccatggctcagctgctgaacagaaagatagacatggaagtgccgtttgcgactttattgacatttgatgagctcgctgattttttcggcggggctgaaacgccggtcgccagtatctttttaagaatggaaggcgacatgaccggttctatctttctcatcatgccttttgatcaagcggaacagtttatcagagagctgatcggaaatccggattttgatattgaccagttgggtgaagatcatttgagttcttctgctttacatgagttcggcaatattttagcaggctcctatttaacggcattggctgatttgacaaagcttgagatttacccgagcgtgccggaaatctcacttgatatgttcggcgcggttatcagtgaaggactgatggagctcagccaagtcggagagcatgccattgtcgtggatacttctatttttgaccagggcagccggcaggagctcaaagcccacatgtttatgctgccggactatgattcttttgaaaagctcttcgtctcattgggtgcggctttatgagccgtgcggaagccgcagtcgttaaagtggggattgcggatgttcaagtcgcgcgttacccagataaaatccgaacctcgggactcggttcatgcgtggggctggttttatacgataaagacaaacaaacggcaggactcgttcacgtcatgctgccggactccggtttatcaaaaacggcggagctcaaccgtgcaaaatacgcggacaccgccgttaagatgacgattgatatgcttttgaaagccggctgccgcaagtttgccctgaaggcaaaactcgccgggggagcggagatgtttaagtttaaaatgacaaacgacctgatgaaaatcggtccgaggaatgtagcggccatcaaagagcagctttcattgtataacattccggtcatcagtgaagatacgggcggctcaagcggccggacgattgaatttgagccaaagtcctgcatgctgcacattcgaactgttaaacaaggtgaaacaacgatttaataaaggtatgaggtagggggataacaatgcaatccttgaattatgaagatcaggtgctttggtcgcgctggaaagagtggaaagatcctaaagccggtgatgatttaatgcgccgttacatgccgctggtcacatatcatgtcggcagaatttccgtcggactgccgaaatcggtgcataaagacgatctaatgagccttggtatgcttggtttatatgatgccctggaaaaatttgaccccggccgggatttaaaatttgatacctatgcctcgtttagaattcgcggtgcaatcatcgacgggctgcgtaaagaagattggctgcccagaacttcacgggagaagacaaaaaaagtcgaagcggcgatcgaaaaacttgaacagcgctaccttcggaatgtgacgccttcagagatcgcagaagagctggggatgacggagcaggacgtagtatcaacgatgaatgaaggattttttgccaatctcttatcaattgatgaaaagcttcacgaccaggatgacggtgagaatattcaagtgatgatcagagatgacaaaaatgtgccgccggaagaaaaaatcatgaaagacgagctgatcgctcagctggcgggcaaaattcacgagctctctgaaaaagagcagcttgtcgtcagtttattctataaagaagaactgactttgaccgaaatcggacaagtcctgaacctttagacgtcgcggatttcacagattcattcaaaagcgctgtttaaattaaagcacctgcttgaaaaagtaattcaataatgaactcatggttagcgagtgaaaaacatgtcaacactattatggcttttaagctttgtgcttcacggcgtactgctttatgccgtcattattctgtacacgaggttttcagccctcaaggagacggagcgccagcagaagaagattcttgaagagacggaaaacactcttgcagcgtttctgcttgagctgaaagaagaaaatgaaagactcgaagacgcaaaaaaccggaatgatcaagcacctgacgcagaagacgccgaaccccggccggaaccgaaaaaagagcctgatattccggaccatatggaaaagctcatcagtgcaacggaacgggctgaaagtgatgaaaacagcggcgcgcattcgtttgaagaacgtgtttcagaattatatgaacaagggctcacccccgcggaaatcgccaaacgggtgcagagcggaaagacagaaatcgagctgtttttaaaatttcgcggcaaagctgtaaaggattcttgattgtcgcataaagctgtgttatattatgtcttggtgttaaatacacacgcttaacgatttatgcagagggtgctgcaaacggcagttctgcacaaaaatgacctaagcggaggaaaaaaaccattttattaggaggaaatcacatgtcagttatttctatgaaacaattgcttgaagctggtgttcacttcggccaccaaacacgccgctggaacccaaaaatgaagcgttacattttcacggagcgtaacggaatctacatcattgaccttcaaaaaacagtgaaaaaagtagaggaagcttacaacttcacgaaaaaccttgctgctgaaggcggaaaaatccttttcgtcggcacaaaaaaacaagctcaggattctgttaaagaagaagctgtacgctctggcatgtactatgtcaaccaacgctggttgggcggtacactgacaaacttcgaaacaatccaaaaacgcattaagcgtctgaaagacatcgagaaaatgcaagaaaacggtacatttgaagtacttccgaaaaaagaagttgttcaattgaaaaaagaattagagcgtcttgaaaaattcctcggcggaattaaagacatgaaggatcttcctgatgcattattcatcatcgatcctcgcaaagagcgcatcgctgttgcggaagctcgcaaattgaacattcctatcatcggaatcgtagatacaaactgtgatcctgatgaaattgatgtcgtaatccctgcaaacgatgacgcaatccgcgctgtcaaacttcttacttctaaaatggcagatgctattcttgaagcgaagcaaggcgaagaagaagcggaagctgctgaagagactgcacctgaaacagaaacgacaactgcgtaacctaatcaaaaggtgataagagggactgccttttatcaccttttttcaagaaaaatgtatctatacatatcttgtttacacatataaggaggaattcaaatggctattactgcacagcaggtaaaagaactgcgtcaaaaaacaggcgctggtatgatggactgtaaaaaagcattgactgaaactgacggagatatggacaaagcaatcgaccttctgagagaaaaaggaattgcgaaagcggctaaaaaagctgaccgtatcgctgctgaaggttctactcttattaaaactgacggcaacaaaggcgttatcttagaagtaaactctgaaactgatttcgttgcgaaaaacgaaggcttcaaagagcttctgaacacgcttgctgaccaccttcttgcaaacgctcctgctgatcttgaagaagcgatgggtcaaaagatggaaaacggttctactgttgaagaatacatcacaagcaacgttgctaaaatcggagagaaaatcactcttcgccgttttgctgttcttacaaaagaagacagcgaagcgttcggtgcttaccttcacatgggaggccgcatcggcgtattatccgttcttagcggaacaactgacgaagatcttgcaaaagacatcgcgatgcatgttgcagcggtaaatcctcgttatatttcccgcgaccaagtgtctgaagaagaagcaaaccatgagcgtcagatcctgactcagcaagctcttcaagaaggcaaaccggaaaacatcgtagctaaaatggttgaaggccgtctgaacaaattcttcgaagaaatttgcttattagaccaagctttcgttaaaaacccagacgaaaaagtgaaacaagttgtggctgcgaaaaacgcatctgttaaaacttacgtccgctacgaagttggagaaggcattgaaaaacgccaagaaaactttgctgaagaagttatgaaccaagtgaaaaaataatggcggaaagccttggcgaatctttcgcggcttttcaggcagtataggggacactacttgtgttccctatttttaaaactatatttacaaacctttttttctcttgcataataggaaacggcaatgtttacacttggaggttattatggaaaaaccaaaatacaatcgtatcgttttaaagcttagcggagaagcattggcaggagagcagggaaacggcattaatccgactgttatccaatccatcgctaaacaggtaaaagaaatcgctgagcttgacgtcgaagtggccgtagttgtaggcggcggcaacttatggcgcggaaaaacaggcagtgacttaggaatggaccgtgcgacggccgattatatgggcatgcttgctactgtcatgaactcacttgccctgcaggacagcctggaaacgctcggaattcagtccagagtgcagacatcaattgaaatgcgtcaggtcgctgagccttacatcagaagaaaagccatccgccacctggagaaaaaacgcgttgtgatttttgccgcgggaacaggaaacccttatttctctacggacacaaccgcagcgctgcgtgccgctgaaatcgaagcggatgtgattttaatggcgaaaaataatgtcgacggtgtgtataatgccgatccgagaaaagatgagtcagctgttaaatacgaaaaattatcttatctcgatgtgttaaaagacgggctggaagtcatggattctacggcttcttcactatgtatggataatgatattccgctgatcgtcttttctattatggaagaaggaaatattaagcgtgccgtaatcggcgaatcaatcggaacgatcgtaagggggaaataacgttgtcaaacgaagtattaacacaaacaaaagaacgcatggaaaaagcggttgctgcttattcacgtgaattggcgtcagtccgcgcgggacgtgccaacccatctctattggataaagtgacagtagaatactacggtgcccaaacacctttaaaccagctgtcttccatcaatgtgcctgaagcgcgtatgcttgttgtcacaccgtatgacaaaacggcaatcggcgatattgaaaaagcgatcctgaaagctgatcttggcgtaactccgacaagtgacggaacaattatccgcatcgcgatcccggctctgacggaagaaagacgtaaagaacttgtcaaagtcgtgaaaaaatacgcggaagaagcgaaagtagcagtccgtaatgtccgccgtgacagcaacgatgacctcaaaaaacttgagaaaaacggggacattacagaagacgagcttcgtgcttccagtgaagacgttcaaaagctgacagatgaatatgtgtcaaaaattgacagtgtcacgaaggacaaagaaaaagaaatcatggaagtttaatgaaaaactatgtacaatagataatgtgaaaagaccctctcatgtttacagggggtttttttgttaatactgttgattacattgatcatcagcaacgcaacctttttgggtgacggaggaatctcatgctcaacatactcaaaaattggaagaatcagcagaatgcggcttccaacttagaacggtatacaaaagaagacatactgaagggtgaaattcccgcacacattgccattattatggacggaaacggacgctgggcgaagaagcgctcactcccgcggattgccggacatcatgaaggaatgaaagtggtaaaaagggtgacaaagctcgcaaatcagctcggcgttaaagttctgactctttatgcgttttcaactgagaattggaagcgcccgaagatggaagtcgactttttgatgaagcttccggaagagttcctgaatacgtatcttcctgaattgatagaggaaaatgtacaggtgaaaattatcggagatgaatccgcgctcccttctcatacgtacagggcgattgagaaggccgtaaaagatacagaacaaaatgacgggctgattctcaatttcgctttgaactacggcggacgcacggaaatcgtcaatgcggcaaaagcattggccgaacaggtgaaaagcggcacgctgaatatcgaagacattgatgaagcgctcttttccgggcatttaatgacagaatcaatccaggacccggagctgctcatcagaacgagcggagaaatcagactgagcaactttatgctttggcaggtggcttacagtgaatttgtttttacagatgtcctgtggcccgattttaaagaagatcactttctgcaggcagtgggagaatttcagcagcggggccggaggtttggcggaatttagaggatggtggaaatgaaacaaagattgttaacaggtgttctggcagcggcactatttttatttttggttattttcggaggattgccgttcaccgtatttgtttacgtgatgggaagtatagcgctttttgagcttttgcggatgaaaaagctcagatttttttcttttccgggtctgatcagcctcttattgttatgggtgtatatgatgccggacaaatatcattttttcgatgcgaaaatggaagtaacgattttcgccgtattgattctgctcagctatacggtgctcgtgaaaaacacctttacgtttgacgaagtcgggtttatcgttctcgcgacggtatatatcggactgtgttttcattattttattgaaatcagaaacattgaaacaaacgggcttttgtatatcttttatgcctgcgttgtcatatggtcaacggactcaggcgcatatttcgtcggaaagtcgctcgggaagcggaagctgtggcccgaaatcagtcccaacaaaacggtggaagggtttctcggcggtattgtcatcgcccttatttttacggctgtttttcagctgtttgcgcaccttccgatttcatacctggttcttttggtcatcacgcttgttctgtctgtgttcggacagatcggggatttggttgaatcagcgcttaagcggcactatgatgtgaaggattcggggaaaatccttcccgggcacggcggcattttagaccgatttgacagctttttgtttgtcatgccgttcttatactttctgcttgcgcttttttcatgagaaaggctaatatgaaaataagaccgatctggacgcatagaatgggagtggcattttgaagaatatttgtcttttaggagcaacaggatcaataggggagcagacgttagacgtattgcgcatgcatcaagatcagttccgtctcgtctcgatgactttcggtaaaaacgccgagaaagcgatcccgttgatcagaacgtttcagccgaaatatgtagcagtcggcgacatggatacatatcaaaaagtgaaagaagcgtctttttctcatgaatgccaaatcggcatcggagaagaaggcctgattgaagcggcagtcatggacgaagtggatatcgtggtcaatgcgctgcttggaagcgtcggtttaatcccgactttgaaagcgattgaacagaaaaaaacaattgcgcttgcaaataaggaaactctcgtcactgccgggcatatagtgaaaggacacgcaaaacgatacggtgttcctcttcttccggtcgacagcgaacattccgctatttttcaggcgctgcaaggcgaacagagcaaaaatatcgagcgcctgatcattacggcatccggcggcagtttcagagataaaacgcggcaggagcttgagtctgtaacgattgccgacgcccttaatcacccgaactggtcgatgggtgcaaagattacgattgactcggctacaatgatgaataaagggcttgaagtcattgaagcgcattggctgtttgacattccgtatgaacagattgacgttgtattacataaagagagcatcattcattcgatggttgaatttcacgacagaagcgtcatcgcccagcttggaaatccggacatgagggtgccgattcaatacgcgctgacatatccggaccggctgcctctgcctgaagcaaaaaggcttgaattatgggagatcggaagccttcattttgcgaaagctgactttgaaaggttccgctgcttacaatttgcctttgaatcaggtaaaatagggggaacgatgccgacggttttaaatgcggccaacgaagaagccgttgccgcttttcttgccggacggatttcattcttatcgattgaggacctgattgaaaaagcattggaccgccacagcgtaattcaggatccgagtcttgcggatatccaagaagtggacaaagacacccggggatacgttaattcaatactcacataaggtggtatgttcgtgaatacagttatcgcgtttattattattttcggaacgctcgtttttttccatgagctcgggcatttattgctcgcccaaagagcgggaatcctttgccgtgaatttgcgatcggcttcggccctaaaatcttttcatttaaaaagaatgaaaccgtgtatacgatcagactccttccggtcggagggttcgtccgcatggccggtgaagacccggagatgatcgaagtcaaacccggttataccgtcgggcttctttttaataaagaggacgaagtggaaaaagtcatcattaatcaaaaggaaaaatatcccgacgctttaattatcgaggtggagacggctgatcttgagcacgaaatgaagattaccgggtacgagcaggggaaagaagatgaactggcgggctttactgtcagtcagacctctttttttatcgtagacggagaagaagtgcagattgcgccttacaatcgacaattcgggtctaaacccgtatggaagcggattaaggcgattgctgccggtccgataatgaacttcatcttagcgtatgtcattctcgtcatgctcggatttattcaaggcgtgccttcgaatcagcctgagctcgggaagctgacagacaatggacgcgcagctgctgccggtttaaaagaaggcgactatatccagagcattaacggtgaaaaaatgaggtcatggaccgacatcgtgacagctgtaaaagaaaatcccgggaaaaaaatcgatgtcgccgtcaaacgggacggcaaatcgtttcatatctcggttacacctgaagctgtaaaagatgaaaataaaaaaacaatcggccgcttcggctcttatgcgccgactgaaaaaggcgcgcttgcagcgattgcttacggcgcgacatctaccgttgatgttacaaaagcgatcctgaccaatctgagcaaacttgtgacaggccagtttaagcttgatatgctttcgggccctgtcggcatttatgatatgacggatcaagttgcaaaaaccggtattatcaacctattccagtttgcggcgtttttaagcatcaacctgggaatcgtcaacctgctgccgataccggcgcttgacggcggacggctgctgtttttattcattgaagcaatccgcggcaagccgataaaccgtgacaaggaagcatttgtcgtatttatcggcgtagctttcttaatgcttcttatgctggttgtcacatggaacgatatccagcgtttattcttataattgactagtaaaaaatcagaggtgcgaagacatgagacaaagtttgacgcttattccgaccctgagagaagtgccggctgatgctgaagcaaaaagccataagcttctgctgagagcgggatttatcagacaaaatacgagcggggtttacagctacatgcccctggcttacagggtcattcaaaacattcagaagatcgtgcgtgaagaaatggaaaaaatcaacgcggtggaaatgctgatgccggcccttcagcaggctgaaacatggcaggaatcaggcagatggtatacgtacgggcctgaattaatgcgtctgaaagaccgccacggccgtgaatttgctttaggcgcgacacatgaagaagtcattacttctctcgtgcgcgatgaggtgaaatcttataagcgtctgccgctcactctttaccagatccagtctaaattcagagatgaaaaacgcccgcgtttcgggttattgcgcggacgcgaattcatcatgaaagatgcgtattctttccatgcttctgaagaaagtctggaggaaacgtaccaaaacatgtacggcgcatacagcagcattttcgcacgctgtgaattaaacgtccgtcccgttattgccgactcgggcgcgatgggcggaaaagacacgcatgaatttatggctctttctgaaataggggaagataccatcgcttattccgatggatcctcttacgcagccaatacggaaatggcggaagttgtcatgaacagcgagccgtcagatgaaacacccgaggcattggagaaaattgatacgccgaatgtcaaaagcattgaagagctcgcttcgttcttgcatattgagccgagcgcctgcatcaaatcaatgctgtttaaagcggatgaccgatttgttctcgtgttagtaagaggcgatcatgaggtcaatgacgtgaaagtgaaaaaccttctgaacgcggaagtggttgagcttgcgtctcatgaagaagtagcggagaaacttggcgcggagccgggatttgcggggccgatcggcgctgccggcgacattgagatttatgccgaccaagccgtgaaagtaatggtaaacgccgtttgcggcgcgaatgaaaaagaccgtcattaccgaaacgtaaacatcgaacgtgacgcgtctgtaaaagcatacgccgatcttcgaatcattcaggaaggcgatccgtcacctgacggaaaaggcacgatccgtttcgctgaagggattgaggtcggacaagtctttaaactcggcacgcgttactctgaagcgatgaatgcgacataccttgatgaaaacgggcgtgcgcagccgatgctgatgggatgttacggaatcggcgtgtccagaacgctttcagccatcgctgaacagcatcacgacgaaaaaggcttgatctggccgaagagcgttgctccgtatgatcttcatattttggcgctgaatatgaaaaacgaagcgcaaaaagagcttgctgaacagctttacggcaaattccaggcggaaggttatgaggtattatacgatgaccgcgctgaacgcgcaggcgtgaagtttgctgattctgatctgatcggccttccgatccgcatcactgtcggaaaacgtgccgacgaaggcatcgtagaagtgaaaatccgcaaaaccggtgaatctgccgaagtttcagtggatgagctttctgaatttattaagacgaagtaatcaccataacgaatcgtccaaaatcatgttaaaatagagaaaaaagaaggtacctcatcacctgcggaggtaccttcacttatgatgttttaagggagggatactgtctgaatggaacagttatcagtaaacagaagacagtttcagattcttctgcagcagcttaatatgacagatgataccttcatgacatactttgaagacggagagattgataaactgacaatccataaagcagaaaaagcctggcatttccaatttcgctttaaggctcttttgccgtatcaaatatatgattcattcatgatgaggttaacacaatcgtttgctcacatcgcccgtgtcacatcgtctgttcaggtcatcgatcctacagtgacagaggagcttgtacaggattattggacacgctgtattgaagagcttgaaggaacctcgccgccgatggtggctcttttgaatcagcagaagccgaagctcaagggaaacaaactgatcgtgaaaacaaaaacagatacagaagcatcggcgctcaaaaataaatacagcacactgattcagcacagctaccgccaattcggatttccggaactgcagctggataccgaaattttcgtatctgaccaagaagtccagaaattccgcgagcaaaagcttgctgaagatcaggagcgggcgatgcaggcgcttatcgaaatggagaagaaggaaaaagagggcgatgaggatcaagcgccgtccggcccgcttgtcatcggctatcaaattaaagagaacgaagaaatccggacgcttgacagcatcatggatgaagaaagaagaattacggtgcaggggtttgtgtttgatgctgaaacacgcgagctgaaaagcggacgcacgctctgcattttcaaaatcacggactatacaaacagcattttagtaaaaatgttcgccagagaaaaagaagacgccgctttgatgaaaacgctgaaaaaaggcatgtgggtgaaggcgcggggaagcattcaaaacgatacattcgtcagagacctcgtcatgattgcaaatgacgtgaatgaaataaaagccaaaacccgtgaagacaccgctcctgaaggcgaaaaacgggttgagcttcatctgcattctccgatgagccaaatggatgctgtaacgggcatcggaaagcttgtcgaacaggcgaaaaaatggggacatgaagcgattgcgttaactgatcacgccgttgtgcagtctttcccggatgcctattccgccgcgaaaaaacacggcataaaaatgatatacggaatggaagccaatatcgtggatgacggcgttccgatcgcatacaatccagctcaccgtctcctggaagaagacacatacgtcgtctttgacgttgaaacgacaggtctgtccgcagtgtatgacaccatcattgagcttgccgcagtcaaaataagaggcggagaaatcatcgataaattcgaagcgttcgccaatccgcaccatccgctgtcagcaacgacgatagagcttaccgggataacggacgacatggtccgcgacgctcccgatgtcgttgacgtcgtccgggattttaaagaatggatcggcgatgacgtgcttgtggctcataacgccagctttgatatgggatttttaaatgtggcgtacaagcgtcttttgaaaacggaaaaagcgaaaaatccggttattgatacgctggaactcgcgcgtttcctgtatcctgagtttaaaaatcaccgcttaaatacgttatgtaagaagtttgatatcgaattaacccagcatcaccgagcggtctttgacgctgaagcaacgggctacctgctgttgaaaatgctcaaagatgccgctgaaaaagacattttttatcatgatcagctgaatgagaatatgggacaatccaatgcttatcaaagatcaaggccttatcacgctacattgcttgccgtaaatgagaccggccttaaaaatctgtttaagctcgtgtccatttctcatattcaatatttctacagagtgccgcgcattccgaggtcgcagcttaataaatacagagaaggtctgttaatcggctctgcctgtgacaggggagaggtctttgaaggcatgatgcaaaaatcacctgaagaggttgaagatatcgcatcattctatgattatcttgaagtgcagccgccggaagtatacagacaccttctgcagcttgagctcgtccgggatgaaaaagcgctgaaagaaatcatcgccaacatcacgaagctcggggaaaaattgaataagccggtcgttgccaccggaaatgtccactatttaaacgatgaggacaaaatttaccggaagatcttaatatcttcccaaggcggcgccaacccgttaaaccggcacgaactgcctaaagtgcacttcagaacgacagatgaaatgctggatgctttctcctttctcggtgcggaaaaagcgaaagaaatcgtggttgacaatacgcagaaagtcgcttcgatgatcgatgagatcaaaccgatcaaagacgatctgtacacgccgaaaattgacggagctgatgaagaaatccgtgaaatgagctatcagcgcgccagaagcatttacggtgaagagcttcctgaaattgtggaagcgagaatagaaaaagaattaaaaagcatcatcggtcatggattcgccgttatttatctcatctctcataagcttgtaaaacggtctctggatgacggttatctcgtcggctcccgggggtccgtcggttcatcgcttgtggcgaccttaacggaaatcactgaagtgaatccgctcgctccgcactatgtgtgcccgagctgccgatattccgaattctttaatgacggatcagtcggttccggttttgaccttccggataaaagctgcccgtcttgcggcacacctttgaaaaaggacgggcatgatatcccgtttgaaacgttcttaggctttaaaggtgacaaagtacccgatatcgacttgaacttctcaggtgagtatcagccccatgcccataactacacgaaagtgctgttcggtgaagataacgtgtatcgcgcgggaacgatcggcaccgttgcggaaaagacggcttacggatatgtgaaaggctatgcgggtgatcacaacctacacatgcgcggcgcggagatcgaccgtctggtgcagggctgcaccggcgttaagagaacgaccggccagcacccggggggattatcgttgtcccggattacatggatatttacgatttttccccgatacaattcccggcagatgcgacggggtctgaatggaaaacgactcattttgacttccactccattcatgacaacctgctgaagcttgatatattggggcacgatgatccgacagtcattcggatgctccaggatttaagcggaattgatccgaagacgattccgacagatgatccggaagttatgaagattttccaaggtacagaatcgctcggcgtcactgaagagcagatcggctgtaaaacggggacgctcggtattcctgaattcgggacgcgatttgtgcggcagatgcttgaggatacgaagccgacgacgttctccgagcttgtccagatttccgggctttcccacggaacggacgtatggctcggcaatgcgcaggaactgatacacaacaatacgtgtgaactgagcgaagtgatcggctgccgtgatgacattatggtttacttgatctatcagggccttgagccttcactggcctttaaaatcatggaattcgtgcgtaaaggcaaaggcctgacgccggaatgggaagaagaaatgaaaaagaacaatgtgccgaactggtatattgattcatgcaaaaaaatcaaatacatgttcccgaaagcccacgccgccgcatacgtattaatggcggtgcggattgcatactttaaagtgcatcacgcgcttttatattatgctgcgtattttaccgtccgcgcagatgactttgacattgatacaatgattaaaggctcgaccgccatcagagcggtgatggatgatatcagctctaaagggcttgatgcttcgccgaaggagaaaaacctccttaccgtgttagagcttgcgcttgaaatgtgtgagcgcggctattccttccagaaggtcgatctataccgttcgagcgcttcggaatttatcattgacggcaacagtctcatcccgccgttcaactcaattccgggactcggaaccaacgccgctctcaatattgtgaaagcgcgggaagaaggggagttcctttcaaaagaggatcttcaaaaacgcggaaaagtgtcaaaaaccattttagagtatttagaccgtcacggctgtcttgagtcgcttccggaccaaaatcagctgtctctgttttaagctttgtgcacagcctccgagcggagttagatttgcattaaatatatggttatggtatagttttattggaaatgctaacgattaccgaggcaaagagtggggaaacccgctcttttgtattgaacaggcaattttgcctcgacatgtccatcgttttctcaatgcccctgctcttttgaagcagggtttttatgcagaggaacggctgatatgatatcgacagcacaaggaggaaaaacatgagcaaaaaagtgactgataccgttcaaggaatggctcagcccatactggatgaccttcagcttgaactcgtagacattgaatttgtcaaagagggtcaaaactggttccttcgcgtgtttattgattccgataacggtgttgatattgaggagtgcgccaaagtcagcgaagcgttaagcgaaaagctggatgaggccgatccgatcactcagaactactttcttgaagtatcttctcctggagccgagcgtccattaaagaaaaaagccgacttcgaaaaatcactgggcaaaaatgtgtacatgaaaacgtacgaaccgattgacggtttaaaagtgtttgaaggcaaattggctgaatttgatggacaaactgttacaatagagatgacggtcaaaacaagaaagaaacgggtcaatattccgtatgaaaaaatagctaacgcgagattagctgtaacattttaatgaatgaagtattagtgtttaaggggggagaccgctaacatgagcagtgaactattagatgctctcactattcttgaaaaagaaaaaggcatcagtaaagacattatcatcgaagcaattgaagctgccttaatttccgcgtataagcgaaattttaaccaggcgcaaaacgtacgggtcgatctgaaccgtgagacgggcacgatccgcgtgttcgcaagaaaggatgtcgtagacgaggtatacgattcaagacttgaaatctcgcttgacgacgcccagcacatccatccgaactaccttgtcggagatgtcgttgaaatagaagtaacgccgaaagacttcggccgcattgctgcgcagacggcgaaacaagtggtgacgcagcgtgtccgtgaagctgagcgcggcgtgatttactcagaatttatcgatcgtgaagaagacatcatgacgggaattgtacagcgcttagacagcaagtttatttacgtgtctctcggcaagattgaagcgctgctgcccgtcaatgaacaaatgccgaatgagagctataaaccgcacgatcggattaaagtatttatcacaaaagtcgaaaaaacgacaaaagggccgcagatctatgtatcaagaacgcatcctggcctgttgaagcgtctttttgaaatcgaagtgccggaaatttatgacggaacggtcgaactgaaatccgttgccagagaagcgggcgaccgctctaaaatctccgtccgcactgatgaccctgacgttgatccggtcggttcatgcgtcggtcctaaaggccagcgggtgcaggcgatcgtcaatgaactgaaaggcgaaaaaattgatatcgtcaactggtctgatgatccggttgaatttgttgccaatgcgctcagcccgtctaaagtgctggatgtcatcgtcagcgaagaagaaaaagccacgactgtcatcgttcctgattaccagctttctctggcaatcggaaaaagagggcaaaacgcccgcttagccgcgaaattgacaggctggaaaatcgatatcaaaagtgaaacggatgcaagagaccttggcatctatccgagagagcatgaagaagatgacgatttagagccgctctttatggagcctgaaacagccgaatcggatgaataagaggtgactttaggtgaataagcgaaaaaaaattcctctgcgcaaatgcgtggtaacgggggaaatgaagcctaaaaaggaactgatccgaattgtccgttctaaagaaggagagatttcagtcgatccgaccggaaagaagaacgggcggggtgcctatatcacccttgagaaagaatgcatcttagctgcgaaaaagaaaaacacattgcaaaatcaatttcaatcacaaatcgatgaccagattttcgaagaattgctggaactggcggaaaaggtgaaaaaataacatgtctggaatggaatggtttcccttgctgggtctggccaatcgagctcgtaaggtcgtgtcgggcgaggacttggttataaaagaaattagaaatgcgcgtgcaaaacttgttctgctgacagaagatgcatctgcgaatactgcaaaaaaagtatccgataaatgcaattattataaagtgccttataaaaaagtcgaaagccgcgcggatctcggccgctctatcggcaaggaatcacgtgtcgttgtcgccgtcactgaccaaggttttgcgaataagctgatcagcttgctcgattaatatttttgggggtgaacgaatggctaaaatgagagtttacgaatatgcaaaagccatcaatgtttcaagcaaggaaattttgactgcgctgaaaaacatggatatagtagtaaataaccatatggcaatgcttgaagaaaagaccattaagcagcttgatgcgaaatttaaaaaaggcggcgccggcgttacatctcagaagcctgcggaaacgaacaaaaacaagccgcaagggattaatcagcagcctgctgggaatcaaccaaacaaaattcgagacggaaagaagaatgacgtgcagaataatcaatttaacaaaaacaagaagaacaacaacaacaaaaacaaaaacaaacgcaatcataacaacaaaaatcagtatcagcaaaaaccgctgaaaccgaaaaaagagcttcctgagaaaattacgttttccggctctttaacagtcggggccttagccgaagaacttggcaaagaaccgtctgaactcattaaaaaactgatgcttctgggcgtaatggctacgattaaccaggagcttgacaaagacacaatcgaactgatcgcatctgaatacggtgtggaaacagaagaagtgattgtgctcgaagaaactgagcttgaaaagtatgaagaggctgacaaagaagaagatcttcaaacccgtccgcctgtcgtgacgatcatgggccacgttgaccacgggaaaacgacccttcttgacagcatcagaaaaacaaaggttgttgaaggtgaagccggcggaatcacccagcatatcggggcgtaccagatcgaagaaaacggcaaaaaaatcacgttcttagatactccgggacacgcggcgttcacaacaatgcgtgcgcgcggtgcggaagtaactgatattaccattttagtcgtagcggctgatgacggcgttatgccgcaaacagtcgaagccatcaaccatgcgaaagcggctgaggttccgattatcgttgccgtgaataaagtggataaagaaagcgcgaaccctgaccgtgtcatgcaggagctgactgaatacggactcgttcctgaagcatggggaggagaaacgattttcgttcctctgtccgctcttacaggcaagggaattgacgagcttgtcgaaatgattctgcttgtcagtgaagtggaagagctgaaagccaatccgaaccgtcaggcaaaaggaacggttattgaagctgagctcgataaaggaagaggatctgtcgcgacacttctcgttcaaacgggaacattgcatgtcggagatccgatcgttgtcggaaatacattcggccgcgtgcgggccatggtcaatgatctcggccgccgcgtgaaaacagccggaccgtccacacctgtagaaatcacgggcttaaacgacgtaccgcaggctggcgatcaattcctcgtctttaaagatgaaaaaacagcccgttctgtcggtgaagcacgcgcttccaagcaactggaagaacagcgcagcgacaaagcgaagctgagcctcgatgatctgtttgaacaaattaaacaaggcgatgtcaaagacatcaatttaatcgtaaaagctgacgttcaaggttcagccgaagcgttaacagccgctcttcaaaaaattgaagtagaaggcgtaaaagtgaaaatcattcacacaggcgtcggtgcgattacggaatcagacattattctcgcatctgcttcaaatgcaatcgttatcgggtttaatgtgcgcccagacggaaatgctaagagcacggctgaagctgaaaatgtagatatccgtcttcaccgtatcatttacaaagtcatcgaagaaattgaagcggcgatgaaaggaatgcttgatcctgagtacgaagaaaaagtcatcggtcaggttgaagtgcgccaaacattcaaagtgtcgaaaatcggcacgattgccggcggatatgtaacagacggccacattacacgtgacagcggactccgcctgatccgtgacggcgtggtcatcttcgaaggggaagtagacgttctgaaacgcttcaaagatgatgtgaaagaagtttcacaaggatatgaatgtggtataacgattaagaaatacaatgacattcgcgaaggcgacgtccttgaagcgtatgtcatgcaggaaatcgaaagaaagtgatcggatttgcggaatgtgaatgcatcatttatgatgcgggatcattaaaggagaaacgagccgttctgaagcggattataacgagggttcagaataagttcaacgtgtcggccgcagaaatcggctatcaggacacttggcagcggaccagcttcggaatcgccgtcgtctcctcctctcacgttcaggcggaaaaggagatccagcgtgtactcgcgtttattgactcctttcccgagatagaacggacgatcactagaacagagtggttttaacttagaggtgattgaattgagtatgagagcaaaccgtgtcggcgagcagatgaaaaaagagctcggggatattatcagccgaaagctgaaagacccgagaatcggatttctcactgtaacagacgtacgtgtttcaggtgatttacaaatagcgaaggtgtatatctccgtcctcggcggagagaaaaagaaagaggaggcgctgaaagggcttgagaaagcgaaaggatttatccgttccgaaatcggcagccgaatcagactccgcaaaacgcctgagcttgaatttgaatttgatgaatcaattgagtacggcaatcgtattgaaacattgattcacgaactgcattcagataaaccgtctgaataacgggaaagaggatgggcgagtgtcgtctgtcctcttttctgcgttttacgggatacaattgataacaaaggagcgaaagacagatggttaacggagttctccttttacataaaccggtcggcatgacttctcacgactgtgtaatgaaaataagaaaactgttaaaaacaaagaaagtcgggcatacgggaacccttgatccggaagtgtcaggcgtactgccgatctgtgtcggacgggctacaaagatcgttgagtacgtcaccgacaagtcaaaaacgtacgatgctgagatcactctcggtttctccacatcgaccgaagaccagacgggagaaacggtcagcgtaaaacctgtcagggagccgctgaaagaagcggatatcaaagccgttttagacgaattgaagggaccgcaggagcaagtgccgccgatgtattccgcggtaaaggtcaacgggaaaaagctctatgaatacgccagagcgggtattgaagtggagcggccgaagcggaatatcacgattgaagatatcgcgctcacttcccctgtcacttataacgaagacacagcatcattccgctttacagtcacgtgctcaaaaggcacttacgtcagaacgttggcggtgacaatcggtgaaaaactcggctatcctgcgcatatgtcgcatctcatccgcactgcttccggcgatttcagccttgatgaatgtttcacgtttgaggaacttgaacagcaggtttcggacggaacggttgcagagcatgccgtgccgatcgatagagcgctcaatcatttgccgaaatgggtcataagtgatacattagctaagaaagctgaaaacgggtcggtgtttgacatcccggcggaattttctgcaatgacagctgacgcccgtatagcggtctgtactgaagacggagaatgtgtggccatttatatgccgcatccttcaaaaaaaggactgctgaaaccggctaaagtgctcatgcaaaaaagcgaacaataagaaaaaaggtgaccgttctgtgaagacgatacatatttctcatccgcatcatttacaaaaagaagagcagccggcgtctgtcatggcgctcggctactttgacggcgttcatttgggacaccggaaagtaatcggaacagccagacaaattgccgaagaaaaaggcctgtcgctggccgttatgacgtttcatccacacccttcccatgtgttgggcagggacaaagagccaaaggatctgattacgccgcttgaagataaaatcagccagatcgggcgtttaggcgctgatgtgctgtatgtcgtaaagtttgatgaagcgtttgcgtctctgtctccaaaacagtttgccgaggagtatattttagggttgaacgcgcggcacgctgtgggaggcttcgattttacgtacggaaaatacggaaaaggtacgatggagacgttgccggacgatttaaacggcaaggccggatgcacgactgtcgagaaacagaccgagcaggacagaaagatcagctccacttatatccggtcagcgctccaggatggtgacgttgaacttgcgcacactcttctcggccagccgtattttatccggggcactgtgattcacggagacaaaagaggccgcaccatcggttttccgaccgcgaatgtcggcctgcacaacagctatatcgtgccgccgacaggcgtgtatgcagtgaaagccgaaataaaaggcgaggtgtatgaaggcgtctgcaacatcggctacaaaccgaccttttatgaaaagcgtcccgatcagccgtcaattgaagttcatttgtttaattttcaacaggatgtatacggagaagacgttaaaatcgagtggtacaaacgaatccgaagcgaacggaagtttaacggcatcgatgaactgacggctcagatcgggaaagacaaacaagaagcgatccgttttttcagcaaataacggaaaaaacatcaaaagtacacaaattttattctaaaagatttgcatatgggcgcgatttttagtatcatatgtttcgtagtcttaaaaccattgcttggcaatccgaagtcaccgacggttgctaggtaactggggctaattatgatatggaggtgaaacaggatggcaattactcaagagcgtaaaaatcaactcatcagcgagttcaaaacacacgaatctgatactggttctccagaagttcagatcgctatcctaacagactcaattaacaacttgaacgagcatttgcgtactcacaagaaagatcaccactcacgtcgcggtcttcttaaaatggtaggtaaacgtcgtaatcttcttacgtatctgcgtaataaagacgtaactcgttaccgtgagttaattaacaaactaggcttacgtcgataatcgtaaaaagcgggaggattcccgcttttttatcgtattaaagcgaaaaaaataataataaaaaaacaatgaaatccttttacatactactttgacattgatatgttcaattcatttcgttcataataggagtaattgattatttcacacattaagagaggagctcgtaatcgaatgggacaagagaaacatgtctttaccatagattgggccggcagacagcttacagtagaagccggccagcttgccaaacaggcaaacggcgctgtcatggtccgctacggcgatactgcagtgctcagcacagcaaccgcatcaaaagaaccgaaaccgctagattttttcccgcttaccgttaactatgaagaaagattatacgcagtaggtaaaattccgggcggttttattaaaagagaaggccgtccaagtgaaaaggccgttttagccagccgtctgatcgaccgtccgatccgcccgcttttcgcagacggattccgtaacgaagtacaggtcatcagcattgtcatgagtgttgatcaggactgctcatctgaaatggctgcaatgttcggttcatcactcgctctttgcgtttccgatatcccgtttgaaggcccgatcgcgggtgtgacggtaggccgcattgaggggaaattcgtcatcaatccgacggttgaccagcttgaaaaaagtgatatcaacctcatcgttgcaggcacaaaagatgccatcaacatggtggaagccggagcggatgaagttcctgaagaaatcatgcttgaggcgataatgttcggtcacgaagaaattaagcgcctgatcgcattccaagaagaaatcgtcgcagcagtcggcaaagagaaaacagagatcgaactgtatgaaattgacgaagagctcagcgcaaaagtaaaaagccttgcggagccggatctgcttagcgccattcaggttcacgaaaaacatgctcgcgaagacgcgatcaatgaagtgaaaaatgcagttgtcgcgaaattcgaagaagaagagcatgatgaagatacgattaaaaaagtgaaacagacactgtctaaactcgtgaaaaacgaagtgcgccgtttgatcacagaagaaaaagtccgtccggacggccgcggcgttgatcaaatccgcccgctttcttcagaagtcggccttctgccgagaacacacggatccgggctgtttacgagaggacagacgcaggcgctcagcgtatgtacattaggagcccttggagacgttcagattcttgacggtttaggcgtggaagagtcaaaacgctttatgcatcattataacttcccgcagttcagcgtaggggagacaggcccgatgcgcggaccgggacgccgtgagatcggtcacggtgctcttggagagcgtgcgcttgagccggtcattccgaatgaaaaagacttcccgtatacggtccgcctcgtatctgaagtgcttgaatcaaacggttccacttcacaggccagcatctgcgcaagtacgcttgccatgatggacgcaggtgttccgattaaagcccctgttgcaggtatcgcgatgggacttgtgaaatcaggcgagtactatacggtattaaccgatattcaaggaatggaagacgccctcggtgacatggactttaaagtagccggcacggaaaaaggcgtgacagcgctgcaaatggacattaaaattgaaggcctttcaagagaaattcttgaagaagcgcttcagcaggcgaaaaaaggaagaatggaaatcttggacagcatgctcagcacgcttggtgaatcaagaaaagaactttctcaatatgcgccgaaaattttaacgatgaccattaatccggataaaatccgtgacgttatcggaccgagcggtaaacaaatcaacaaaatcattgaagataccggtgttaaaattgacattgaacaagacggcaccatctttatttcttctactgatgaaagcagcaaccaaaaagcgaaaaaaatcatcgaagatcttgtcagagaagtcgaagtcggccaactttacctcggtaaagtgaaacggattgagaaattcggcgcttttgttgaaatcttcagcggaaaagacggtctcgttcacatctctgaactagcgctcgaacgggtcggcaaggttgaggatgttgtgaaaatcggtgacgaaatccttgtgaaggtaactgaaattgacaaacagggacgagtgaatctgtcgcgtaaagcagtgctgcgcgaagagaaagaaaaagaacaggaacaacaacaatcttaaatgaaaacctaacaaggagcctgggagacccggcttctttattttgagaaagacaacagacgggttctaccttgtcctcctcatacataatgtgtgatgaggggggaaggacatgttgaaaaaattcgtgccgtttgccgtttttttatttcttttttttgtttcgtttgaaatgttaaaaaacccgtatacagttgattacatagacgcaatgaaaaaagacgcggtaactgtgtcagcatcaaaagatccgctctatgaagaattactgcaaaaagcgtcagagtatgaagtgaagccgcaagacgcgcggattgataaaatatggaagagtataccggggtataacggtttaaaagtcaatgtggaaaaatcctataaacaaatgaaaaaggacggagaatttcacgaagacgaccttgtctatgagcaggtaaagccgaaagtccatcttgattctctcgcgcctgaacccatttataaaggaaatcccgacaaaccgatggtcgctttcctgataaatgtcgcctggggaaatgaatacgtggagcaaatgctgcctattctgaagcagcaccaggtcaaagcaactttctttcttgaagggaaatggctgaaaaacaatcaggaactggggaaaaaaatagcggcagacggacatgaaatcggaaatcattcatacaatcaccctgatatgagcaaactgacttcaggaagcatttccgaacagcttgacaaaaccaatgcacaaatcagcgagacgctcggcatgaagccgaaatggtttgcgccgccaagcggcagcttcagaaaagccgtggtcgaccttgcggcggaaaaaggaatgggcaccatcatgtggaccgttgacaccattgactggcaaaaaccgtctcccgctgttttacaaacaagggtgttgagcaaaatacataacggagccatgattttaatgcatccgactgatccgactgcgaaaagcctggatacactgattgcaaaaatcaaagaaaaaggctacgcgctcggctcagtgtctgacttaatggatgaaaacaggctgatgaagtagcaggcggcagttgcctgtctttgaataggaggaacagacttgataaaacgctatacatgccaaaacggtgtaagagttgtgcttgaaaataatccaacggtgcggtctgtggcaatcggcgtctggatcgggacgggatcacgtcatgaaacgccggagacaaacggtatttcgcactttcttgagcatatgttttttaaaggaacaaataccaggtccgcacgtgaaatcgcagaatccttcgatcggataggcggccaagtgaatgccttcacttcaaaagaatatacgtgctattacgccaaagtgctggatgagcatgcaaactacgcacttgatgtgctggctgatatgttctttcattctgcttttgacgaagatgagctcaaaaaagaaaagaacgtcgtatatgaagaaatcaaaatgtatgaagacgcgccggatgacattgtccacgatctgctgagcaaagcgacatacggcaatcattcgctcggatacccgattctcgggacggaggaaacgctttcgtcgtttaacggcgattctctcagacagcatatggatgacttttacacgccggaccgcgtcgtcatttctgtcgccggaaatgtaacggaacaattcattaaagacgtggagaaatggttcggtacatacgaagcgaagggcaaagcaagcggcatcagcgagcctgagtttcattatgaaaagctgaccagaaaaaaagacaccgaacaggcgcatctctgtctcggtttcaaaggcctgaaagtcggagatccggacatttacgatttgatcgtcttaaacaacgtgcttggcggaagcatgagcagccgtcttttccaggatgtgcgcgaagataaaggactggcctattctgtatacagctatcacagttcctatgaagacagcggtatgctgacgatttacggaggcaccggcgcgaatcagctcggacttctgtctgaaaccattcaggaaacgttatcggttctaaaacgtgacggtatcaccccgaaagagctggaaaacagcaaagagcaaatgaaggggagcttaatgctcagcttagaaagcacaaacagcaaaatgagccggaacgggaaaaacgaactcctgctcggaaagcataagaccatggatgaaattatcgctgaattaaatgcggtcagcctggaaagcgtcaacggcctcagccgccgcttatttacggatgattacgcactatcgctcatcagcccgaccggcaatataccggcctcgtcttaagctgcaaagcagtctgcctctatacggggcaggcatttttttttgctccgggtcatatagtacaagggggtggctatcatgaggctcagtgaactgtcaggtaaagaaattgtggacattaaacgggcagagcggctcggcgtgctcggccagaccgatttggaaattaatgaacaggacggacaaattaccgcgctgttgataccgacggtaaaatggttcggattgcgaaaacaaggccacgacatccgcgtcccctggaaccatatccaaaaaatcgggtcagacatgatcattttagacgttccgggggagatcacgcctcccgaagagtagatcttattcattttttgcaagcaccggctcatacagccggtgcttttttcatgaaaaagacgctgtacattcaccgccctttctctttgcacatacgatgaagaggaggatgacacttaaaagatccagtaactgtaaagaaggtgaacgtttcagatgttaaccggattaacaattgcgatcattggcggtgacgcaagacagcttgagattataagaaagctgacagaacagcatgccgatatttatcttgcagggtttgaccaattggatgacggttttacaggaaccgtcaaatgcaaaattgatgagattccctttcaaaaaatagacagtatcatcctgcctgtatcggcaacgaccggagaaggcgttgtttccacggttttttcaaatgaagaagtggtattaaagcagagctatcttgagcggacaccggagcattgcgtcatttattcaggcatctccaatgcatatcttgaggggatcgccagcgaagccggccgtaagcttgtgaaattatttgagcgggacgacatcgcgatattcaactcgattcccactgttgaaggaacaatcatgatggcgattcagcatacggattataccattcacggatcaaatgttgccgttctcggcatggggcgcaccggtatgacgatcgcccggacgtttgcagcgttaggggcgaaagtaaaagtgggcgcgcggagttcggctcatttagcccgtatatcggaaatggggctttctccttttcaacttgaagaacttactgaacatgtaaatgatattgatatctgcattaacaccgtaccgagcttgattctgaatcaaagcgttttatcgcgcatgacgccgaagaccttgattttggatttagcatcccgtccgggcggaacggatttcaaatatgctgaaaaacaaggcattaaagcgctgcttgctccgggtcttccgggaattgtggccccgaaaacagccggacagattattgcgaacgtattgagcaagcttttggcagacttaaagaaagaggggaaatagccatgtctctgaaagggaaaagaatcggattcggattaaccggctcgcattgcacatatgaggaagtttttccgcaaatagaggcgcttatcagtcaaggagctgaagtccggccggtcgtgacgtcaaccgttcaatcgaccgatacccgctttggggaggggggagattgggtcagaaaaattgaagaagcaacaggctttgaggcgattgattccatcgtaaaagcggagcctctcgggccgaaacttccgctcgactgcatggtcatcgcccctttaaccggaaattcaatgagcaaactcgcaaatgcgatgactgacagccccgtccttatggctgcgaaagccacgatccgcaacggccggccggtcgtgctcggaatttcaacaaatgacggactcggtttaaacggaacgaatttaatgaggctgatgtccgcaaaaaacatatatttcatcccgttcggccaggatgaccacgtgaaaaaaccgacatcgctcgtcgccagaatggatctccttccgattacggtagaaaaagctcttttgcaccagcaggttcagccggtgctcgtacaccatcatgaataaaaaatcatgatgacagaaaatcattccggaataaaaaaattcggtcaatccgtgactattctatggtaaaataaaacgtaaaatgcaaagtcaattcaacaaatgatgcttaattggcggaaggagttttacagatgggaagaggattacacgtagcagttgtcggagcgacgggagccgtaggacagcaaatgctgaaaacactggaagacagaaactttgaaatcgaaacactcacactactatcctcaaagcgttctgctggtacgaaagtaacgtttaaaggcgaaggatatacagtgcaggaagctgttcctgaaagcttcgaaggcgttcatatcgcgttattcagcgccggcggaagcgtatcacaaagcttggcgcctgaggctgtaaaacggggagccatcgtgattgacaatacgagcgcattccgtatggacgaaaatacaccgctcgtggtgcctgaggtgaacgaaggtgatctgcacaaacataacggcattatcgccaaccctaactgttcaacgattcagatggtggctgcgcttgaaccgatccgcaaagcgtacggtttgaaaaaagtcattgtatctacttaccaagctgtttccggagccggcaatgaagcggcgaaagaattgtacagccagacaaaggcgattttaaacaatgaacccgcagaaccgtccattatgccggttaaaggcgataaaaagcattatcaaatcgcatttaacgccattccgcaaattgataaattccaagacaacggctatacgtttgaggaaatgaaaatgattaatgaaacgaaaaaaatcatgcatatgccgaagctggaagtggctgcgacatgtgtcagactgccgattgaaacagggcactcagaatctgtttacattgagcttgaccgtgatgacgcaaccgttgaagatattaaacagcttttaaaagaagctccgggtgttacgcttcaggatgatccggcggagcagctttacccgatgcctgctgattgcgtcggcaaacgcgatgtatttgtaggaagaatccggaaagatttggacagagcaaacggttttcatttgtgggttgtttctgataacctgttaaaaggcgccgcttggaactcagttcaaatcgcggaaagcctgcaaaaactgaacctcgtataaaacaaacgtattttctataggcgaacagaagagagtaaggctctgcctgctctcttctgttacgtcagactaatttggagtgaaaatagtgaagatcatagttcaaaaattcggcggaacatccgtaaaagatgacaaaggccgcaagcttgcgctagcacacattaaagatgccataagtgaaggttataaggttgtcgttgtcgtatcggcgatgggaagaaaaggagacccgtacgcgacagattctttaatcgggctcctttacggcagccagtccgacatttctccgagagagcaggatatgcttctgtcttgcggagaaacgatttcgtccgttgttttttccagcatgctgaaggaaaacggcataaaagccgcagctttaacaggagcccaggccggctttttaaccaatgcccagcatactgacgccaaaattatagaaatgaaaacagagcggcttttcgctgcactcgccagccatgatgccgtcgttgtcgcagggtttcagggagcgactgaaaaaggcgacacgacgacgatcggcagaggaggaagcgatacatcagcggcagcgctcggcgcggcggttgatgctgagtttatcgacatttttacggacgtggaaggtgttatgacagccgatccgagaatcgtggaaaatgctaagccgcttccgaatgtcacatatacggaaatctgcaaccttgcctatcaaggcgcgaaagtcattcatccgcgcgcggtggaaatcgccatgcaggcaaaggtgccgatccgcgtgcgctccacttattcaaaagacaaaggcactttggtgacgtcccatcattcgtccaacgtcggcagcgatgtattcgaacggctgatcacggggatcgcccatgtgaaagatgtgacgcaatttaaggttcccgccaaaatggggcaatacaacgttcagactgaagtctttaaagcaatggcaaatgccggaatcagcgtagatttctttaacattacgccgagtgaaatcgtatataccgtagccggcagtaaaacggaagccgcgcgcagcatcttggctgaattaggatatgagccgacagtgacggaaagctgtgcgaaagtgtcagcggtcggcgccggaataatgggtgttccgggtgtcacgtcaaaaatcgtctccgcactttctgataaaggcattccgattctgcaatctgccgacagccatacgacgatctgggtgctcgttcatgaaaaagatatggtaacggccgtaaatgcgctgcatgaagtgtttgaactttcaaagtaaatgtgattgaatcatgatgaggtgaaaaaaatgaatgtcggaaatatatctacagcgatgattaccccctttgacagtaaagggaatgtagactttcaaaaactgtctacattaatcgactatttgttgaaaaacggcacggattctttagtcgtcgcaggcacgaccggcgaatccccgacactttcaacggaagaaaaaattgcactctttgaatttacagtcaaagaagtgaacggacgcgtgcctgttattgcgggtacaggaagcaacaatacgaaagactccattaaactgacaaaaaaagctgaagaagccggcgtcgattgcgttatgcttgtcacgccgtattataataagccttcccaagaggggatgtaccgtcattttaaagccatagctgaagaaacgtctctccctgtgatgctttacaacgtgccgggcagaacggtcgcttcgcttgcgccggaaacggccatcagacttgcggagattccgaatatctctgcgattaaagaagcgagcggcgatcttgatgccattacgaaaattattgccgaaacaccggaagatttttacgtctattcaggtgatgacgggttaacgcttcctattctcgcagtcggcggaagaggagtcgtgtcagtggccagccatatcgtgggttctgacatgcagcagatgattaaaaactatacgaacgggcagacggcaaccgcggcactgattcatcagaagcttctgccgatcatgaaggagctctttaaagcgcctaatccggctccggtcaaaacggcgctgcagctgaaaggccttgatgtcggatctgtgcgtcttcctcttatcccgctgaatgaagatgaacgtctgagcctgagcagcgtcatcagcgaactgtaagaaaaaatttatacagttgaaatacgcggtcattctcatttttatcgtgagtttgaccgttttgtatacatattggttttccctaaaccttccgcttcttcttgttttctaaaattgatatcagttataataggaacaagtgatgatggacgggtatgagactaggaggatacagattttgaaaaagaaaaatacagaaaacgtcagaattatcgcccttggcggcgtcggagaaattgggaagaacctatatgtcattgaaattgactcagacatatttgtagtggatgcagggctgatgcaccctgaaaatgaaatgctcggtattgatgtcgtcattccggatatttcctacttagtagaacgggctgaccgcgtgaaggccatctttctgacacacgggcacgatgaaaacatcgggggcgtcttttatttattgaacaagctgttggtgccggtatacggaacgaagcttacgcttgcattactgagagaaaaactcaagcagtacgggcataatcgaaaagctgatttacgtgaagttcactctaaatcagtcattacatttgaatcaacgaaagtatcgttctttaaaacgattcacagcattccggattcagtcggagtcagcttcaaaacatcacttggctctattgtatgcacgggagacttcaaatttgaccagacgcctgcttatcatcaatcatgtgatattggcgaaattgccaaaatcggaaacagcggcgtgctcgccctgctttctgacagcgccaatgcggagcgcccggggtatactccgtcagaagcatatgtaagcggtgaaatttccgatgcgatgaacaattcagaaaaccgtgtcatcattgctgtattcgcgtctaatatcaaccggatccagcaagtgatacaggctgccgtccagaacggccgcaaacttgcaatcgccggaaaaaatctgcaaaacgtgcttcagcttggacgcaagctcggctatattgaagccgaagatgaaatgtttattcctgtgcaggatgtgaaaaaatatccgaagcgggacgtggcaattgttacagccggaagtcatggagagccgctggccgctcttacgcgaatggccaagcaggcgcacaagcagcttaacattgaagaaggagacaccgttgtcattgcatcaacaccgattccggggcatgaattgatatattccaaaaccgtcaacctgcttgcccgcgccggcgctcaagtgattttcgcccaaaaacgagtgcatgtgtccggtcacggttcgcaggaagaattgaaactcatgcttaatttgctgaaaccgaaatatttaattccggttaacggtgaattcagaatgcaaaaagcgcattccaaaatcgcagaagagatcggcatgaaacgcagcgatattttcttgattgaaaaaggtgacgtcgttgaattccgcggccagaatgtgaaaatcggggataaagtcacatacggaaacgttctgattgacggcctcggagtcggcgacatcggcaacatcgtgctgagagaccgccgcttattgtcacaagacggcattctcatcgtcgtgatttcactcgataagcagaagaagaaccttgtttcaggccctgagatcattacgcgcggttttgtgtatgtcagagaatcagaggggttaattgtacaagctactgagctcgtccgctctatcgtgactgaagcgacagaaacatctgccgtagaatggtccacgctgaaacaagcaatgcgtgatgcgctgaatcaattcctttatgaaaaaacaaaacgcaagccgatgatcattccgatcattatggaagtataatgtatacaaagccggagcgcatcatgctccggctttgtttttgttcatgtcccggatggaaatcatcatctttgttcataatacaaagagacattcggaaagggtgaaagataaaatggatcatcgtatggaaaacaccgaggaacagcagcccgaaaaatcagatgcgaaagacagcattatgagcaaaattcagcagctgggagagacatctctgccgcaaatgtcccaagataccaatattcactgcctgacgatcatcggccaaattgaggggcacgtccagctcccgccgcaaaataaaacaaccaaatatgaacatgtcattccgcaaatcgtcgccattgagcaaaatccgaaaatcgaaggacttctgatcatcttaaacaccgtcggaggcgatgtggaagcggggcttgcgattgcggaaatgctcgcatccttatcaaaaccgaccgtctcaatcgtactcggcgggggccactccataggtgtgccgatcgccgtgtcatgtgatcatagttttatcgcggagacagcgacaatgaccattcaccccgttcggcttacaggtctggttatcggcgttccgcaaacgtttgaatacctggataaaatgcaggagcgggtcgtcaactttgtgacccatcattcaaatatttccgaagaaaaattcaaagagctgatgttttcaaaaggaaacttaaccagggacatcggaacgaacgtagtcggcaaagatgcggctgattacggactaattgatgacgtgggcggcgtcggacaggcgataaaaaagctgaatcagctgattgaggaacgaaagggcgaggaaggaaggatgattcaatgatcctttataccgtcatgccccaagaagtcgtttacggtcaggatatagagaaaagcgtgcatgaacaggtagattacgccggtgtgccgctgctggttgagatgaagggaaatgaagctgaagtcgtacagattttaagtacgaacccgatggattttctgaatccggacatcgctccgggacaaaaaatcaagctgaaaatctaaccggcattcagtccgtttctcgggggcaaaatatgctataataggggaatcctacagaaaaatgcagccggcaaaaggctgcttttcttcatgatgtatgattttacattttttaacgcagtaaggtgatgagtgtggcaaagaaaaaacggaaatctaaaaagaaacaagagagtaagctcaatctaaaatacgaactaagcggactgctctgtgttgcaatctcgattattgctgttttgcagctcggcgttgtgggacagacatttgtgtacttgttccgtttttttgccggagagtggtttattttatgcttaattgcgctcttccttctcggaatttcgctgttttggaaaaagaagagtccaagccttttaacgagaagaaaggcggggttgtactgtattatcgccagtattttgctgctgtctcacgtgcagctctttaaaaatctgtctcatcacgggtcgattcggtcggcaagtgtcatcggcaacacgtgggagctgtttatgattgacatgaaacagcaggctgcttcccctgatttgggcggcggcatgatcggcgcggtactgtttgcagcttcccactttttatttgcatcaacgggttcacaaatcatggcgatcgtgctgatcttaatggggctgattcttgtaacggggcgttcactgcaggaaacgctcaaaaagtggacgagccccgtcggcaggtttatccgcaatcaatggcaggcatttcttgaggatatgaagacggtcagaacgaatatgtcttcgccgaaaacaaaaaccaaatcgggcaaaaaacaaaaacgggttcaaaagaaaaaagaaatgcctgagcccgaagaagaggatgaggaaatcatttcgccgatcatccattcagagccgattatttcaagcttttcagaccgtcaggaagaacgcgtcgaaccgctgattccggaaaaaacgcaggagacggcgcaagcggcaaaagatgagccttccggcggcgctcaagacagtgacgaaacggctgccgctccgccgatgacgtttacggagcttgaaaataaagattatcaaatgccttcattggacatactggctgacccgaaacataccggccagcaaaccgataagaaaaacatttacgagaatgcaagaaaactcgaacggacttttcaaagcttcggggtaaaggcgaaagtgacccaagttcatctcggcccggcggtcacaaaatatgaggtgtatccggacgtcggggtcaaagtcagtaaaatcgtgaatctgagcgatgaccttgcgctcgcgcttgccgccaaggatatccggatagaagcgccgattccgggtaaatcagcaatcggcatcgaggtgcccaatgctgaagttgcgatggtttcgttaaaagaagtgcttgaatccaagctcaatgacaagccggacgcgaagcttctgatcggcttgggacgaaatatttccggggaagccgtgcttgccgaactgaacaaaatgccccacctgctcgtagcgggggcaacgggaagcggaaaaagcgtctgtgtcaacggtattattacgagcattctgatgagggccaaaccgcatgaagtgaagatgatgatgattgacccgaaaatggttgagctgaatgtgtataacggcattcctcatctgcttgcgccggtcgtgacagatccgaaaaaggcctcgcaggctttgaaaaaggtcgtcaatgagatggagcgccgctatgagctgttctcccatacgggtacgagaaatatagaaggctataacgaccatataaagcggtcaaatgccgaagaagaagtcaagcagcctgagctgccatacatcgtcgtcatcgttgacgagcttgccgatctgatgatggtcgcttcttccgatgtggaagattcaattacgagactttcacagatggcgcgggcggcgggaattcatttgattatcgcgactcagcggccttcagttgacgttattaccggtgttattaaagccaacattccgtcaagaattgccttcagtgtttcatctcagaccgattcacggacaattttagacatgggcggcgctgaaaagcttctggggcgcggagacatgctgtttctgcctgtaggcgcgaataagcctgtccgggtccagggagcatttttatcggatgaagaggttgagcatgtcgtcgatcatgtgattacgcagcaaaaagcgcagtatcaagaagagatgattccggaagaagtgtcggaaacacacagtgaagtaacggatgatctctatgacgaagcggtcgatttgattatcggcatgcagacggcatcagtctccatgcttcaaaggcggttcagaatcggatatacgagagcagcccgtctgattgacgcaatggaggaacggggcgtcgtcgggccgtatgaaggaagcaaaccgagggaagtactattatctaaggaacaatatgatgagctctcttcttaaaaaggagagagttttcactgaaaatgatatcaccaaaatcattcctatttatttttttattaaaacatgatatagttgtcccaattgttcaataatttatgaaagtggtttacggaggggaaacatgtctacaaaagctgacaatcgtcacttgtacctaaaagtgattgagcgaatcaaagaggatatacaaaacggaatttacaccgaaaaggaaaagcttccttctgaatttgagctttcaaaatctatgggtgtcagccgggcaactctgcgtgaagctttgcgtatccttgaagaggagcatgtgattatcagaaggcacggtgtgggcactttcgtccatacaaaaccgctgtttctttcaggtattgaacagctcaacagcgtgacgaaaatgattcagcaggcgaacatggtgccgggtacgatttttttgtcgtctcaggtcatcacgccgtctgatgaagatatcgctagattccggcttgagcctgagcaggagcttttttatttggaacgcgtgagaacggcaagcggcactccggtcgtttactgtttagattcgattccgatgcacattctgccgaattctttctgtcatgaacaggaatctatttttgatcttttggaaaaaaactccgggtctgtgatcagctatgccgttgctgatatcgaaccgatcggatatcacgatacgatttcaccggttttggaatgcgagccggagacggcgcttttattgctgaagcaaacccactataatcagaatgatgaacctgtgctgtattcattaaattatttccgggcagataagttcagttttcatgttgtaagaaaacgtttttaagacagacgcgtcatgtgtctgttttttttatttgccgcttcaatacatactttgttttccgcaaggcacaataaaacaggaaacaaccaagtatagtgaatgggtgaataagttgagtaagaagaaaaatggaacaaaaaatatcattgctctggcttctgtaccgctcgtgatgacactcgggaattccatgctgattcctgtgcttccgatgattgaaaagaagctgtccatatcgtcttttcaagtatcgttaattataacggtctattcgattgtggctattatttgtattccgattgccggatatttgtccgataaattcggaagaaaaaaggttcttctgccttgtcttctcatagccggtgcgggcggagcgcttgccgcgatagcttccaccgcgttcaagcatccttatcccattatcttggcggggcgggtgctgcagggaatcggttcggcaggggcggctcctgtagtgatgccgtttatcggtgatttattcaaaggggatgatgagcggattaccgcggggctcggcgacattgagacgtcaaacacggccggaaaagtattaagcccgattctcggatcgctcttggctgcatggttttggtttatgccgttttggttcattccgtttttttcgctcatcagtttttttctcgtattgtttttggtggcaaagccggagaaacaaaaagaagcgccttctatttccgaatttgtgaaaaatgtcggccgcatatttaagcgtgacggacgctggctctttacggtatttatcatcggctgcgtgattatgtttttgctgttcggggttcttttttatttatcagactcactggagaagaaatacggaattgacggtgtggctaaaggagcgcttttggcaatcccgcttttatttctatccgtcagttcatatatatcaggcagaaaaatcgggaaagaccaaggcaaaatgaagttttgcattgttttcggaatgagtgccgtgacactgtcgtttatcggcctatggtggaatcacagtttttatttattatttatctttttgtgtgtcagcggtatcggtatcggaatagcattaccggcattagacgctgtcatcacagaaggcgtagacaacgaggaatcgggaaccatcacctcattttataacagcatgcggtttatcggagtagcggcgggaccgccgatctttgctgccctgatgtcaaatgcaggctggctgatttttattttatccgctttttgcggcattgtgtctgtatttttagcgctgttaaatatctcatcacaagctaaagaaaaaaaggaatcattaaagacggtgtaatctgcactgtctttttttattttgaagattgacatgatatcgtcaagtcgttatcctttttaatagttaaacattttaactattggaaggagggggaaaaggtgcatgaagaaaaagtaaagcagctgattcagcgttattccgatgtatacctgcacgtcttaaaaaaaattgacagcattatcgctgaaaaagtgaacaaagagctgacattggatcaatattacatactccgctatattatgctcaatccggattgcaaatcaattgaactggccgcggtgtgccacgtcaataaaagcgccattacatcgatgacgaaccgcctgtatgaaaaaggctacatcaatagagaacgcagcgaaagcgaccgccggagcatacttttaaatgtcacggaaaaggggacggaagtatttcaccgtgtggagcggcggattgaggaactcgtccgttcatatattatgtattttgatgaagacgaggcggagatgttcgttaatacatatgaaaaattatatcgattgatgatgacagaggaggatcagcagacataatgaaaaacattatccgagcccgctggatcatcgccgcgttatggatcgccgcaacggtgatatttatgcttacagcgcctgatatggctgaattgacacgggagaaagggcagatttccgtaccggacggatattcctcttcttatgcccatgaattgcttgatgaaatgtctgattcagatgcaccgtcttcttctgccgtcatcgtatttcacgaaaaaggcttaatgacagacaaaaaagatcgtctggaagaagccgtcagcactttgtctgaacagaaaaaagcgcttcagattaaaacggtgacttcatacttcggggagaaaaatgacgacatcaaaaaacagctgctgtcaaaagacagacaaacgatgctcgttcagctgcagcttgatacatccaaaaacgatatcctcgaaataaaaaataaaattgataaagagctgaaaccgtacggcgtatcatacggcattacaggccagtcgctgatcgacgaagatgtgttaaaaagctcacaggacggcttgaaaaagactgaatatataacggtcgcttttatcctgatcgtgctggtccttgtattccggtcagtggtcgctccgtttgtgccgcttttatctgtattgatatcttatttagtcagccagtcgattgtcgcatttttagtcggccagctgaattttccgctctcaacttttacgcagatttttatggttgcgattatgttcggaatcggcacagactactgcattctgcttctcagcagatttaaagaagaactgtcgcatggcgctgatataagagaagcgatcgtcgtcacctacaaaacggccggaaagacggttttgtacagcggcggtgcggtgctgatcggatttgcctgcatcggatttgcgacatttaagctgtatcagtcggcagccgccgttgcggtcggtgtcgcggtgctgctgcttgcgctcatgacgatcgtgccgttttttatggctgttttaggaaaaagactgttttggcctgttaagggcgatatttcccatcctcaaagcaaagcatgggaaacggcagggcggttttcatttaaaaggccgctcatcagtcttgcaatcgttgcggtattcaccgtcccgcctatccttctttacaaaggatcgctatcttacaacagccttgacgaaatcggggacaaatatgaatccgtccgcgcgtttaatacgatttcaggcgcattcggcccgggagaacttcttccggccacagtcgtcatcaaaaatgatgagccattaaataccgaaaaacacctgattgatatcgaaaaaatcagcagagaacttgaaaaaacagagggtgtaaaaacggtcagaagcgccacgcgccctgccggaaacggattgaatcaattatttgtcacaaatcaggcaaagcagcttcaagaagggcttgataaaggcaatacaggacttgaaaaaatcacggacggattagggcatgccgcaaagtcgttagccgattcacagccgcagatcgaagagtcggggaaaagcgtcaatcagcttattaacggaacattgtctctgaaatccgggctttctgatataggagaaaacctgaataaactgcaggctggcgtgaatgagaataaagccggcgtcgcccagatgagaaatcagattgaagagcaaaaacaaatgctgacttcacagctcaaacaaaacagcggtctcgcttcagaaacgcaaaacgctttaaaattggtaaaaaccgtcctgccgatgaaagatgaagccagcagacagcttgccgatttgaacaagcagcttgcccggctgccgtttgcaaaattggaagcgtcaataccgtcagtcaaaaccgatccctcttacaaagaaatcaaatcggcctttacgggtgtacagtcagccgtttccaaggcaaacgcggatgcagaagcgttttctaaacaggtcgacagtcaaaaggatcatctgcagcaagcggaaaaacaatttgcccggctggcagccgcacagaagaagattgacactcaaattaacgcaatgatcaatggactgaccagtattgaaaacggtctgcagcaagtgtcagacggacagggggctcttgcaggacaaatgccgcgccttgaatcggcggcaggacagctcgcggagggccagaaaaaaatgaagagcggtctcggtgatttttcttcccggctcagcgatctttcttcaggccttaacgatagtgtaaaagggcttaagaaagtatcaagcggcatgatgggggcgaatgattacctgggtgagcttcacaaggcgtcagataaagaaatgacaggctggtttgtgccgagagacgcgttgacaaacagtgatttcacaagcgtgtttaatacgtacatgtcagatgacagaaaaacgacagaattgaccgtcgttcttgataacaatccttactcaaatacggccattcaagatattcaagcgatcaaagcgagcgtaaaaagagccattccgaacacggatctgaagaatgcctctttcggcgtttcgggagtctccagcatgaatgccgatctgaaagaagtatcggattcagacttcaaacggacggcaatgtttatgctggcgggaatttttctgattctcatcataatgctgcgctctctcattatgcctgtttatttagtggcgtcgctcgtactgacgtatttcgcatccatcggcgtgacggaatacatctttacacacttcttcgggtatccgggcgtaaactgggccgtaccgttcttcggctttgttattttgatggctcttggtgtggattattccatctttttaatggaccgctttaatgagctgaaaaaagaaggaacggggcccgcaatgatcagcagtatgaaaaatatgggttccgtcatcatttctgcggcgattattttagcgggaacctttgcggccatgctgccgtcaggcgttctttccttattacagattgcaaccgtggtattaacaggccttctcatgtacgcaattgtcgtccttccgttttttgtaccggtcatggtgaaaatattcggaagagccaactggtggcctttcaatttgaaaaaataacgtacaatgcctctgcctgttttcgggcagaggttttttgtttccttataaatcctccagttgatataattacatctgcgcactcttttttgcgaatgctgaaatttggtcataatacatactattaaagaatgaacgaaggaggtttcacatgacttatgtaaatgaaatgaagtcaaagcacggcgggatcaccgcccatatcgtaaagactgagaaatttaaaaccgtttcgctgacgtttaaaatgctggctcctttaacgaaagagctcgtaacaaaaagggcgctgtttccgcatgtgcttctgcgcggaacagaaagccgcccgaaaaccgctgatctgcgttcttattttgatgagctgtacggcacatccgtttcagctgatctgacaaaaaagggagaacgtcatgtcattacgttcagacttgagattcctaatgaaaagtatctgaaggaccgcacaccgctattggaaaaaggccttcagcttttatcagagcttgtcttttcgcccgctttggaaaacggcgccttcctgcccctttatgtcacgcaggaaaaacggacgctgaaacagcggattcaagccgtatatgatgataagatgagatattctaatctgcgtctcgttcaggaaatgtgcaaaagcgaaccgtatgcccttcacgtcaacggcgagttcgatgatgttgaacacattacaccgcaagatttgtatgaagcctatcaaaaagccatacgcgaagatcagctggacctgtacgtcatcggcgatgttgattcagatcaggtgaaaacggccgttgatacgtattttaaaacggaagaacgggagctgcagccttttgaaagaagcgcggcgaatgaacagcccgatccgaaggaagtcattgatgaagaggacgtcaagcagggcaagctgaatatcggattccggaccaatacgacatatacagatccggattatccggcattgcaggtgtttaacgggctgttcggggggttctctcattcaaagctgtttataaatgtccgtgaaaaagcgagcctcgcctattatgcagcctcaagggtggaaagcttcaaagggcttttgatggtcatgtcgggcattgaggtgaaaaattataagcaggccgtcaccataatcgaagaacaatttcaggctatgcaaaacggtgacttttcagaggacgatatcgcccaaacgaaagccgttattaaaaaccaagtgttagaaacgattgatacggcatacggcttatcggaatttctgtatcagcaggcttcagcccaagtggaaataccgatcgaaactttcctcgacaatatcgagaaagtgacaaaagaggacattatcaatgtcggaaagaacattaagctggatacgacttatttcttaaaagggacggggggagcatcttgactaaaccgataaacttcgaacagcttcaggaaacgctgtatcatgaaaaaatggcaaacggccttgatgtctatgtgctgccgaaacagggttttaataaaacatacgccgtgtttacgacaaagtacggttccattgacaatcaattcgttcctttaaataaggaagaaatggtacacgtccctgacggaatcgcgcattttctggagcataaactgtttgaaaaagcggacggcgacgtgtttcaggacttcagtaagcagggggcgtcggcaaatgcctttacatcatttacacgaaccgcttatctgttctccagcacttctaatgtagagaaaaacctggaaacactcgtggattttgttcaggacccgtatttcacggaaaaatcagttgaaaaagaaaaaggcatcatcggtcaggaaatcaatatgtatgatgataatccggattggcggctgtttttcggccttattgaaaatatgtataaagaccaccccgtgaaaattgacattgccggaacggtggagagcatctctcatattacgaaagatctgctgtatgagtgctacgaaacgttttatcacccgagcaatatgctgctctttatcgtcggtcccgtagatcctgaagcggtcatcagccaggtgcggaaaaaccaggagaaaaagccgtttacagaccagcctgaaatcaaacgtaaagaggttcaggagcaggaagcggttttccgccgggagcaggaattaaaaatgaacgtgcaaggctcaaaatgtcttgtcggcttaaaggcgaaagacccttataaaacggggcgggagctgttgaagcacgagctcagcatgaacctcatgcttgaatgtctcttcggaaaaagctcaccgcattacggcaacttgtacgataaaggctacattgatgaaaccttcagctttgattacacggctgaatacggattcggttttgcctctgtcggaggagatacaccggagccggataagctcgctgacgaattaaaacagatgctgcttgatgcagaatcagccgtgactgcggaaaaacttgaccttgcgagaaaaaagaaaatcgggtcatttttaaaagcgctcaattcacctgaatatatcgccaaccaattcacacgctacgcctttttagatatgagtctgtttgatgtcgtaaccgtactggagcagatcaccctggaagacgtaaagcgggtcattaaagaagaaatatcagaagacaggctgacagtctgcaaagtcgtgccaaaatcataacaaaacatccctcacgccctgagggatgtttttctggggaaagaaggagtattgattgatgaaacagacagcgctcgtaaccggagcaagcggcggaatcggacaaagtataagtgaagtcctcgcaaaaaacggatatgacgtccttttgcattatcattctcataaggaagccgcacacaggcttgcggaaaggctgagcgcatcattcggcgtaaaagcctccgttatacaggcggatctgtcctcaccggatggcgcggagacactcagccgttccgttaagcagcctgtggatgctctgatattaaacagcggcaaaagtcatttcggcctgattacggacgttacggatgacacggcgcgggagatggtgcagctgcatgtgacgagtccgtttcttttggcgcgtaatctggtgcccggcatgatccggaaaaaaagcgggggcatcgtcgcgatcggttccgtctggggagaaacaggcgcatcgtgcgaggtattatacagcatggtcaaaggagcgcagcattcgttcgtcaaagcgcttgccaaagagctcgctccgagcggcgtccgcgtgaatgcaatatcgccgggtgccgttgatacaaatatgcttgatcagttcacgtctgatgaaaaagaagcgttggcagaggaaattcccgcgggccggctggcgaagccggaggaaatcgccgaagcggcggcctttttattatcggacaaggcttcctatattacggggcatatattatccgtaaacggcggctggcactgctgaaaaaatgtgtgtatagtttgcatctgcacggacaaaataattttgtaacaacagatgaaatggaggaacccaacatgtcagtattagaaaactgggataattggaagaatttccttggcgacagattgaactatgcgcaggaaaaagggatgagtgatgaaacaatcactgacctcgctacagaaatcggcggttaccttgcgaacgaagtcgactcgaaaaaccatcaggaaaaagtgcttgctgatctttggagcgttgcttctgaagatgaacagcgcgccatcgcaaatatgatggtgaagcttgttgaaaataacagcactcattaagaggggggatttctcctctctttttttatgttttcctctatagagcaacattcttctttctaattagagaaaaatgttttatgataaaggaaggtaaaaatttgccacaatggagggggtatatcatttggcaaagctcgaatggtattttgaatatgaaattcaagtgaaccgccccggcctgctcggggatatttcatctcttctcgggatgctgtcaattaatattgtcacaattaacggtgtcgacctttccagaaggggaatgctgctcagatgccggcatatagatcaaattaaacgattggaatcaattttaaaaacaatggagaccattaaagtaacgaagctgagagaaccgaggcttcgcgaccgtctcgcagtccgccacggaagatacattcagcgtgatgccgatgacaaaaaaaccttccgttttgaaagggacgagctcggtcttctggttgactttatggccgagctgtttaaaaaagaagggcacaaactgatcggaatccgaggaatgccgagggtcggaaaaacggagtccatcgttgcgtcaagcgtttgtgccagcaaaagatggcttttcgtatcatcaacgctgctaaaacaaacgatccggagccagctggttgccgatgaatacagcacggaaaacgtgtttatcctcgacggcatcgtttcgacaagacggggatctgagcgccatcttcagctcgtcagtgaaattatgcggcttccggcgacaaaggtcgtggagcaccccgatatttttgttcaaaattcggagtatacgctcgatgatttcgattatattatcgaactcagaaatgatcctgacgaagtcattacatatgaacatgcagaagaaccgcaaatgtttgatcagaccggtttttcaagctttgatttttaatattggaaggtgtttgttgtgacagaattagcaatccggcttaaagaagccagagaggaaaaagggatgtcattggatgaactccaggcggcgacgaaaattcagaaaagatacttaaccgctctggaagaaggcaattatgacgtcattcccggcaatttttatgtgcgggcgtttatcaagcaatacgctgaagctgtcgggcttgattcagatcagttatttgaagaatataaaaaagacatccctaacacgtaccatgacgatgtgtcggaaaaaatctccggtctcgccatgcaaagggagcttcctaagtccgcttcaaaggcggcggaatggcttccgaccgtccttgtcgtcatcggtgtcattatcgtcatcgcgatcatttatgcgattattcagttcggaatgagcaaatccgggcagacagacggagataaggccgtcacccaaagtgagagcaagtatgagattcctaaggattctgcgctgaaaaacgacggcaatacaaacgacgaagcgcaatctgacagcaaaaaagacaaaaaggacacaaaagcgtcagagcagaaaaagaaagaaaaaagcagtgataagacggagatcaaagcggccggaacggaaggctcggcttcttcatacaacgtctccggggcagataagtataagcttgaactgattgcttctgacagcgcatggatccgcgtccgtgatgacagcggcggttctttaaaagaaggaacgctgcaaaaaggcgaaacctttaaaaaagacgtcacggatcaaaagcagattgaaatccgcacgggctatgcccctaacctgaaaattaaaatcaacggagaggttctgtcctatgaactcaatccgcatgatgtgatggcgcagaccatcacaatcaagatgaaaaaacaaaaggggaaaagtcatctgaacgattaagatgactttttcttcacgtccgagtacatattattggaggggctttatgtttaacttaccgaataaaatcacactggcaagaatcgctttaattcctgtatttatgattatcatgcttgttccttttcattggggcagcgttcatataggggatgaatcgattccggtcgcgcatcttacgggagctgttttattcattatcgcatcaacgactgactgggtggatggctactacgccagaaaactgaacctcgtgacaaacttcgggaaatttttagatccgctggctgacaaactgctggtgtccgcggcattaattacgcttgtgcaatttgaccttgcgccggcgtggatggtcatcatcatcatcagccgcgaatttgccgtaacgggattaagacttgtgctggcgggaacgggggaagttgtagccgccaatatgctggggaaaattaaaacatgggcccagatcatcgctgttgccgcgcttttgctgcataatcttccgtttgagctcgtttctttcccgttcggcgatatcgctttatgggtggccgtgctcttcacagtcatttccggctgggattattttgcgaagaactgggatgcgttaaaaacatctaactaaggaagaaggacttaaagatggaaatagcaaaaaaagcagaaatcattgcggtcggctcggagcttctgctcggccagatcgccaatacaaacgcgcagtttatcagtaaagagctggcggaaatcggtgtaaacgtgttttaccataccgctgtcggtgacaatccggagcggcttaagcaagtcatccgcattgccgaagagcgctcagatctgattattttttcaggcggcctcggaccgaccaaggacgatttaacgaaagaaaccattgcaaacacactggggcgcccgctcgttctgaatgacgaagcattccggtcgatcgaagaatatttcgtgaaaacaaaacggaccatgtcgccgaataaccgcaaacaggcgctcgttattgagggctcggacgttttggcgaatcatttcggcatggcgccgggaatgcttgcagagcacggctcaaggctttatatgctgcttcccggaccgccgagcgagctgcgtccgatgtttgaaaatgaagcgaagccgctgcttcttaaaaagctcggttctaatgagaaaattgtttcaaccgtgctgcgttttttcggaatcggtgaatcccagcttgaagctgatttagaagatatcattgacgcgcagacgaatccgacgattgcgccgcttgctgctgacggcgaggtcacgctgcgtttaacggcgaaacatgctgacgaaaaagaaacagaacggcttttaaaagaaacggaagccgccattttagaacgtgtcggtgaatttttctacggatatgatgatacgtccctggtgaaggagctttcaaaagcatgcagacaaaacaaaatcacgatttcttctgccgaaagctttacaggcggcctgttttcagagtgggtgactgatttaagcggtgcgtctcaactatttgcagggggcgttgtctgctattccgacagcgtgaaacagcatgtgctcggcgtgaaagctgagacgctcgcagaaagcggagcggtcagcaaagagtgtgcgaaagagcttgcagccggtgtgagaaagctgaccggaagcgatatcggcatcagctttaccggagttgcgggccccgatccgcaggaagggcatgcgccgggccgcgtctttatcggcatttcagcggaaggaaaagaagaggtgcacgaatttcactttgccggctcaagaaccggaatcagaaagcgcgccgctaaatacggctgccatctcattttaaaaatgctggatcaaaaataaagttttaaagagccgttttctctgatttttaagttttataagggaacttatgctcttttgcagaaaagcgaacgcggaaaaaatccgaatatgcgttcgcttttttcttggcaaatgccagtaaacaaggtatagtatatgtagtggcaagataaaggaggaaaaaataaatgagtgatcgtcaggcagccttagatatggctcttaagcaaatagaaaaacaattcggcaaaggttccatcatgaagctcggagaaaaaacggatacaagaatttcaacggtgccaagcggctcccttgcacttgataccgctctcggaataggcggatacccgcgtggacggattattgaagtatacggacctgaaagttcaggtaaaacgactgtagcgcttcacgcaatcgctgaggttcaagaaaaaggcggacaggccgcatttattgatgctgagcatgctcttgatcctgtttacgcgcaaaagctcggtgtcaatatcgaagagcttctgctttctcagccggatacgggagagcaggcgcttgagattgctgaagcgctggtgcgaagcggagctgttgatatcgtagtcgttgactctgttgcggcgcttgttccaaaagctgaaattgaaggtgacatgggtgattcacacgtcggtttacaggcgcgtcttatgtctcaggcgctccgtaagctttccggcgccatcaataaatctaaaacaatcgcaatctttattaaccagattcgtgaaaaagtcggcgttatgtttggaaatccggagacgacaccgggcggccgcgcgctgaaattctattcttccgtgcgccttgaagtgcgccgtgccgagcaattaaagcagggtaacgacgtcatggggaataaaacgagaattaaagtcgtaaaaaacaaagtcgctcctccgttccgtacggctgaagtggacattatgtacggtgaaggaatctccaaagaaggggaaatcatcgaccttggaactgaactggatatcgtgcaaaaaagcggttcgtggtattcttatgaagaagaacgcctcggtcagggccgtgaaaacgccaagcagttcttaaaagaaaataaagacatcatgctgatgattcaggaacaaatccgtgaatattacggtttagacaataacggtgtaacggacaaagcggaagaagttcaggaagagatggaattagaagaataaaaacacgatcaaaagagcggagtaagcaatttccgctcttttttttgtgtgtttcaaaaaacactggctgtttcggaaaattttatctggaatgttacaacttttttcacccttcactcgtctaacatcatggcgaaagttgaaattatatctgaggaggaaaaaagatgacgagcccccgccgcacaagaataaataaaaaaagaaagaagaagctgatgaaaacgggagggctgtttctttttctgctgcttgtcactgtttttattatgatctggaccgtcacagcgcatcatcgggagaaggaatccgttaaaaatgctcccgccgctcaatctgatacttcaaaagaccagactcaacagaaaaaagaaaagacgcaaaaagagaaaacacctaaatcaatcgatcgcaataaacagatcagcaattacttgcaacagatcgggttcagcggcacagcaatgatcgtaaaagatggaaaagttgtgctgaaaaaaggctttggctatgcggaccgaaaacaaaaaattaaaaacaatccggagacatcatattatatcggttcttcacaaaaagcgttaatcgcgacggctgtcctgcagcttgaagaaaaagggctgctgcagacgagtgaccccgtcagtacatacttgccgaattttcctaacggcacgcgcattacattgaaaaacctgctcaatcatacgtccggcataaacgggcatattgagggtcggggaccgatttctccaattgatttaatcaaggatatagaataccgcggaattaaacggcagcccggggtttgggattacagggattccaactattcagtgcttgcttatatcgtatctcaggtcagcggggagtcttatgaacaatatataaaagaacacgtgttcaaaccggccggaatgaagcatgccggattttacaaaacatttgctgaagctaaatatcctgccgtcggctacaaagtcgatgagagcggcagtcttgtaacgccgcaccttttggatttatcgcagctgtacggggcgggcgatatgtatatgagcgctgaagatctctataaatttgataaagcgatcgtaaacggcacgctcctttcaaaagaaagcttcacaaaaatgtttacagcaggaagcagtgccgcttacgggatggggttttacattgatccgggaagctattccaatcacggtgttatgcccggttacaacattttgaacagcttcagccattcggcaagcaaatatgtcatattactgtcaaacattcagaataacgccaaattaggacaggtaaacaatagaatttaccaattgcttaaccaggcggactgacagagccgtcattcacgaaaagcggatgaaggtatggtatgatatatacatgggcggcgatccgagctgaaggcgaatcgttaagctggcaagcttgacaagtatttccgacacaattacaatgaagttgtaacatttgtttttttaacatgattgttaaaccatttaaacttgacaagggcatgagagactcattccctgtgaaggttctgtatgttgagaaaatcagacaatgtacatgccggcacttatttaagcaaaaaccaagttcatagcaagaggaggtgaaagtatgaccccaatgacggttctcatctccattttgctgactctgctcggtttagttgttggctactatgttcgtaaaaccattgccgaagcaaagattgcgggcgcacgcggtgctgccgagcaaatccttgaagatgcaaagcgtgatgctgaagcactgaaaaaagaagctctgcttgaagcaaaggacgaaatccatacacttcgaatagatgctgaacaggaagttcgtgaaagacgaaatgagcttcaaaaacaagaaaaccgtttacttcaaaaagaagaaaatcttgaccgtaaacacgaaggaattgataaacgggaagcgatgttggagaagaaagatcattctctgaatgaacgacaacaacatattgaagagatggaaagcaaagtggatgagatgattcgtatgcagcagtcagaactcgaacgcatttcgagcctgacacgggatgaagcgaaacaaatcattcttgaccgggttgaaaatgagctttcacatgacatcgccatcatgacaaaagaaaccgaaaaccgtgcgaaagaagaggcagataaaaaggcgaaaaacattctgtcgcttgctttgcagcgctgtgcagcagatcatgttgccgaaacgacggtatcggtcgtcaatcttccgaatgatgagatgaaaggacgtatcatcggccgtgaagggcgtaacattcgtacgcttgaaacgcttacaggtattgacctgattattgatgacacacctgaagcagtcattctttccggatttgatccgatcagacgggagacggcaagaattgctcttgataaactcgttcaggatggccgtattcatccggcgcgcattgaagaaatggttgaaaaatcccgccgtgaggttgatgactatatccgggaaatgggtgagcagacgacgtttgaagtcggcgttcacggacttcacccggatctgatcaagatcctcggccggttgaaattccgtacaagctacgggcagaacgtactgaaacattctatggaagttgcgtttttagccggtttaatggcttccgagcttggagaagatgcaaagcttgccaagcgggccggtcttctgcatgacatcggaaaagcaattgaccatgaagtggaaggaagccacgtggaaatcggagtggagcttgcgaccaaatataaagagcatccagtcgtcattaacagtattgcgtcacaccacggagacgaagagccgacttccattatcgccgttctggtcgctgccgctgatgcactgtcagccgcaagaccgggcgcgagaagtgaaacgctcgaaaactatatccgcagacttgaaaagcttgaagaaatctccgagtcttacgaaggtgttgaaaaatcatttgcgattcaggccggccgtgaagttcgcatcatggtgaagccggactccattaatgatttagaagcccatcgtttggcgcgtgatatccgtaaacgaattgaggacgagcttgattatccgggccacattaaagtgaccgtaatcagagaaactcgagccgtagagtatgcaaaataaagtgatgcttagcgcatcactttatttttttgagtccctgaaaaggaaggaatggaatgtatgagaattttatttatcggagatgttgtcggttccccgggccgcgacatggtaaaagaatatgtcccgaaactgaaagcgaaacataaaccgcattttacaattattaacggagaaaatgcagcacacggaaaaggactgacggaaaagatctaccacagcctgatggaagcgggagcagatgctattacaatgggaaaccatacgtgggataaaagagagatcttcgactttattgatgatgtgccgcatcttgtccggccggcgaatttcccggaaggtacgccgggcaaaggcattacttatattaaatcgaatggaaaagagcttgccgtcattaatttacagggacggacgtttcttccgccgcttgatgatccgtttgctaaagcggatgaattaatagaagaagcgaaaaagcgcacaccgtacatttttattgattttcacgccgaagcgacaagcgaaaaaattgcgatcggctggtacacagacggaagagcctctgccgtggtaggcacccatacacacgtgcaaacggcagataaccgcattttgccgaagggaacggcatatattactgatgtaggcatgacgggtccgtacgacggaattctcggtatggacagagaaacggtcatcaagcggtttaaaaccaatcttcccgtccggtttacggtggcggaaggtaaaactacgctgagcggagtgctcattgacatcgacgatcaaacgaaaaaggccgtaaatatcgaacggatattaatcaatgatgaccatatgttctttgaataggtgatcatgtgtttattttataaaaatattaaaaggaaaagcaggaatatagcaacttcttagtgaatatagtagaaatggaaggtagcccgctatttttgaaaagcattgtggggatggctttttggatagcaacatctaataatgattgttctaatgaacactcacttatccattgtaaaactaagggggagcagaaatggaaatcttaaaagtttcagcaaaatcaagtccaaattcagtagcaggcgcgcttgccggcgtattgagggaacgcggagccgccgaaattcaagcaattggggcgggtgccttaaaccaggctgttaaagcggttgcgattgccagaggctttgtcgcgccaagcggcgtagatttgatttgtattccggcttttacagatatacagattgacggagaagaaagaacggcgattaagttaatcgtcgaaccccgttaaaaacaaaaacatgacattctcaacctgcttgcgtaaggcgagcaggttgtttttattgctgtcatattttctcacaatattatattaatagtacgaagagatgataaatggctttattcatataatattcaaaaaaaatcccgcccatttttccggacggaagcagttgttttcttggagtggacactggtatttacctcctttttaactcatgttacaatccagttattacagtgttttttcgaggaggagtgtacatgttgggaggaaagatgaaagctatcgtcaaaaatgaaaacgctttcggagcaactctgaaagaaattcccataccttccattaatgagaatgaagttctcattaaagtacaggccgcatctatatgcggtacagatgtgcatatttataattgggatcaatgggcgcagaaacgaatcaaaacacctcaagtattcggacatgaattcagcggtatcgtagcggaaacaggcaagcacgtcacaaatgtcaaaataggtgactacgtttcggctgaaacccacttcgtctgcggtacttgtgtcccgtgtttaacaggaaaacatcatgtgtgcacccatacaaagatactcggcgtagatacagccggctccttcgctgaatatgtcaaagtgccggcccgaaatgtttggaaaaaccccgctgatatggaccccgccgtcgcctctgttcaagagccgcttggcaacgcggtgcatacggtgctggaaagcagccggcttgcgggtggttccgctgcaattatcggctgcggaccgatcgggctgatggcggtggcggtggctaaagcggccggtgcatcccgtattgcggccattgataaaaatgattacaggctggctcttgcgaagaaattgggagctgcgatcaccatttcagctgacgaggaagatccgcttgaggtgatcgacaccttaacaggcggagaagggatcgaccttgtctgcgaaatgtcaggccacccggcagccataacacaaggattaaagatggcggccaacgggggaaggttccacatgctgagtctgccggaacgtccggtaacggttgacctgacaaatgacgtggtgtttaaaggacttaccgtccaaggcatcacaggcagaaaaatgtttgaaacatggcggcaggtatcgcacctgcttgaatccggccttgttgatctgacgccggtgatcacgcatcagtttccgcttgaagactttgaaaaagggtttgacctgatgagaaagggacagtgcggcaaagtcattttgattccataaggggagggttctatcatgaaagaatttgaatttctaaaagcagagcttgataaaatgaaagaaaataaaacgtggcagcaaatgaaacaaattgaaacgaagcagggtccgtcggtggaagtcaaagggaaaaacgtgatacagctttcatcgaacaattatctcggtttgacgtcgcatccaagacttgtcgaagcggccaaacgcgccgcggaagaattcggagcgggtacggggtccgtccgtacaattgccggaacattcacaatgcacaatgagctggagaaaaaattggcaaactttaaaaaaacagaagcggcacttgtttttcaatcggggttcacaacgaatcagggcgtcttatcaagcattcttacaaaagaagatatcgtgatctctgacgaactgaaccatgcttccattattgacgggatcaggctgacaaaagcagataaaaaggtgtaccgccatgttgatatggacgatttggaaagggtgctgaaaaaatcaatgaattaccgcatgcgcctgatcgtcaccgacggcgtattctcaatggacggcaacatcgctcctttgcctgacatcgtcaaacttgcagaggcgtacgatgcctttgtgatggtcgacgacgcgcatgcttccggcgtactcggaaaaaacggaaggggaacggttaatcacttcgggcttgacggaagagtccacatacaagtgggcacattaagcaaagccatcggagtgcttggcggttacgccgcagggtcgcaggttctgatcgattacctgcgccataaagggcgccctttcttattcagcacttctcatccgcctgcggtaacggccgcatgcatagaagccattgacgtcctgctggaagagccggagcatatggaaaagctatgggagaacacggcgtatttcaaagacaaactggttcaaatggggctgaccctcacaaaaagcgaaacaccgatcgtgccgatattaataggggaggaagaaaaagcccaggcattatcagaccttttattgacccgcggcgtgtttgcgcaaagcatcgtgtacccgacggtcgcccaaggaaaagcgagaatccgcaccattattacggcggagcatacaaaagaggagcttgaccgggccctggaagtaatccgttcagccgcaaaagagcttcagcttgtgtaagggggaaatgattccctcttttttatttcttattgattcttattctcaataaggtgtacaataataggctggcggttgtgccaaacgcttttaaccagtatacttgagggtggaagtttcggttgaaaggagacattcgaacatgaatgaaaagcaaaagcaggaaagcggacaagtgaatccggcggacaaaaaatccgaaaaggattacagcaagtattttgaagccgtatatattccgccttctttaaaagatgcgaaaaaacggggcaaagaatccgttcaatatcataacgattttaaaatctcagaagaatttaaaggcctcggtgaaggcaggaaattttatatccgcacgtacggatgccaaatgaacgagcatgatacggaagtcatggcgggtatttttatggcgctcggttatgaagcgacaaattcggttgatgacgcgaacgttattttattaaacacttgcgccatccgggaaaacgctgaaaacaaagtgttcggagagctcggccatttaaaggcgcttaaaaaaaacaacccggacttgattctcggcgtctgcggctgcatgtcacaggaagaatcagtcgtaaaccgcatccttaagaagcacccgtttgtcgatatgattttcggcacacacaacattcaccgtctgccggaactgttatcagaggcatatttatcaaaagagatggtcattgaagtgtggtcgaaggaaggggatgtcattgagaaccttccgaaagtccgcaacggaaaaattaaaggctgggtcaacattatgtacggctgtgacaagttctgcacatactgcatcgtaccgtatacccgcggaaaagaacgaagccgccgtcctgaggaaattatccaggaagtcagaagacttgcaagcgaaggctataaagaaatcacgctgctcggtcaaaacgtgaatgcgtacggaaaagattttgaggatatgacgtacggtctcggtgatttaatggacgaactgcgtaaaattgatattccgagaatccggttcacgacgagtcatccgcgtgactttgatgatcatctgatcgaagtgctagccaaaggcggcaaccttttagaccatatccatcttccggttcaatcaggaagctcagcgatgttaaaaatgatggcccgtaaatatgaccgagaacgctatctggagcttgtcggaaaaattaaagcggcgatgccgaacgcttcactgacgaccgatattattgtcggttttccgaatgaaacggatgaacaatttgaagaaaccctttcgttatatcgcgaagtggaatttgacagcgcatatacgtttatttactctcctcgtgaaggcacaccagcggcgaagatgaaagacaatgttccgatgagggtcaagaaagaacgtcttcagcgcctcaatgatttggtgaaagaaatttcagccaaaaaaatgaaggaatatgaaggcaggactgtcgaagtattagttgagggagaaagcaaaaataaccctgacattcttgccggctatacggaaaaaagcaagctcgtcaacttcaaagggccgaaagacgccatcggcaagattgtacgcgtcaaaatcgaacaggcgaaaacatggtcgcttgacggtgtgatggcaggagaagcaatcgaggtgaaataataatgacgctttactcaaagaaagacattgtacagcaggctaggaaccttgcgaaaatgatttctgaaacagaagaagttgattttttcaaacgcgctgaggcgcagattaacgaaaatgaaaaagtctctgcgattattaatcagattaaaaccctgcaaaagcaagccgttaacctgaagcactacgaaaagcttgaagcgctgaaacaagtggaaagtaaaattgacgccctgcaggaagagcttgaagggattccgatcattcaggaattcagagattcccagattgaggtcaatgaccttcttcagcttgtcgcacatacgatctcaaatcaggtgacaaacgaaatcattacatctaccggaggcaacctgctgacgggagaaaccggttcaaaagtaaaacattcgaataacagctgttctatttaaacacggggccttcatcggcccgtgtttttttgctgtttgagaactaattgtaatatgtactaaattttcatcatctcaacgttttgtcctatttttactggaaagttttatcatacttaaaagtaaagtttctgggcagggctgcatacaatgaaacagaaactttgtatttttatatttttattataaaaatgcacatgagacaaatgcccagcataagataacacgaagaagaacaaggaggcctgccggaatgtctgaatacagggaaattattacgaaagcggtagttgcgaaaggaagaaaattcacccaatgcaccaacacgatctcgcctggagaaaaaccgtcaagtatattgggcggctggattatcaaccacaagtacgatgccgaaaagatcgggaagactgtagaaattgaagggtattatgatataaacgtctggtactcttacgccgataatacaaaaacggaagttgtaaccgagagagtaaagtatgtcgatgtgattaaactcagatacagagacacaaattacttagatgacgaacacgaagtcattgccaaagtgctgcagcagccgaattgtcttgaagtcaccatttctcctaacggaaataaaatcgtggttcaggcagagagagaatttttagcagaagtggtcggtgaaacgaaagtcgtcgtcgaagtcaatcctgactgggaagaagacgatgatgatgattgggaagacgatcttgatgaagaattagaggacattaaccctgaatttttagtcggagatcctgaagaataagttgaggctaggggagtttaacaccccaagtctcttttttatatataaagatatcactcttttgtttatgttataatgggattcggataagagaagatacatagtgagggattaaatgatggctagttacacgcctatgatacagcaatacttgaagataaaggcagagcaccaagatgcctttttattttttcggcttggtgacttttatgaaatgttttttgaagatgcaaaaaaagcgtcgcaagagcttgaaattacactgacaagcagagacggaggttcggctgataaaattccgatgtgcggcgtgccgtatcattctgcggcggcttatattgaacagctgattaaaaagggctataaagtggcgatctgtgagcagacggaagatccgaaggcggctaaaggcgttgtaaaaagagaagtcgtccagctgatcaccccgggaaccgtgatggatggaaaaggcatccatgagtcggaaaacaactttatcgcttccgtttccgaatttcgtaacggatacggtctcgctttatcggacttaacgaccggagaaaacctggccgtatttattgagcggattgaagatgtcatgtcagaaatttactcagtcggcgcaaaggaaattgtcgtatcaagcaagtttaacgaacatacagctgctcagctgaaagaacggtgcagcgcaacgatttcgatcgaagacggggaaataacagaacgcattgaaatcgcaaagcacttgccgggcgaagagctgacagagacgtttatgcgtttatatacgtatttgcagaaaacgcaaaaacggagcctggatcatctgcagccggttcaagtatatgaattggaagaagcgatgaaaattgacctgtattcaaaacggaatcttgagctgacggaaacgatccgttcgaaaagcaaaaaagggtcattgctttggcttttagacgagacgaaaacagcgatgggcggccggcttctcaaacaatggattgaccgtccgctgatcagggcatcccaaatcgaagaacgccaggaaatggtcgagacgctgatcaatcatctgtttgagcgtgaagacctgcgcgagcgcctgaaggaagtatacgatttagaacgtctggcgggccgggtcgcattcggaaacgtcaacgcaagggatttaatccagctgaaagaatctttaaaacaagtgccgagcattaaagagcttatagggtctcttaaccataaaaaagcaaaagaacgcgccggcttgattgatccgtgcggagatttgcttgacctgttagaagaagcccttcatgaaaacccgccgttatcgttaaaagaaggcaacttaattaaagacggctatcatcagaagctcgatgagtaccgtgacgccagcaaaaacggtaaagactggattgccagactggagcagcaggaacgcgcttatacgggcatccgttcattaaaggtcggtttcaataaagtgttcggctattatattgaagtcacaaaagcaaaccttcatctgcttgaggacgggcggtatgagcggaagcagaccctcacaaacgccgaacggtacattacgccggaattgaaggaaaaagaagcgcttattttagaagcggaaaacaacatctgcgagctggaatatgagctttttgccggactgcgtgaaaaggtgaaacaatttattccgcgtctgcagcgtcttgccaaacaaatgagtgagctggatgcgctgcaatgctttgctacgatcagtgaaaacaggcattacacaaagcccgtcttttctgataatgaagtaaaagtcattgaagggagacaccccgtcgtcgaaaaggtgatggacagtcaagaatacgtgccgaacaactgcctgatgggcgattcgcgggaaatgctcctgattacgggtccgaatatgtcaggtaaaagcacgtacatgagacagatcgcacttctatcgatcatggcccagatcggctgttttgtacccgcaaaagaagcggttctgccgatttttgatcaaatcttcacgagaatcggggcagcggatgatttgatttccggacaaagcacctttatggtggaaatgctggaagcgaaaaacgcgattgtgaacgccacaaaagacagcctgatcctgtttgatgaaatcggccgcgggacatcaacgtacgacggaatggcgctggcacaggcgattattgaatatgttcatgatcatatcggcgctaaaacactgttcagcacgcattatcatgagctgacggtgcttgaagataagcttcctcagctgaaaaacgttcatgtgcgcgcagaggaatataacggaacggtcgtgtttctccatcaaatcaaagagggagccgcagataaaagttacggcattcatgtcgcccagcttgcggagcttccggacgatctgatcagccgggcgcaggagattttgaaacagcttgagcagacgggagataaaccggagcttccggcggcacctgagaaaaagcccgccgtcaaagaagaaccggcacagctgtccttttttgctgacggtgaaaaagaacagaagacaccggctgtttctaataaagaaaaacaagtgcttgaagcttttaagtcaatcaatattctcgatatgacgccgcttgaggcgatgaatgaaatgtacaagctgcaaaaaaaattaaaatagaaagaggtgacggacttggcaaaagtcatccagctgtcagatgaactctcaaataaaattgcggccggtgaggtggtcgaacggcctgcatctgtcgttaaagaattggtggaaaacgccatcgacgcaaacagcacagtcattgaaatcgacatagaggaagcggggctttcgtcgattcgggtgctcgataacggcgaaggtatggaaaccgatgattgcaagcgggctttccgccgccacgcgaccagcaaaatcaaagatgaaaacgacctgttccgggtgagaacactcggtttccgcggagaagctttgccaagtatcgcgtctgtttctcatctggaaatcaaaacgagcatcggcgagggagcgggaacccatctcattcttcagggcgggaatatcatttctgaacagaaatcctccagcagaaaaggaacggagattatcgttaccaacctgtttttcaatacacccgccagattgaaatatatgaaaaccgtgcatacggagctcggcaatattacggatgtcgtcaaccggattgctcttgcgcatccggaagtatcgatccgtctccgccatcaggggaaaaatctgctgcagacaaacggtaacggggacgtgcgccatgtgctggccgcaatttacgggacggcggttgcgaaaaaaatgataccgctccatgtcagctcgcttgattttgaagtcaagggctacattgcacttccggaaatcacgcgtgcatccagaaactacatgtcatctgtcattaacggaagatacattaagaatttcccgcttgtaaaagcggtgcatgagggctatcacacacttctgccgatcggccgccatccgattacgtttatcgaaattacgatggacccgattttggtcgatgtcaatgtccatccgtcgaagcttgaagtccgcctcagcaaagagacggagctgcatgagctgatccgtgacgggataaaggaagtgtttcaaaagcaacggcttattccgagcgcccagctaccgaaaaaatcagcgccggcaccggccaaaaacgaacagcaatttatgacattcgaggaaagcgcgcctgagcggaaacttcctgaaaaaacgcctgagccgtcttactcaccgatgaagctgagttcggtcgtaaaagagcctgagccggtcatagaagaagagtccctgaccgatgaagcaggtcacggagtgccgccgaagatcggcatgccggtaacggaagcgcctgtttccgatattccggagcctgaagtggaggctgactctgaagaaatacgggaagaaagagttccggtgatgtatccgatcggccaaatgcacgggacatatattttagcccaaaacgaaaacggcttgtatatcattgaccagcatgcggcgcaagaacggattaaatacgaatatttccgggagaaagtcgggcaggtcgagcctgaagtacaggatatgatcgtgccgctcacctttcattatgcggcaaatgaagcgctgatcattgaccagcatcagcatgagcttgaaagcgtcggagtatttttagaagcattcggcacgaacagctacatcgtccgctgccatccggcctggtttccaaaaggggaagaagctgaactgattgaagaaatcattcagcaggtgcttgacgccaaacagatcgatattaaaaaactgcgggaggaagcggccattatgatgagctgcaaaggctcaatcaaagcgaaccgccatttgcgcaacgacgaaatcaaagcgctcttggacgacctgcgccgaacgacagacccgttcacatgcccgcacggccggccaatcattatccaccacagtacgtatgagatggagaagatgtttaagcgtgtgatgtagcagggttctgggtgggatgcacccctcgtgcccacattttgcccactgattttagctgtttaggtatttatcaaaacgttaatgctgtatatcttttcaaaagccgcgaagggatcaacaagcccatttcccggtcgatggcttataagattctaagggctgccgctgagtatgtcggtttggacgatataggcacacacgctgaggaaaacattcgggtaccatttttacaagcaaacaaaagatgttgccatgctgcaggcgattttcaatcactcggaccagcggacaacccttcgatacattggaatcaatcaggatgccatgaacaacgccatgaagaaattcaagatataaacaggctcatctcataaactagatgagtcttttttctgcatatttttattgattcccttcaaaaagcaaacgtggaattcattttagggatatcgcttgaaaacaagggtggcaagggctgacggaactcggcagttgcacagtctataacatatgggtaatccgtggattttgtggataaatggaaaatttgggcgtttttcgtgatattattgtgttacagaaggtgagcggcatgaatagaggcgcaacaggttcagcgttagaagagaaaggcatggtttgatagaacgataccaagtaatgaaggggtgagcgggatgactgcagcagagcaaaaaggaatgtactaaaaagattttggcagaaagttggcacgataacggcacaccattttgttttagataaggtattatggtagtaggtaataaatcaagggagcggcactgctgatgagcggggtcgctttttgttgaggagggataataatgagcagcattggaacaccgtcaaaaggtttcgaaaacttcgacgtaacttgcaagggctgcggatcaaagaaccgacactgggttcgaaaattggatcgtatgtcgaatttacctactacgaagacatctgataacgattaaaatacggaggtgttctcgttgttgtatatacaaactaaagaaatgccgaagaatgaaaaagatttctctgcggaaaaaattcgatgtgatacggatgaataaacaggagggggagtagttaacaagctgctccccagttcaactataaacaaatttctataaaatcttcacatagaggtgttttggtacagattccttttttaaaatcaagcttagtaaactctggatcaacatctcttatttcaatcaatctctggttagcttcttcaagcacaggatgagaagaaatataatcatagtattctggattcccggatcgtactgaataatcaacagctaataaacctactctttggagattagatattgatgaagcttgagctttataatcaacttgatctttaaaattcaaaatatgttgttgaataacaacataagtacctgcatcatttttagacgcgtcaactcttattgctggaagttgttgaaattgtttaaagtttatcaagatggctgcatctaatggcgataactgtttgattatctctacaaatgaaggatgaactttggaaaattttctactatctatagtagaagaaataaggttggcaaacatttctcgtagttgttctgaatcaatatagaactttgaagcttctatagcaggtcctactatattgagttctggttctttaagaaactcctcaggaataacttgagttttattttgcaccttataaacatagtcctcaaaattttgcttatggcgaaattcttgtttcctagaccatagtgacacgtgattgccaattcctaatttccataaatccgttaatgtgtcacctactgcctgcgctggtttgccggcagcattatcaataaactttggtagaatacccattttttaatccccccttatactagtataggaggaaagtctcgtggaaacaatatacaatcatccttttctaacatcatggtttatttttcttgcaggattttggctgacagtagctttagggcaagtcataaagaatagcattcttcagggtgttttttatgttctctgtaaactgcgtccggtaaatctcaggttagactattagcggttaacggcggcttgagcgcgagggcagtttagaaagaatatatcaagcgctttccaatcgggagggcgctttttctattggagggattaaccatgtctgaagacaatttatatgttgatcaatttaaagcgtggtgcactgagcaagagcttcttttaaaacagattaattatgacattgaaatcagtaaaaggaaaatcgaattgaacgagaaacaaaagcagttgcatctggaacgcgtgaatataggaattcaggaattcaataattgggcaaaaacttctaatcgtgacgaaagactggagttactgaaggaagatcaaacagatgctactgaaacacttttttgtgatggtcaggaattcgcaactatacatggaaagaatatgaaggaggatgaacagacttgaaaattccagttgttaaaacggatgtacctcttgatagaagagcaaaagaaaaaatgcgcatggaaattgaaaaggcaattaaaacaggcatcgtaattcttgatggagggttagaccttgcaataattgaagttgaagactccaatattgttaatgaaacgtttatagaagcgaagactttttctcctgctaaaggcgagacagaagctgttgaatatattggtgggccgataattggcagttgtgtctcggaaggagtgctaaatcacaaagaaccagaacctttaaagacatcgaaagcaacgcctttgctacagattgagcttgatgacattacttccgttccgcgtgttttatataaaggcgaagaaataaagaataaagtccgtgtagatttctcttatcttactggggatgagtatgggatcaaaccgatttatattgacattgttgctcatagagaagatggatcagtaagaccaattagccataacctaggtgcaataagcataaatgaaaaaaggctcaagtgatgttttctttctattaaatctttgaggaggaataacaatgaatataaaggttacaaaggataaggcatcatgcctcttaaacctctaaggatatgcgctgcccgcgggtgttccagcctcacccgtgaccggtactgtgatacacacaagacacaacgacaagaagaaacgaaacattacaacaaacattcaagaaacaaaacaataacaagtttttataaatcaactgaatggaaacgaacaagacaacttgctttgatacgagacaattatctctgtcagcattgtttgaaagatcattgcttcactccggctgacatggtgcatcatattgtggaagtaaagcaagattggtcgaaacgattggacataaagaaccttgaaagcttgtgtaacgcctgtcacaacaaggctcacggcagtaagggcaagtgaccctctccccctaacaaatctctggaagggaaacgaacggagaacggcgatcccccttctgcaaacaaacaccgcttttcaaagttccgaaaacagcagaaagccccctcagcaaatttgccgagagggcttggtacgactggttttgttgttaatttcatcgtaacacgattggcgaaaaaaacaagcgaaaaatgcaacttttttgacatgaaatgaggtgagtacatgccgaggcctgcaaaatccgcgacgcttcaattgatacaaggcaacccaaataaaaagaatacggaagagttggcagcccggactgagcacgagaaaaagacaaaaggcgatccgataatataaaaccgccaacgtggttggataaagtcgaaaaaaaaggaattcaaacgagttgctgctttatgcgatataaacattgtttatggacagcatttggtttgacagctcagaatgccgtgtttggtgtgatcgtctatatcgtcaattaatagtgaaataatgaagaaacccattcctgaaaatctgaatgttactcgtgaaaaatctcttaaagggctacatgattatcatgagtacctgcttttacaaattcacagggagatgggggaagaatttaaatcagaatggaatttggtgagctgacaatctaaaagagtcaaaggggactagtaattagcccccttacatttagttcttcctgcggttttttctatttttgatcaaactgaaaaccactaagagaactacaccgacagcaacaatataaaatgaaatttccgctgcggcggtgttaatattcttaaggacaaggataagccctattaaaattataggaatgatgtaagttagaattcttatagcttttgggctcggttcagcgtttcttttattttccataattacctcccgtctaaagtttaacacaggttaaatttgataatcaccaacaatagtcccgtttaaagaggaaacataagagtttaagtaatccatcaagcggcgtacgtgccgtttggtccagaagatgctttactctagcataaaagattactcaggggagaatgctccggcgttctaagttttggactgtattctggcaaaagaaagtgaagaaacaacatcttgtgtgtgaattacgtcgtatctttctaattcgaattgtgtgttaatgccaactcataaacataacattgaaattcggtgtaaggagctaatgtattctgatatattttgaggaagccgccgtaggggtttagtttagcttgaagaaaaggattgaaatataccatccttcattttctgaataaaattacctgaagaattcatctaaatgaacatcctgatttcctgatatatcagcatagcaatttgtaaaaaaggcccagactggtgcttttggcgggagcagaaagttttttaaactttaccggaaaatccatggaaaaacgtggtgccatctggtaaagtggttacagtcggctgggcggcggcagcagtctgcccggatcttttaaatgggaatggtgacaatggatcatacatatgaagtgcatcaaatcaaaacttatcaccagatgtggtccaactattgttatattatcgcagaccgctcaaaaaaatctgcgatagcggtggatccgtcctgggaaatcgataaaataaccgataaactgcatgaattggatgttgatttatcagctattttattaacacattcgcattatgaccatgtaaacttggcggagccgcttcagcaaatctatcattctgatatatacatgtcgtcggcggaaatcgatttctatcaattccggtgcagaaacttaatagcgcttgaagacggccaaacctttgcggccggagggtttatcatcagaagtatactgaccccgggacatacggccgggggaatgtgctatttgctatctgatcacctttttaccggtgacaccgtgtttacagaggggtgcggtatatgtgaggacaggggcagctcagctgaagatatgtttcacagtatacagaggatcaaagcctctattccgccgcatgtgcgtgtgtatccggggcactccttcggggagaagccgggtcaaaaaatggagagtcttttgaaaaacaatatttactttcagattgaaaaaaaagaacatttcgtgaatttccgcaacagaaaaaatcaaaaagggctgtttcattttaagtagcgtataatttggttctatctaactagtttttcttttggggcacggaacttctgaaatgaaatgatagttattgctcgcttttgggtgatgaatggctgagtaacggtagtttgcggataaaagcgccgggcaggccgaatgggacattctgcttacgtctgttccaaaagccctgagtccgccttccgtcagggaaaaataggcattattcaggattccgcataggataaattaacttgacatggtatttttgtgaagttactatcaacttgaacatgcttcttaactgaatccgagaaaggatggctgagaaaatgatcacatacttattccccggacaaggttctcaaaagcagggaatggggagctcattgtttgatgaatttaaagacttaacggagcaggctgatgaaacactcggatattccatgaaacggctttgtcttgagaatccgtattccaaccttcacaagacgcagttcacccagcctgctttatatgttgtaaacgcgttaagctatttgaaaaaaatccaagataatgacataaagccggattatgtggccggccacagtttgggagaatataatgcgctgtttgcagcaggtgcttttgattttattaccggcctgcagcttgtccgtaaaagaggcgaattaatgagtatggccactgacggaaaaatggccgccgttatggggttaactgcagctcaagtgtcagacgcccttcaaacgaacggattacatacgattgatattgccaatatgaattctcctcaccaagttgtcatatccggacgcaaagaagacattgaaagagccaaaagcgtattcgaaggattaaaagacgttacgatgtttcatccgttaaacgtcagcggcgcttttcactcgagatatatgagcgaagcaaaacaagagttcgaaaaatttttacagtcatttcatttttctgctatatcaattcctgtcatttctaatgtgcatgccagaccttatgagcaagacggaatccactccgttctggccgatcagatcgaccactcagtgcgatggaacgacagcatccgctatctgctggacaaagggcggatggaatttgaagaagtcggcccgggccatgtgctgacaggacttattcaccgcatcaaaaaagaaactgaagcttcacccgccatgtagcggaacgcaagtcaaaattcttatctcacacaatagtgccagccatacaacatcacgaccacttcacctgcacacgacatcacgaaaaacgtacaaatcaatattttaaaaaaataaagagcaaaaaggagaacaaatgaaccagccaattgttttcatgttttctggacagggttcccaatactatcaaatggggaaagagctgtttgcacataacgccgcttttcggcagaaaatgcttgacttggacgattttgcagtcagccgtttcggttactctgtcctgaaagaggtttatcatacaggcaatcgtctgtctgatccatttgaccgccttcttttcagccatcctgccatttttatggctgagtacgcacttgcatatgctttggagcaaagaggcatacgtcccgattatgtgatcggagcaagcctcggagagtatgcagcagccgctgtatcgggtgtgctgagcgccgaggatgctttagattgcgtgctggaacaggcccgaatcattacggaaacttgccgtaacggcagcatgcttgcgatactgggtgatccggctttatatcaagatgatccgctgctcggcgaacatagtgaattggcatctgtaaactatcattctcactttgtcatctcgggagagcgggaacatatcaaaaagatcatggacgatctgagagagaagcagattcctcatcagctattgccggtatcttacgggtttcactcagcgctggttgatcaggcggaacagccgtacaagcgttttttagctcagaaatcaatccggactccgtttataccgtacatctccagtgcgaccggagaggctgagaccgatatacaagcggactttttctgggatattgtaagaaagccgattcgattccgtgaagcgcttcaattcgcagacagccgccaaaaaggattgtatatcgatgccgggccttccggaacgttggccgcatttgccaaacagattcttcccgcaggatcggctgaacgcatccgtgccattatgacgccgtttcataaagaacaaacccatttgcagcaaatagaagacagcattttatcaccgcccggaaggagactgtaagatgatcagctttgtttttccaggccaaggctcgcaaaaaatagggatgggagaggacctgttcggccgctatcctgaattaactgcaaaggccgatcatattctcggatattctattcaggagctgtgccgggacggagaacgtctcaatcagactcaattcactcagccggcgctctatgtcgtcaatgccctcagttatttgaaaaaaacagaagaaaccggcttgaaaccggattttaccgccggacacagtttaggcgaatataacgcgttatacgcctcgggcgcctttgattttgaagaaggcttacagctggtcagaaaaaggggcgaactgatgagccgcgccaaaggaggcggcatggcagcggtgatcggcctgactcatgagcaggtgacggacgttttaaaagagtatcacttgcatatggttgatatcgccaacatgaacacaccgcagcaaattgtcatttccggatataaagaagatattgaaaaagccgcatccgtttttgaagccgtaaacggcgtaaaaatggttcaccgcttaaatgtcagcggcgcctttcattccagatatatgatggaagcgaaggaggaattttcacggtttattgaaactttccattttaagccgctgtccatcccggtcatttcaaatgtgacggcaagaccatatgagcagaccgagctgaaagagacactcaccggacaaataacgggatcggtgaactggacagacagtatccgtttcttaatgggaagaaagaacatgagttttgaggaaatcggtcccggaaaagtgctgacagggctgattcaaagaattacggctgaagcggagccgataacagatgaaatcaaagtcccggctgaggctggaaaaagctcaattacggcggcgtctttaggaaatgaagagtttaagcgcgattatcaattgaaatacgcctacttggccggcggcatgtaccgcggaatttcttcgaaggaaatggtcgtcaaactggccgaaaaaggaatgatgggctttttcggaacgggcggtttgaacatcgcgcacgttgaggacgccattttgtcaattcagcatgagcttcgtgacggcggttccttcggtattaatgttgtacataacatgaagcatacagattcagaagaaaaaatgattgatcttttactgaagcatgggattcagaacttggaagcatcagcatttttaacggttactcccgctttagtaaggtttcgcgctaaggggttaaaacgcggtgccggcggacaagtaatagcgcgtcagcggattatcgccaagctgtcccgtccggaagtagcggaagcgtttctcagcccggcccctgatcacattctgcagaaacttgcagccgaaaacaaaattaccgctgaagaagcaagtctgatgagagaaatacccgttgcgcatgacatctgcgtagaggctgattcaggcggccacactgacggcggagttgcttacagtctcatgccggcgatcatccgtttacgagatgacatgatgaaaaaataccgatacggcaaaaccgtccgcatcggagccgcagggggaatcggaacgcctgaggctgctatggccgcatttatgctcggcgctgattttattgtgaccggatccattaaccaatgcaccgttgaagcagcgacgagcggcctcgtaaaggatctcctgcagcagatgaatgtacaggacacggcctacgcgccggccggcgatatgtttgaatcaggcagcaaggtgcaggtattaaagaaagggctgttctttccgacccgggcctctaagctgcatgaactgtatcagcgtcaccgctcaattgaagaaattgatgaaaagacactcagacaaatagaagagaagtattttaaggcaagtgtaagcagtatttatgacaaagtgaaggctcattattcgaatgaagacatttcaaaagccgaacggaatccgaaacagaaaatggcgctcatattcaaatggtatttcaggcaaagctctgcttcggcgattaaaggagacccggaagccaaggtagacttccagattcattgcggcccggcattaggcgcctttaatcaatgggtgaaaggtacggagctggagtcctggaaaaaccgccatgccgatggtatcggccttcgtcttatggaagagacggcctcgcttttgaatcagaagttaggctcatttctgcaaacgtgttgacaagacgaaatgatagattgaaaacatggaatattcataaaagatgaaacagggaggaactgacaatgagtgaagaaagaatctttgaattgctgcagaacacaatctacgaggttttgcctgatttagaaggcgaacagctttcacaggaagaccggttagttgatctgggggcggactcagtggaccgcgccgaaattatcacgatgatgcttgaagaattatcactgcagatcccgcgtgttgagctgacgggagtgtcaaacatcggcgaattggcggcaaagctttatgaaaaggtacaggctgtctgataaaacggtgaaaaatcggaaactcaaaattcatattggaggcgaagttcatggcggctgccggaatagaagcgataaatgtgtttggcgggacggcataccttgatgtcatgcagctggcggagtacagaaacttagaccctgccagatttgagaatttactgatgaaagaaaaagcggtggcgcttccgtacgaagaccccgtcacattcggcgttaacgcggcaaagccgattatcgaccgattgacagaggctgaaaaagacagaatcgagctgctgattacctgctcggagtccggtattgacttcggaaaatcactcagtacatatattcatgattacttaggcctcaaccggaactgccgtttatttgaactgaagcaggcctgttattcaggaacggcgggtttgcagatggcgcttaactttattttgtcgcagacatcccccggagcgaaggcgcttgtcgtcgcaacggatatttcccggtttttaattgccgaaggcggcgatgcgttaagcgaggattggtcttacgccgaaccgagcgccggagcgggtgccgtcgccttattgatcggtgaaaatccaattgtatttcaggcggatgcgggcgccaacggctattacggctatgaggtgatggatacatgccgtccgatcccggacagtgaagccggtgacgccgacttgtcattgatgtcatacctcgattgctgtgaacagacatttcgcgagtacaaaaaccgtgtgccgggcgctgactacaaagagacgtttcactatctagccttccatacaccgtttggcggcatggtcaaaggggcccaccggacgatgatgcgcaagcttgcaaaagcgaaaaacgctgagatcgaacaggattttcaaaccagggtagagccggggctccgctactgccaaagagtcggaaacattatgggggcagcctctttactggctcttgcaagcacgattgaccaaggggcattcgacacttctaagcggatcggctgtttctcgtacggctccggatgctgttcagaattttacagcggcgttgtgacgcctgaaggacaaacgcggcagcattctttcaaaatagaagagcatctgaacaacagatacaggctgtccatggaagagtatgaagaactgtttaaaggcagcggtttggtgaagttcggaacccggaatgtcaaattggatatgaatatgattccgaacattttagaccatcatgccgggagccctcgtttatatttggaagaaatcacggaatttcatcggaaatacaggtggatcccgtgacctatgagacgatcaacgtccgttttcagcaaaatgtctgcttcatcacctttgatcggcctgaagccaacaatacgattaatgagcgtttagtggaggaatgcctgcacgttctttctgaatgtgaggactccgtgacctccgtagtgcttgaagggcagccggaggtattttgtttcggggcggattttgatgagatgtaccgaaaaatgaggcagggaatgcagcatgcggaatcgcaggagccgctttaccgtttgtggctggcattaaaatccgggccgtacatcacaatcgcccgcgtccgcggaaaagtaaatgcgggaggtgtcggttttgccgccgcgtgcgatatcgtcattgcagaggagagtgcttcgttcagtttatctgaactgttattcggactttatccagcctgcgttctgccgtttttaattcaaagaatcggatttcaaaaggcgcattatatgacgattatgacaaagcccgtgccggcgcgccaggcgcttgaatggggactttgtgacgtatgcgtcccggactcagcaacagagctgagaaagcatttgctgcgtcttcgcccgctgtcgaaaaaagcagtcatccgctataaaaaatacatggattccttaaacgaccttgttcatcgttcaaaatccattgctctagccgaaaatcaagcgatgttttcagatccggataaccaatcagccattttccgttatgcagaaacggggcggcttccttgggaaacggagaacagttaggaggatatcatgccgaacgccgcagttgaactgctcgaaattgaaccggatattatccaagtgacaatgcaggataaagcccataaaaacgctttctccaaagaactgacggatggattgatggaagcattcacccgtataaaaaaatcgtcagtctataaagctgtgattttaacaggatacggccattactttgcttccggaggcacacaggaaggtctgctcaggattcagcagggcatcacgaagtttacggaagaccgcatgtattctttggcgctggaatgtgatatccccgttatttcagccatgcagggccacggaatcggaggcgggtttgtcatggggcttttcagtgattttgtcattttaagcaaagaaagcgtgtataccgcaaactttatgaaatacggtttcacccccggaatgggggctacctttatcgttccggagaagcttggggcaagcctcggccatgaaatgctgttaaacggcggccactaccgcggcggtgacctggagaaaagaggagtgccttttccggtgcttccgcggcaggaagtattagactatgcgcaggaattggctcgtgagcttgcggaaaaaccgagaaactctttaattacattgaaaaggcacttggtgacgccgttccgcgagcagcttccggctgtcattgagaaggagttaatcatgcacgatgagacgtttcatgatgatgaagtgaaaaaacgaatcacgacgatgtacggagtataagacatacatcttacatacagatgaaatggaggcagctctatgaaaagtgatatgaaggcaagcgggttactcaagccatctgtcagctacggaaaaccattgcggctttcagcggatcagccgatgacgattcctgaagtcctgcacaaaaccgccgcgacagcgggagatcaaaagggcatcacatatatacagcctgacggcactaaagtgtaccagacttacagcggcctgaaaaagatcgctctttcgattgtgaaagggctccgccaatcaggagtgaaggctcaggatgaagtcatattacagctcagtgacaattcccagctgattcctgcgttttggggctgtgtttttttaggagcgatcccggttccgcttgcggccgctccggcttatacagaaatgaacagcgggacgcaaaaactgaaagacgcctggacgcttttgaatcagccgtatgtcatcacaagccgtgaagtgctgccggagatgactgaatgggcggaggagcaggagctttccgggttttgcgctttggcggcagaagatctcagtgcgcatgaaatggatacggactggcatcatccccgtccggaagatttggcgatgctgcttttgacctcgggaagcacgggcacgccgaaagccgtgatgctcagccatgaaaacatcgtctgcatggtcaaaggaaatattcagatgcagggctatacaagtgaggatgtcacgtttaactggatgccttttgaccatgtcggcggcatcggaatgcttcatctgcgtgatgtttatctcggatgtgaggaaatcaacataccgagcgaatccattttgatggatcctttaaaatggctcgacctgattgatcattaccgcgcttcggtcacgtgggccccaattttgcctttgggctgcttgccgatttcgcagaagagattcaaacacggaaatgggacttatcttccatgcgttacatgctgaacggcggggaggccgcggttgcgaaagtcggacgcagaattatggagcttttagagccgcacggtctgccggctaatgccatccgtcccgcatggggaatgtccgaaacgtcttcgggcgttattttctcagatgagtttacactggaaaacacgagtgacgacgatcgtttcgtcgagatcggtctgccgatcccggggtttaatatgagaattacggatgaccgcaatcaagtggtggaagaaggagaaatcggccgcttccaagtgtccggtctgactgtaacgagcggatattatgagcgcccggacttaaacgagagtgtctttacagaagacggctggtttgaaacgggagatctcggatttctgcgtgaaggccgcctgacgataacggggcgcacgaaagatgccatcattatcaacggtgtgaattattacagccacgccattgaatcagcggttgaggaattgccggaaattgaaacgtcatatacagcggcatgcgccgtccggccgaatcaaagcacgacagatgagctggcgattttctttgtgacatccattccgttggatgagaaccgcatgacgaagcttcttcatcacattcaccagcacgtgacacagagaatcggcgttacccctgattatctgcttccggtcgcaaaagaagacattcctaagacggcaatcgggaaaatccagcgcactcagctgaaacattcatttgaacaagggcaatttgattcattacataataacagacaagaaggcggcaattcagacacggcttctgcagagaaagaaattgaacgggattttatccgttttctgaaagaggaactttccatcgcggatgagcttgttgatccaaatacaccgtttcaaagtcttggcgtcaactccatcaagatgatgaaactcgccagatcaattgaaaaaacgtatcacatccggctgacggcaagagagctgcacaaaaacccgacgattggcgctttagcggcttatactgctgaaaaagcggcaaacatgtcagcggagcatcattcccaaaaagccgaaccgccggcagaacgggagagacggcaaacggcgccggcgctttcagaagtccaaaaagggctgtggacattgcagaaaatgtcgcctgaaacgactgcataccatgtcccgctctgtttccgattcacaaccggaatcgacaaagagaaactgaaacgggcgtttcagctcgtattaaagcagcatccgatgctcaaaagcgccgtgaatgaaacagacggcgggttttatttcatagaagcggcagatccttttgtattcttggaagaagatatttctgacgtcaatgaatcacaaatatccgctctgatacggaaaaaagtgaaagagccgtttgtcaaagaaggcgggcctttgctgcgtgtgcagctgctttcaaaatccgcctcggaacattatcttttgacggtcattcaccacatcgtgtttgacggtatttcatccattacatttattcacagtctgctggatcattatcaggcgctggtggagggaaaagaagagtttgcggccgccgctcccggcattcattccgatttcgcggcttgggaaaagcggtatttagcgggtgaagaaagcaaagctgcccgcgcttactggatgaaacagctcgggggcgatctgcctgaccttcagcttccgccgatgcgcgcggacagcagcgttccggagtttacagaagatacgctgacacgccgtcttcccgaacggctgctgaataatctaacggcgtttgccgcatcccgttcgattcatttgtctaccgttatgctgagctgctatatggtgcttttaagcaaatatacagataaggaagatattgtgacaggcatgcctgcaatggtcagacctgaagaacgctttgacggagtggtcggccatttcctcaacatgcttcctatacggagcagagccggacgaaaagaaacatttgctgactttgttcaaaaggtgcaggatgccgttctggacggactggatcactccttttatccgtttccgaaaatggtgcatgatgtgcatgcgaaaccccggcagaacggttcgcctgttttcagcaatgcctttttctatcagaactttctgcagcattcaagttatcaatcgatgctggatgaatacaaggaattctcctgtgagtttgtaaaagacattcatcaggagggggaatatgatcttgtatttgaaatgtgggaagaagcatcaggcatggatcttacgattaaatacagcaccgaattattcgacgaagcaggggcggccagacttttcagccaatttgtacaggccgccgaagctttgacggcgaatccggatatgccgcttgagaacgtttctctcatgacaaaaagagaggagcacatgattcttaagacttggaatgagacaagccgtgaatatccggatgcctgcttccatgaattatttgaacgtcaggcggcagaaacgccggacgcttgtgcggtcgtgtatgaacagcaaaagctgacgtaccgtgagcttgatgaaaaaagcacgaagctggcgctctatttgcaggcgcacggtgcaggccctgatgatctcatcggcatttatacagaccgttcattgcatatggctgtcggccttctcggcattttaaaagccgggggagcgtatgtgccgcttgatccttcttatcccgctgacagattggaatatatgatcgccgacagcaggatttcaatgtgtctgacgacagctgatttagagcactccttgaactggggaggcgtgcagacaactgccattgaccgcgattggtcttgtattgaaagcacagccgcggaaagaacgtcgctgaagcggttagtgacacctgacgatctggcgtatgtcatttacacgtcgggcagcacgggcaaaccgaaaggcgtgatgattccgcaccgggccctgaccaatttcttaatctcgatggcatatgaaccggggctttcgtctaaagacaaactgcttgccgtcacgacatattgctttgatatcgcggcactggagctgtaccttcctttaatcaaaggagcggagtgcaacatctgtaagacagaagtcacaaaagacgcacggaagctgaaagagctgattcaagagtacaaaccgacgatcatgcaggcgacgccgtttacgtggaaaatgctctttcattccggatggtcaaatgaagaaaaagtgaaaatcctttgcggcggagaggcgctcagcgaacaattgaagcagcagtttctcgatacgaaaagtgaggcttggaatatgttcgggccgacagagacgacaatctggtccgcggtgcagcgtataacggaaaatgagagcgcgcttacgatcgggcgcccgatcgccaatacccgtgtgtatattatggattccggtctcaaccctgttttagaaggggtgccgggagaactttgtattgcgggagacggattggcaagagggtatttcaacaagcctgagctgacagataaagttttcgtcagccaccggctcgaactgggatcaaagctttataaaacaggcgatatggcgcgttttcttcccggcggccgcattgaatacatgggacggatggacacccaagtcaaaatccgcggctaccggattgaacccggagatattgagagccggctgaatgcctatccggccgtacaggaaagcgtagtggttgtgaacaatcactccggaaatgaaaagctttgcgcattttatatcctgaaaaacggagagccgcttccgtctgcaaaggaattgcgcaatcatttgaaacaagcgctgccggcctatatgacgccagcttcgtttatccgtcttgaagagctgccgctcacaccgaacggaaaagttgaccgcaagcttcttgctgcccgtgatctgacggaaaagcagccggacacacaaacattttcatcatctcatatccagcaggcggtgctggcgatttggcaggatgtattgaaaagcaaagatatagagcttgatgaccgcttttttgatgcggggggagattcgcttcttgccgtgactgtcactgaccggatgacgcaggaactggattgtgaattcagtgtaacggagctgtttgaatacgcgacggtaaaagacatcagccggtacatcacagaacaaaaaccgaaagaagccgttttggctcctgtgccgcaaaagaaagtgaatacagaagaccgggaacacccagcgggagaaattcccgattattatgaggacagtgtcgcggttatcggtatatcctgtgagtttccgggagcgaaagatcattatgaattttggaataacatcaaagaaggcaaagaaagcatcaccttcttttcaaaagaggagctccgccgatccggtgtttctgaagaactggctgatcatcccggcttcgttccggctaaatcagttttagaggggaaagaaatgtttgatcccggtttcttcggcttttcgccgaaagatgcggaatatatggaccctcagctgagaatgcttttgctccattcatggaaggcaatcgaggatgcgggatatatctcaaaagaaattccggaaacaagcgtgtatatgtctgccagcgcgaactcttaccgcagcctgctgccggaggagacgacagcacagctggaaacgccggatggctacgtgtcatgggtgcttgcccaaagcggtacgattccgacgatgatttctcataaactcgggttgaaagggccgagctattttgtccatgccaactgctcatcttcgttaatcggcatgcattcggcttttcaaagcctgcagtccggcgaagccaagtatgcccttgtcggcggtgcgacccttcatacggaatcaagtgccggctatgttcatcagccggggctgaatttttcaagcgacgggcatattaaagcgtttgacgcggctgctgacggaatgattggcggtgaaggagccggcgccgtgctcttgaaaaaagcgtcggatgccgttaaggacggcgaccatatttatgcgctgctgcgcggaatcggcgtcaataacgacggagcggataaggtcggattttatgcgccgagcgtcaaaggacaggctgaggtcattcagaaggtcattgatcagacgggcatccatcctgaaacgatcgcgtacgtcgaagctcacggcacaggaacaaaactcggcgacccgatcgaactgtccgcacttcaatcggtgtacggccgatatacagataaaaaacaatactgcggcatcggttcagtcaaaacaaatctcgggcatttggatacagcggccggaatggcgggctgtatcaaggttgtcatgagcttatatcatcaggaaatcgcgccgagcatcaattacaaagagccgaacccgaatcttcatttagaagactctccgttttacgtagcgggagaaaagaaagagttaacccgtgagaacagagcgcaccgcatggctttaagctctttcggtcttggcggaacaaacacacacgcgatttttgaacaatatccggatgcatccgaagcagcagacgctgccggtccgttcatcattccgttgtctgccagaaaaaaagatcgtctgaaggagtacgcaaaacagctgctggcttttctggaaagaaaaacggccgccggcctcgctgatcttgcctacacgttccaagtcggaagggaagcgatggaagagcgcgcggcctttatcacaagcggcactgcggagctcaagcggcagcttgccgattttatcaatgataagccggctgtaacaggctgcttcagaggagaaaaacagcaggcgaaagatattgcctggctttctgatgatgatgacagtgctgaactcattgagaaatggcttgcgaaaggaaaagcaacgaagctctgtgaaatgtggagtaaaggtgtcgccatcaattggcacaagctttacaaagacaagcatccgaaacggatcagcgtgccggtctacccgtttgcaaaggagccgtactggccgaaaaaagcagaaaagaaaacatctgccgcatacaccggagtctcagttttacacccgctcgtgcagcaaaacacgtcagatttggccgttcagcggttcagctcacggtttacaggctcagaatttttcctgaaggatcatgtggtcagggaaaaagcggtactgccgggagcggcatatttggaaatgtcttatgaagcggtaaaacgggcgcttggcggcttattaaaagaccaagacagaataacgctccatcataccgtctggatgaaaccgatcgtcgttcacgaacaagagcgccaagtccatattgcgctgttccctgaagaggacggcatcatctcatatgacatttacagcgtaaacgctgacgatgaagaagtgctgcacagccaaggacgggccgaaatcataaaggctgaacgagagccagagaccgacctttctgccatacaaaacagatgcacagcggacattcttgatccggcggccttttatcgggaaggccggagcagggggatgttccacggaaaagccttccaaggcattaagtccgcctttatcggcgagaaagaagtgctttcggacatacagcttccggattctgtttctcatacgaacggacaatttacgcttcatccgagcatcattgattcggctattcagacggcgacgatctgcattatgcaggagttttccggacaaaagctgattctgccgtttgcgctggaatatcttgaagtcatcaaagcatgcacgccgactatgcgggcgcatgcgcgcttcagtgaaggatatcaaaccggtgattccgtgcagaaagccgacattgacctgttcgacgaaacaggagcgctttgcgtgaaggtgagaggattctctacgagagtgcttgaaggcgatgcagaatcggctcagcggccatcaggctcggaaaaggtcttgtttgcaccggtttggaaagaagccgccgcatccgagaaagcttctgtccatgctgatgagcatttgatcatactttgtgaagatgcctgccgtataaaagataaagcggcatccggcctgaaagacgccgaactgctgattgcagaaggtgagggtgaaacagccgctgaacgcttccaaagctttgcgcagacaatcgctgaacacatccggcggatcatcagcgaaaaaaggcagggccgcattctggttcagaccgttatttcagcagacggcagccagcaattgtttgcggggttaacaggtttgttaaaaacagcagagctggaatacggaaaacttgactgtcagctcatcgagatggaatcaatcggcgaaatgccggctgtcgctcaaaaactgaaaaacgacagtcatcggccgcatgataaacatatccgttatacaggagaaaaacggtatgtgaaggcttgggaagaaatgcatcctgcaggtggcggcgccgtctggaaggacgaaggcgtatatctgattaccggaggcgcaggaagcctggggttgatgttcgcaaaagaaatcgcaggtcgcgtaaaacacccgaaaatcattctgaccggccgctcaaatctgacagaagccaaacagcgtgagcttgctatacttcaggactcaggcgcaaatgtcgtctacaaaaagctgaatgcggcagaccggcgggaaaatgaagcgctgataaaagagattacggcggagttcggggagcttaacggaattattcacgcagcgggagtgattcaagaccgtttcctgctgcaaaaaacgaaggaagagttcagggaagtgcttgatccgaaagtgatcggcaccgcttatttagatgaagccagcaaagactgcaatcttgactttttcgtattgttctccagtgtttccggcgttctcggcaatgtcgggcaggctgattatgccgccggcaacgcgtttatggatgcatacgccgcttacaggcaatcccttacggagaatggcttgcggcacggaaaaacgatcgcctttaactggacgctgtggaaagatggcggtatgcaggcgggagacgagacggaaagaatgatgaaaaaagctttcggcatggttccgcttcaaaaggcgtcaggcctggccgcattttatgaaggaatggctcaggaaaagccgcagcttttagcagctgaaggagacgcagcaaaattaaaacagtcgttcctgtccgtttctgaaactgaaaagccgcaggtggagaaaatagagcctgtatccgccgtttcgggagacaaatggcacggtgcgcttatcagattggtcagttcaattttaaaagtcggccaagacgagattgatattgatacggaactgagtgaatacggttttgattccgtatcctttaccgtctttacgaatcaattaaatgaagcgtatcagctggagctggcgccgacgatcttcttcgagcacgggacgatccgcagtttagcagagtatttgacggatgaaacagaagcaggtcttccttttcagccggaagaaaaacacgatgcagaagaatctcttcaagcgcttcacaccgctttgacagccatggtaagcggcattttaaaagttgaccgtgaggacattgatacagatacggaactgagtgaatatggttttgattccgtatcctttaccgtctttacgaatcaattaaatgaagcgtatcagctggagctggcgccgacgatcttcttcgagcacgggacgatcagcaatctcgccggatatttggcaaaagagcatccgggccgtttcggcgaaaagaagaaggagtctccgaaaaaagagcagccaaaagcccaaaaaccgaaaatgcagcggaaaaagcgcttcgcaacggtaatgaacgctagggcagcgacacaagagccgcgccgcttggaccctgttgccattgtcggaatcagcggccgattcccgggcgcgaaggatatagaggaattttggcgcaatctgaaagaaggaaaagattctatcacaaccattccgaaagaacgctgggattggcaagcgtttgatggcgacccgaatcttgaaaggaacaaaacgaatatcaagtggggcggctttatcgacggaatagctgaatttgatccgctgttctttgggatttcaccgcgggaagcccaatatttagatccgcagcagcggctgttattgacttatgcatggcgggcgatagaagatgcgggctgtaagccggaaagcctttccggcacaaatacgggtgtctttatcggcaccggaaataccggttataaagatttgttcacaagggcaggacttgcgccggaaggacatgcggcgacaggcagcatgattccttccatcggtccgaaccgtttgagctatttgttaaatcttcacgggccgagcgagccgattgaaacggcatgttcaagctcgcttgttgcgattcaccgggcggtatccgctatagaaaacggagaatgcgacatggcgattgccgggggaatcaacacgattctgacggaagaagcgcatatcagctacagcaaagcaggcatgctcagcaaagacggaaaatgcaaaaccttctccaaagatgccaacgggtatgtcagaggagaaggcgcgggaattctgatgctgaagaaactgacaaatgcagaacgtgacggcaatccgatttacggcgtgatccgcggtacggctgaaaaccacggcggccgggcgaatacgttaacctcgccgaatccgaaactgcaggctgatttattggtgaaagcatatcggaaagcgggcgtggacccgagcaccgtcacgtatattgaagcgcacggtacaggaacggaattgggcgacccgattgaaataaacggtttgaaagcggcgtttcacgagctggcgaaaacaaatcaagagcccgaagtctccgatcaccgctgcggcatcggttcggtcaagagcaatatcggccatttagagcttgccgcgggagtatcaggcgtcatgaaagtgcttttgcaaatgaagcacaaaacgctggtgaaaagcctgcattgcgagacgatcaatccgtacattcagctcgatgacagtcctttctacatcgtgcgggagactcaggaatggacggcagcgaaagatagaaacggaaatgcgattccgcgccgggccggggtcagctcatttggcatcggcggggtcaacgcccatatcgtcattgaagagtatgttccgaaagcagccgcgcagcctgagcacagtccggaaaatccggcaatcatccttttgtccgccaaatcaaaagaaaaactgtttgaacaggcgcagcagctgcaaaaagcgatccgtcaaacgccgtatacagatcaagacttggcgggcgtcgcttatacgctgcaaaccggaagggacgaaatggaagagcgcctggccattcttgcagcgacgatggcggaattggaaacaaagctggaagcatttacgaaaaatgagaaaaacatcgcggggctgtataccggccagtctcaccgcaataaagatacgtttgccttattcacggcagatgaagatatggacatcgtcattgacgcctggattaaaaaaggaaaattcgccaagctggcagaggtatgggtgaaaggcggggtgttgaattggaaccggctttatgaaaaaggtacgccgcgtttactcagtcttccgtcttatccgttcgcaaaagacacgtattgggtgcctgagaatcctgacaaaaataaggtccatacagaggaacggatgaaacgtattctgacaaaacaatgggaactgagcccgctcgaactgcgtgaaccgtgcccacgttccattgcgattttgacaggcggggacacgatcaatctcgcagaagagatcgcagcgcatatgccgaatcaccgtatcatcacatcatcagaccttaccggtgaatatgactggcaggcgtttggcggagtcatcgacctcctcggcgcagcgaaagaagattctcaagacatggccggaatcaaatggcttcagcaattgattgagcatgggcataaagaagggatgacactgctttgtgtcacgaaagaccttgagtcattaaataaagaggccaatcaaacaacaggagcaaaacgggccggtctgtacagaatgctggcatgtgagtacggtcatctgtcttcaaggcatctcgaccttgaaggagcgctttctgatgacaaactggcgaagcagattgccgatgagtttcatgcccgtactgatgacgcggaagtttgccggagggacggcttgcgctaccgcgctgtattgagcgaatcagaaaatatgaatatgcaaggcgagagaattgattttccggacaaccatgtgcttctgatcaccggggggacgagggggatcggtcttttatgcgcacgtcattttgccgaacattacggagtgaaaaaactggtgcttacaggccgtgagacccttccgccgcgaagtgagtggacgggcggactgaatggggtgacggcttctgtaaaagcgaaaattgaagctgttctcgacttggaatccaaaggtgtacaagtgaaggtattgtcagtcccgttagctgatgaagccgggctgagacaggaactgagtcagatcaaacagacgctcggacctatcggcggcgtgattcactgtgcgggtgtgaccgataaagagacgctcgcattcatcagaaaaaccgatgaagacatacagcgcgtgctcgagccgaaagtagacgggcttcaggcattatacagtgtgctcagcgaagagccgctgaagtttttcgtcttgttctcttccgtgtcagctgcgataccggcgctttcggcaggacaagccgactatgccatggccaatgcgtatatggactattttgcagactcatacaaagagcagctgccgatcgtaagcattcagtggccgaactggaaagaaaccggaatgggcgaagtcacgaacaaagcttataaagagagcgggctatacagcatcacgaatgcagaaggattacagctccttgacggcatacttcttgcatcagcaagaggcccggtgctgccggccgttctgaatcctaagctgtggaagccggagcgattcctgcggcgaagcaggcaggatcagccaatgagcccggctatggtaaaaccggcggaaaaaaccgctgatactgccgcagacaacgctcaattaacaaggaaaacagaagaatggctgaaagaattattttctgaagagctgcggattgaccaggatcagcttgagacagacgtattattccaagattacggagtggactccattatccttgctcagcttctgcagcggatcaatcggaatctctcggcatcgcttgacccgtccattctgtatgaatatccgacgattcaatctttcgcaaattggcttctcgaaggatatacagaagttttgtcagaacggtttgatttggcggcggagcctgttatgaagaagccggctgagccggtaattgtaacacaagccgttaaggtgcaagaagagccggccgaaaaacagattcaccgggaagatatcgcggtcgtcggcatgtcctgccggtttccgggggcggcttccttagaggcgtactggtcgcttttggctgaaggccgttcggctatcggtcctgttccggctgagcgatgggggttgaagacgccttattacgcgggaatgcttgatggaattgatcaatttgatccggacttctttttactggctgaagaagatgtaaaggcaatggaccctcaagctttggccgctctggaagaatgtcttaacctgtggtatcacgcgggctatacgccggatgagataaagggagaagcaataggtgtgtatctcggcggacgcagccgtcacagaccgggtgaagagaaactgctggatgcgaaaaacccgatcgtcgcgctgggccagaattatttggccgcaaatctctctcaatattttgatatgcgcggcccgagtgttgtcctcgatacggcttgttcttctgctttagtcggaatgaatatggccgtgcaggctcttctaacaggagaaataaaagcggccgtcgtcggcggtgtgagcctgtttgaatcagaagaaacccataaattatttgaacagcgcggcatattaagtaaagcgcagtcgttccatgtatttgacgaacgcgccgatggagtcgtgctgggcgagggagtcggaatggttcttttaaaaaccgtgtctcaggccattgaagacggagattctatttatgccgtagtgaaggcggcatccgtcaataatgacggaagaacggcaggcccggctacgccgagcctggaagcgcaaaaatccgtcatgaagacggctcttgaaaaaagcggaaaacagccggaagacattactcatattgaagcgaacggttcaggcacggtcgtgacggatctgttagaactgaaggccattcaatccgtctaccgttcaaaagatgccggcccgctcggaatcggatctgtgaaaccgaacatcgggcacccgctttgcgcggaaggaattgcaagtttcataaaggttgttctcatgctgaaagaaaagagctttatcccgtttttatcaggtgagcatgaaaacacacattttgatagagaaaaggccaatattcagttcagccgcactctggcagactggccgtcaccaataccggcggcaggaattaactgctttgccgacggcggaacaaacgcccacgtcattgtggaagcgtggcaggaagacgaagggcgccgaatcaagcgccaccctttaacaccgcctgcattaaataagcggctgatttcgccggacagcaaagaagaaacgaacgaaaaagctgcggcaaacatctgggatacctatgaagtggaggtttaacgtgaagaacttcaataagcaaatcactttatcgctgaaaaatccgtttattttacatcatgacgtttacggacaaaaagtccttccgggattggcttatattgatatgttttatcagattttcaaagagcgcggctattcatacgacgggcttcagctgcgccatttatccatatatcagccgcttatcgcgaaagaagacagcgccgtcaagcttacggttgaatgtacaaaggtaaaagaagggcgctggaaacttaccgcaaaaggggctgaggtcagcggcggacgagtccagccggaagaacgtatttacgtcaaagcggaaatgcacgagacggcacccgcagttttcagtgacacgcttgatcttgactctgtcaaacgcgaggcggagcgcaccatcgatttaaatgagctgtatgcacaatgcagaagccaggaattggttcacagcggatatatgaaagcagaaggagaagtgtttgaggagcgggacggcgttacctttgatgtatcgctcggaaaagacgcgatgggacaggccggagggtttttgttccatccgactcttcttgacggaagcggcgtcggcgcaaacctattgatctcctcgctgttaaatggggaaaagaggctgtttctgcctcttttctacgaatcttttacagcttccgaacctttgcaggccggctgcatcacgagaatcaaacgttcgtcgcttcggcaggaaaaagagctcatttacattacactggagttttttaacacatccggccgaaaagtagccgagctgaaagatttcacaagcaagctcgtgcgggatgccgagctgatcaatacagaccgaaagactgctgagaagtctcctgaaaaagccggtttaccggaagttgcggcatcgcttgaaggcggacacccgcatgaggaagcagaacggtatgtcatgaatctgatggctgaaaaaatcggcaagccgcttgaacagattgattctcaagtcggctactatgaaatggggctgacatcgtccggactgcttgacgtcgtcgaaacgataagcgaaaaaatcggcgaaaccctttctccgactttgctgtttgaatatacgacggtagcagagctggcggctttcctgacagagcagtacggaagccatttcagcgcgtctcctgcaaaaatagagaagcaggttgagaagcaaacagaaagaagacggaaaagcagtgttccgcaagatgaagatatcgcgattatcggcatggccggccgctatccgcaggccgaaaatattcatgaattctgggaaaacctgaaagaaggaaaaaactgtgtcaccgaaattccggagtctcgctgggactggcgccggtttgaaaatgtaaagtcgccttccggaaagagcatttcaaaatggggcggatttattgatgatccggattgctttgatccccaatttttccggattacgccgcgggaagctgaaacaatggaccctcaggaacggctgtttttacaaacatgctgggaaacgattgaggatgccggatatacgccgaagtcgctcgcagaggcgcgcggacggaataagagacagcgcgtcggcgtcttcgcaggggtgatgcataaggattatacgttggtcggggctgaagcttcttctgaagatcatgtattcccgctttctcttaattatgcgcaaatcgcaaacagagtttcatatttttgcaattttcacgggccgagcatggcggtcgatacggtctgttcatcctcgctgactgcggttcaccttgctgcggaaagcattcggcgcggggaatgtgaatcggcggttgccggaggcgtcaacttgtcgctgcatccgaataaatatctgacatacggtttatgggacatgttttcaacagacggggtttgtcatacattcgggaaagacggagacggctatgtaccggctgaaggaatcggtgccgttttattaaaaccgctgcgagaggcggtaaaagacggagaccggatttatgcggtgataaagggcagtgccgtcaaccacgtggggacagtgagcggaatttccgtgccgagtcctgtcgcgcaggccgatttgattgaagaatgcctggacaaagcgggcatcggtccgcgcacggtcagttatgttgaggcgcacgggacgggaacttctctcggcgacccgatcgaggttcaaggccttgtcaaggcgttccgccagtacacacaggacaaacagttctgttcgatcggatcagtgaagtccaatatcggccatgcggaatcggcggcgggcatcagcggcttaagcaaagttgccctgcagcttcaccataaaactctggtgccgtctcttcattccgaggagctgaatccgtatttagattttgaacaatcaccgttttacgtccagcatcataccgaagcatggcagcagccctcagtaaaggaaaacggaaatgagaccgtatatccccggcgtgcaggcatcagttcttttggggcgacaggttcaaacgtgcatctcattctggaggaatttgtccctgaagaatcacacggaacagtggctgaaccggcagaagaacagacattcattttcccggtttcagcccgaaatgaagaacggctaaaagagtatgttgcgaagctgtctgcatttattcatcccggcctgccgcttgaggatgcggcgtatacacttcagatcggccgtgaacagatggaggagcgggttgcgttcaccgctcagaatatgacacagctcaaagagaggctggaaggctttctggcgggtaaaacggtcagcggatgctggcggaaccgagccgataaaagcaaacaggcagagcttgctccggacttgatacataattggctttcttccgggagtctggagatgattgccgaaaagtgggccggcggaggaacgatggattggaatctcttgtacagtgaaaacaaaccgaatcggatcagcctgccgacatatccatttgaaaaaatccggtattgggtgccaaaggcggagaaaagagaatcgctgccgcaaaacagggcaggcatgctgcatccgctccttcatgaaaatgtatcaaacatgtcaggtgttcgtttccggtcctcttttagcggcggagaatttttcctgaaagatcacgtcgtcaaaaacgagcggacgttaccgggcgcggcttatctggaaatggtccgggcggccgttgaacacgcggcagaaacgaaggaagaaggaacagtccgtctgaaacatgttgtatggatacgtccgtttacagcggcggatgaatccgcagaactgtatctccgcctttatgacgaagaaaatggggagatgggcttcacggtttacagtgaatcggcttccgcggaacaagagcccgttctctatgcgcaaggaagcgcggcgtgtgtcggagcgggcgaaccggctaaaatcgagattgacaaattaagagagtcacgccgtctgatcacacctgacgcttgctatcaggcatataaacagatggggattgaatacggggatgctcacaaagcggtcacggaaatctatgcaaaagacagcaaagtgctcgcgaagctctcactcccgtcatctatttctcatacaaaagatcagtttgtcctccatccgagccttttggatgcggccttccacgcgacaatcgggttaatgcttgacagagacgggactgacataaggccgatgctgccgtttgctctcgaacagattgatgtgttgaaaagctgtaaaagcgatatgtgggtttccattgcgtacagcggcgaaagcaagcctgaagatgccgtgcagaagctggatattgatgtatgtgacgaacaaggcaatgtatgtgtgaaaatgactggttattccgcacgggaaattgaaacggataaaacagatacactattttttgaacacgtatgggaagagaaggccgctgtacatgaaaaagcgccgactcatttcaaagcccgtcacgtgatgatatcagaccggtttacggatcaaatgaacagcatacagacagacttcagctgtcacgtgctccgtgatcagcataagagtgaagacgaacggtttgaagcttgtgcgcttcaggctttcgaagaagtgaagaaaattctcgcttcaaattccggcgggcgcgagctcattcagattgtcgtgcctcaagaagcggatacgcagctcctttgcggcttaacggggcttttgaaaacagcggcgcttgaaaacccgaacctgaccggccagctgattgaattggagccggacgtcaaagcagacacgctgtcccgatatgtaaaagaatgcagcgctcatcctgatgacaagcatattcgctatgaaaacggcaagcgctatacggcacaatggcaggaaacagggcttgaacagttcggcgccgaaaagccgtggaaggataaaggtgtttatctgatcacaggcggtgcgggcggactcggatttttattcgccaaagaaatcgcccggcatgcaaaagacgccgttcttattttaacggggcgttctctgttggataaccgtaaaaaagtccagcttcaagaactgtccgatctcggcgcgcaagccgtgtacaaacaaacggacatgacggaaaaacaagaagttcaatcgctcacagcggacatctgccggaagtacggcggattaaacggtatcatacacagcgcgggaacgataaaagacaactatattctgaaaaagcacaaagatgaaatccgtgatgtactggcgccgaaagtctccgggctggttcatcttgatgaagcggcaaaggacattgagcttgattttctgattcttttctcttccggagccggaagcgccggaagcgcgggccaggctgattatgcgatggccaatgcgtttatgaacgccttcagtgaaaaaagaaaccgtaaaaaagcccgaaatgaacgctatggacacaccctttcaatctgctggccgctttggaaagacggcggcatgacggttgatgctgaaacggaagcgatgctgacaaaagaaagcggcatggtccctatgaaaacagaaaacggcatccatgctttgtaccgcgggtgggcggcaaacacatcccaaatcatggtgacggaaggctacgccgcaaaaatccgggcgtttctgaaaaaatcagcggatgatcagccggataagggcagcaaaacggaagaaacggcaggtcttacagcaggcggagagaacatgcttgcagaaaaaacagagcatttcttgaaacatgtgctttcggaagtaaccaaacttcctgtcggcaaaattgacgccaaggcgcctatggaagattacggaattgattcgattatgattatgcatttgacgggccggctggaaaagagcttcggttcattgtcaaaaacattgttcttcgagtaccagaatatcgaatcgctggcgcagtattttatgaaagcacaccgggacacgctgcgggaagtgaccgggatgaaaacagaagaaacccctgcagccaaaccggcgctgtctgagaaagcgaaagtaaagcccgtttccaaacggaatgaaggcaaaaaaggctttgcgcaagtccgtccagacgcgcggaaaaatcagcagctgacggagcgtgaagatatcgcgattatcggtatatcaggacgatatccgcaggccgaaaatcttcaggaattttggaagaacttgagtgaaggcactgactgcataaccgaaattccaaacgatcgctgggatcacagtctttattacgacgctgataaagataaagaaggcaagacgtacggaaaatggggaggatttttgaaagacgtggacaaatttgatccgcaattcttctctatttcgcctcgggatgcaaaattgatggacccgcaggagcggttattcctgcaatgtgtctacgaaacgatggaagatgccggttacacgcgcaaaaagctcacggaaaaatcgggtgatttgcttggcgccaatgtcggtgtttacgtaggcgtcatgtatgaggaatatcagctttacggagccgaagaacaggcgcgcggaaaatcgcttgcgctgaccggaaatccgtcatcaattgcgaacagggcttcctatgtattcggttttaacggtccgagcatggcgctggatacgatgtgctcttcttctttaacagccattcatctggcatgccaaagcttgcggaacggggaatgcgagacagcatttgccgggggcgtcaatgtatccgttcatccgaataaatatttgatgctcggccagaacagatttttatcaagcaaaggcagatgtgaaagtttcggtgaaggcggggacggttatgtgcccggtgaaggagtgggagccgtgctccttaagccgctttctaaagcgaaagcggacggtgatcatatttacggcctgatcaaaggaacggccgtaaaccatgatggaaaaacaaacgggtattccgtaccgaatccgaacgcccaagccgcggtgatcaaacaggcgttaaaagacgcgggaaccgatccgagggcggtcagctacattgaagcccacggcaccgggacttcactcggtgatccgattgaaatcacgggtctgacaaaagccttttcagaacaaacacaagataaacagttttgtgccatcggctcagcaaaatccaatatcgggcactgtgaaagcgcggcgggcatcgcgggtctgacgaaggtgctcctgcaaatgaaacataagaagctcgcaccgtcactgcattcccggacgcttaacccgaatattgattttctctctacgccgttcaaagtgcagcagacgcttgaagagtggaaaagaccggtcataaatgaaaacggagtaaataaagaactgccgagaaccgcagggctttcctcattcggagccggcggcgtcaacgctcatatcgtcatcgaagaatataccgctgatgaggataaggagacggcttttgctgcacctcatccgtcgatgatcgtcctttccgcgaaaaatgagcaacggcttcaaaaacgggcggaacgtcttcttgatgcgctgcggagcgggcgttaccgggaagcggatctgagccggatcgcatatacgcttcaaatcggacgtgaaccgatggaagagcgtctcggaatgattgtcagcaatttgcgcgagcttgaagaaaagcttgacgaatttacgggcggcaaggagtcaattgaccggctctaccgcggacaagtcaaacagaataaagacacgatggcgctgtttgcggctgatgaggacatggaaaaaaccattgaggcatggcttgaaaaaggcaaagccgcaaaggtattagagctttgggtgaagggccttccgctgaattgggataagctgtatcaaatgggcagaccgcaaaaaatcagtctcccggcctacccgtttgcaaaagaccgttattggatcgacacatcagctgatacagctgtcaaaagaccggccgaaacacagtctgcgccgatcgcaccggcggccgtcccggaaccggtcattgaagtaacaactcttcacgaggagactgccaaagaaaaaccgtcaaacatttcattgcagcctttgagcggcgcgaaaccgaaaagaaccgtacagtctgcttcccgtccggcggtttccgctgaaaaagtaagtgccgaattaacggaaaggttggcggacgttttatatatggatgccgacgatatcgacgcagatgacacatttattgatatcggcatggattcaatcacaggtcttgaatggataaaggccgttaataaagcgtacggcacgtcccttacggtgacgaaagtatatgattatccgacaatccgccagtttgcggccttcttgcaaaaagagctcgggacagaaccgatccttgaggaagcagccgaaccgcagaaaacagaggccgtaaaaaaaccgtcaaacatactgctgcagcctttaaacgctcataagcagcatgtgatacaagcagaagcggatattctggaggcgatgtctgaaacagcagcttccgccgaaccggaagaaccgattgaagcggtgcatgacgagttatcaaaagcactggctgatgtattgtacatggagcggcatgaagtggatattgatgaggcctttattgacctcggtatggattcgattaccggtcttgaatggataaaggccgtcaataaacggtatggcacggactgtaatgtaacgaaagtgtatgattatccgacaatccgtcaatttgccgattttctgcgcacgcagccgtccgtccgcggaagaaaaaaacaggcggttcccgtacatccaaagccgcttacgcagcaagccgccccgcgggagaaaacacctgccgagccggagagattaacggttcaaaaggaacctgaaccggtgcaggccaaacgggagcctaaagacgagatagcggacgcgatagccatcgtcggcatgtcgggcaagtacccggatgcgccggacctaaagacatattgggacaacttagcccgtgcgaaaaacgccattcgcgacatcccgctttcccgctgggatgtaaacaaatactatgatccggccttaaacaagaagggcaaagtatactgcagatcaatcggtatgcttgacggcattgaagagtttgatccgctgttctttaatatatctccgtctgaagcggaacttatggacccgcagcaccggatatttttacaggaaggttttaaagcctttgaagatgcgggttacagctcaaaagaattaaacggaaaaaattgcggcgtttatttggggattatgaacaatgaatacggcatgatgttaaacaaacatcagacaggaggaagcgcgacgggcaacagtttcagcatcgcggcggcccgcctgccttattatctcaatttgaaagggccggccattccgattgatacggcatgctcttcatctctcgtcgggactcatttggcgcgtcaggcgctgttgaatcatgaaattgacatggcgcttgtcggcggggtgaccttgtatttaacgcctgaatcatacatcagcatgtgtgaagccggaatgctgtctcctgacggccaatgtaaagcatttgataacagtgcgaacggatttgtgcctggcgaaggcgcgggggcgctcgttttgaagaggctgaaagatgcggaagccgaccaagaccatatttacggagtcattatcggatctggaattaaccaggacggaaaaaccaacggcattaccgcaccaagcgcgaaaagccaaatggaattagagcgtcaagtgtatgaagcgcacaacatacaccctgagagcatcacctatgcggaaatgcacggcaccggcacaaagcagggggacccgattgaattagaagccttatcttctgtattcaaggaaaaaacggaccgcaaacaattttgcgccatcggttcggttaaatcgaatatcgggcatacgtcggcggcggcaggtgtagcaagcgtccagaaggttctgctgtcgatgaaacatcagcagcttgtgccgacccttcatttcagcacgccgaatgaacattttgatttcgatgactcgcctttatttgtcaataccgaacttaaaccttgggaaacaggcggagcaccgcggcgggcctgtgtcagctcattcggctacagcggcacaaacgctcatctcgttatcgaagagtatcagccgaaagaccggggaagccgtaagtctgatgagacaaacatttttgtgctgtcggcgaaaaaagcgccgcaggtaaaaacctatgccgagtctgtgatccaatttgcaaaagccaatcagaatatcaatctttcagatatggcatacacgcttcagaccgggcgtgatgcgatggattaccgtcttgcggttacagccggttcgagagaagaactgatcagccgtttaaccgattttgtaaacggaaatacgggtgaagggatatatgaagcccacatcaaaacggcaaaaaaagaaatcaaagcatttgaaacggacgatgatctgaagcagcttgtcaggtcgtggttcgataagaaaaaatacgccaaaatagcggaattgtgggccaaagggcttcagatggactgggacagactctatcaagacgaaaaaccccgcagaatcagtctgccggcttacccgtttgcgaaggagccttactggctgcctgaaccgaaagccgtaccgcaggaaacagaagaccggcgcgaggctgtgcttttagaaaagcaatgggttccgtgtgagatcgattcggccggtgagaaaagcggcaggacggtcatgattctggctgatgcagggacagcggggcttgccgaagagactgcaaagcatttcgctgactcgttcattttcccggccgattccgctgacactgcagctagcgattggaatcacatagatggcgcaatcgatctgacgggatgcggagacgaagacctttcactggaaggaatcagccggatccagactctgattgatacaagccgccggcaagcgcggccgctgacgctgctatatgtaacaaaaggcttggagccatttcagcagaaaacgattcatcttgcaggagcggcaaaaagcggcctgtacagaatgcttcaaaatgagtatcaaaacgtgacgtccagacacatggatgccgatacagatacggatcagcagacgcttgccaaacagattgcagatgaattttcggcggacagcacagaaccggaagtctgccgccgaaacggacagagataccgtgctttgttcagcgagattccaagcgggaagcgagcagaacataagcccgcaccgtttcctgaagaccatgtgcttttcattaccggaggcacgaggggactgggtctcttatgcgcccgccatttcacagaaaaacacggcgtgaaaaaagtagtgctgacaggcagggagccgattcctccccgtcatgaacggtcagccgttaatacgaggctgaaagagaagatacgggcgattgaagagcttgaagcaaaaggagtgcaagtggcggtgatcagtctgaaattgtctgatcatgatgcggcagcagcggaaattgaaacgatccggcgcacgatgggaccgatcggcggcgtcattcactgtgcgggatcggttaattcagtaaatccggcatttatcagaaagactgccgacgatatacaagaagtgctggaaccgaaagtcgccgggcttcaaacattaagcagccttttcacaaatgatcctttgcaattttttgtcttattttcttcagtatctgcagtcgttccggcgctcgcggcgggacagtcggattatgcgatggcaaatgcgtacatggattatttcgcggcggctcatcagcatcaatatccgttagtcagcattcaatggccgaactggaaggaaaccggattgggtgaagtccgcacagaaagcctgaagcagaccgggctgctgggactgtccaacgcggaaggacttgacttgctggaccgcattttatctgaaaacatccgtccgtccgttctgccggctatggttgatcggagcgaatggcatcctgacaggctgctctgtcaaaagaaaaaacaaaaagagactgaagccgtaataaacggcaaagccgcggaaaaacattcagacagagaactgcttcttgatacgaaggtgtggcttgtgaaactgttttccgatgagctgaaaatcgctccggaagaactggaaacagacgaaccgtttcaggattacggggttgattcgatcattttagcgcagcttttacagcaaatgaatcatgcgctcaaagaggacttagatccgtctgttttatatgaacacccgacgattgacgcgtttgccgaatggcttgtatccaatggtcaacagctgcttgcagaacgggaggaacctgatacagaaatgttggttccggctgccgtacaaacggttcacactgagcaaaagcgtgctgctgtaactgaagacattgccgtcgtcggaatgagctgccgttttccgggagcggaatcgttagaacaatattgggatttgctgagaagcggcaggtccgcaatcggctccgtcccggcggaacgtttcggatatgcaaatcaatacgttgcgggattgattgacaatatggatcactttgattccgaattctttttcattccggaaaacgacgcgaaagcgatggaccctcaggcgttggcggtgctggaagagagcttgaaactttggtgccatgccggctatacccgtgaagaaatcaagggcatagaagccggtgtgtatatcggaggccgcagccagcatcagcctgatcctgaaagtcttgcgaatacccgcaacccgattgttgcgggcgggcagaattatttagcggcaaacgtttcgcaattttttgatctgcgcgggccgagtatcgtgcttgatacggcttgttcatcggctttgacaggaatgaacatggccgttcaggcactgagaagcggcgatatcaaagcggcggtagttggcggcgtcagcctgctgaacacggatgcggcgcaccggatgttccaagagcgcgggctgttaaacgaaaaaccggcatttcacgtatttgacaagcgttccggcggagtggtcctcggtgaaggcgtcggcatggtgctgttaaaaacagtaagacaggcgcaaaaagacggcgacacgatacacgcggtcattaaggctgccgccatgaacaatgacggcagaacggcaggcccgtcagccccgaatatgcaggcgcaaaaagatgtcatgcaaagcgcgcttttcaaaagcggcaaaaagccggaagacatcagttatatcgaagcaaacggatcgggttccgcggtgactgatttgcttgagctgaaggcgattcaatccgtataccgctcaggtccgcatgttccgctcggcatcgggtcaatcaagccgaacatcgggcatccgctttgcgcggaaggcatcgcaagcttcattaaagtcgtattaatgctgaagcataaacaaacggttccgtttctctcaggagacgaaccgatgccgcattttgatataacaaagacagattttcactttcataaaacagccggcgaatgggatgcagccagaccgtcagcagccatcaactgctttgccgacggcggaacgaacgcccacgtcattctggaagcttgggaagaaaaagatacccgaatgaaaagaaagccgctgccggtaccgtcattaagacgtaaggctctggtaaaagaacctgacgtacgagcggagaaacaagagcttcctgcgaaaaaaatgttttggaaagcatttaaataagagaggagtgggaaggaatgatatcggaaaaaatcaatatctcactggatcatcccatcatgaagggccatatggtctttggtgaagcggtattgcccggtcttgcttatatcgatttgatttatcaggtttttcaggaacacggttatgtatacaatgagctcgaattgaagcatgttacgatttatcagcctttaaccgtcagtgaaacggctgcaatcattctgaccattcaatgttctgatagcggagatggaaagtggctcatctccctttcagggcagaaacagcaaggtgacgagctgtcagacaatatacaatatgcgacggctgaaatggtgaaaagagacgctgtcacatttgacgaaaccattgatttcggcgatgtgaagcagtcagccaggtctctgaatcttgatgacatgtataaccgctgtctggatcatgacttggttcattccggtatgatgaaatcgaacggacgattgtacgaaacagaaggcggcatgctggctgagctttcttgcgaagaaggaaaagatttctttttattccatccggcccttttggatgcgagcgggatcggggggagcggtttgctttcagaaacaaaccggcttcacctgcctttatattatgaatcgttcacggccgctgacaggcttcaatcagaatgcacggcgcgtatcgccgcttccggcgtccgtcaggaaaaagaactcacaacgatgacgatcgagtacttcagccgatccggacaaaaggtggcggagcttaaaaacattacgggaaaagcggttcggctcgaagaagacgcgaatacagccgaacagaatcaacaggctgcaactgagccggaaagcgcagatgaaaaagacatcattctgtttttaaagaagcttttggctgataagcttgggcagccttgggagacgctggacgttcttgcaggctactacgagcttgggctggattcatcttctttgcttgagattgtacaggatatcagtaaaaagacgggtgcggacctcgcgcccactcttctctttgaatatacaaatataaaagaactcgcagtctttctgaaaaagactggttcatttgaatgtgcggaggaacgtgcagccgaaccatcacggtctgaagctgaggcgccggacgcgccagaacttcataaaaacaccggagacatcgcgattatcggaatggccggccgctatccgaaagcgaaaagtgtggcggagttttgggaaaaccttaaggcgggcacggattgcatcactgaagttccgaagtcccgatgggattggaaaacatatcaaaacgtaacgtccccgtctggaaaaacagtatcaaaatggggcggtttcattgacgatgccgactgtttcgatccgcagtttttcagaatctcaccgcgtgaggcggaaacgatggatccgcaggagcgcctgtttttagaaacatgctgggaaacgattgaagatgcggggtatacgcctgaaacgctgggaaataaaggggagaaacagcatccgatcggcgtatttgcaggggtgatgcataaagattattccttaatcggcgcagaacaattatctgaaactgatccttttccggtttcactgaattatgcgcagatcgccaacagagtgtcctattattgtgacttccacgggccgagcatcgcggtggataccgtttgttcatcatcattgaccgccgtccatctggccattgaaagcatccgccgcggcgaatgtgaagccgcgcttgcgggaggggtgaacttgtcgctgcacccggcgaaatatctcagctacggaagcgtgggcatgcactcaagtgacggccgctgccgtacattcggcgagggcggggacggctacgtttccggagaaggagtcggtgcggtcttgctcaagccgctggaaaaagccgaacgagacggcgaccgcatttacgcggtcattaaaggaagcgccgttaaccacgtcgggaaagtaagcggaattaccgtcccgagtcctgctgcacaggcagaagtcattaaggcctgtctgaaaaaagcaggtatcagcccgcggaccgtcagttatgtggaagcccacggcacgggtacttcgttaggagacccgattgaaattgaaggtctgtcaaaagcgttcagccaagggacgcaggatcagcaattttgttccatcggttcggtcaaatcaaatatcggtcacgcagaatcagcggcgggaatcagcgggttaacaaaagcggcgctgcagcttcatcacaaaacgcttgtcaaatcactgcattctgcggaattaaatccttacctgaaatttgagggatctcctttttacgtacagcagcagactgctccgtggatgcagccggcagccgaagaaaacggaaaagtcacacattatccgcgccgggccggactcagttccttcggtgcatcaggttcgaacgcccacatcattttagaagaatacattcagcctgaacaaaaagcgcctgcacctgagaacgatgcagcaaaactcatcccgctgtcagcaagaaataaagacaggcttctggcctatgcggaaaaattagcccgatcgctttcagaaaagacggtgctgtctgaactggcttatacacttcagacaggacgtgaagcaatggaggagagagctgtcttccttgtaaatgacacccgcgacttgaaagaaaagctgaatgatttcgtaaaaggaaacgaaaacatccccggtctttggcgcggacaagccgagctgccggaactgagcgaaaccgctccagagacggatgatccgatacggcttgccgagttatgggcagaagggaaaataatagattggaataggctgtacgcttcgggtaaaccgcgtaaaacaagcgttccgacgtatccgtttgcaaaagaacgctattggattccgcagcagaaaaaacaggagaaaagcgtgtcaggcacagtgctgcatccgcttttacaagaaaatacgtcagatttttcgcatcagcgcttcacgtctctttttactggagatgaatttttcctatctgaccatgtcgtcaacggacaaaaaatactgccgggtgtcgcctatttggaaatggccagagaggcggtcaaaaaggccgctgccgtgacggaaaaaggccatagcgtcacactcaggcaggttgtttgggtcaggccggtcatgattgaagacaaaccgaaggaaatacatattgccctttatccagaagataatggtgagattacctatgaaatattcagtgaaacagaaaacggcgaagatccggttattcacagccagggtgaagcggtcattaccgaaccgggaagcgcccagattgatatcgagtctgtcaaagcttcctgcaattcagggaccgtgactgcggaagaatgttacggtgcttttgagaagatcggtctggattacggagaggcatacagaggcgtacagcaattgctgatcggagaacaccgattattggcccgtatttcactcccggctgccgtacatgacaataaagaacagtatacgcttcacccgagtatgatggacgccgcttttcacgcctccgtcggtctgcttgtccgctcaatacatgacgatgcagacagccacgagctttctctgccgtttgcaatgcaggaagtggaagtgttcgggccgtgtcctgaacatatctggtcatatatccggtacacagaaggcagcaaagcagatgacaacgtaagaaaatttgacattgatatgtgcgatgatgccggtacggtttatgtccggatgaaaggcgcgtccgtccgggcgcttgacacaggccaaacagcaggcggtgaaaccccggaggcgcctgtcggccatacgatgctgattccggcttgggagcccgttgcacttaaaaaaacgaagaaagcaaaaacggcggaaaagcagactgcggttttcggtgaaactgacagaatgcatacgcgcataaaagaacatctgccgaacgcttcctattatccgatcagaggtacggatgatatcacatctcttacgcacatgcttgaaggacaaaaagaactggagcaaatcatttggcttgctccgcaggctgagagtgctgacagcctcaaggaacaggaaagaaacgttcttcatgtgttcaagctgatgaaagcattacttgccttggggtacggagaaaaacatttggactggtgcatcgtcacagcaaatgcccagccgttttccgatcaagacagcgccgacccgtcacaagccgcagtcagcggacttgccggaacaatggcgaaagaatatccgcattggaatatccgcatgattgacacggaaacggacggcagctggccgatcgaagaggcgctcagtctttctgccggaaaaaacggtcaaatttgggcgtaccgcaatcagcagctgtttgagcggcagctgataccgcttgacaatatgccgaaaaacggcacgctgtaccaaacaggcggagtttatgccgtgatcggaggcgccggatatcttggcgaggcatggagtgaatacatgatccgccgctacaaagcacgcatcatttggatcggaagaagcacactgaatgattccatacaggcgaaactcgaccggctcagcgcattcggcccggcgcctgaatatgtttccgccgatgccgctgacagtgcttccttagagcgggcttatcagtttataaaagagcgtcacacaaaaatgaacggaatcatccactcggcaatggatctgtctgagcaaagcttaaataatatgaagacagaagagttcaaatcggtgctgcgggcaaaagccgatgtcagtgtgtccttggcggaggtatttggacaggagccgcttgactttgcgctcttcttctcctcgcttgtggcatttatccataacgtgaaacaaagccactatgccgcaggatgcgctttcagtgacgcatttgcgaaagaacttgatcagacgtggaattgtccggtcaaagtcatgaattggggctattggggcaacagcgaagcggctgaagacggcgattttattcagctgatggatcagatcggattaggattgatcgaaccggacgctgcgatggaggcgcttgaaacccttatgacgctgccggttgatcaagcggctttcattcatacgacaaaaccggtcgcagtcgaagggatgagtgaaacagaaaaaatttccgtttatccgtctcagccgcttgtctcttcacaacagctgaaggccgctccgcccggcgcacgtcttgtaaaagaggctgaacatcaaaagctcgatgattttctgtatcagcttttgatcgcccagcttaaagaagcagacttgctgacgccgcaaagccttaaagcgtatgagcccgaacacgaatattttaaaaaatggctcaatcaaacgatcgctttccttctggaacatggttatctggaagggaatgcggattcatataatttgtcggcgcgagccgaagacacaaccgcctcgctatggcaaaaatgggagcaggaaaaagaggaatggctcaataacgccgatacaaaagcgatgactgttttagccgagacgatgcttaaagcactgccggacattctgcgcgaagacgtgccggcgactgacatcatgttcccgcactcttcaatggaacttgttgaaggaatttataagcacaatcaagtcgcggattactttaacagcgctctgtcagatacattaacggcgtatgtgaaagaaaacatcagcaaacattcaaaagccgagatccgcatactggaaatcggagcgggcacaggcggcacaagcgcaggcatatttgaaaagcttaggccgtatcaaaactatataaaagaatactgttacaccgatgtatcgaaagcttttctcgtgcatgcggagacggaatacggcaaacggaatccttatctgacgtataagctttttaacgcagaagcgccgcttgccggccaggacatagagccgggcgcatacgacatcgtcgttgccgccaatgtgctccacgcgacgaaagacatccgccagacgctgagaaacgccaaagccgttttaaaagacaacggtttgctgctcttaaatgaaatggcgggaaacagcctgttcccgcatattactttcggactgcttgaaggctggtggctgcatgaagattccgcccttcgtattccggggtgcccgggcttgtatccggaaagctggaagcgcgtgttagaaagtgaaggctggcattctgtcttcttcccggcagaagcggcacatgaattaagccatcagattatagcggcaaaaagcaacggcgttgttcgccaaaaaacgcttacatcaggggccggaaaacggaccgctccgccaaaagcagcatatacgccggaacttcaggcgcaaacaacggtgcaaaaaggcgacacgtctttaacagaaaaaagcaccgagtacttgaaaacgttaatcggagaaacattaaaaattccgccggctcaaattgatccgaaagcgccgcttgaaaaatacggaattgattctatcgtcgtcgtacagctgacaaacgcgttacgaaatgtattggaccaagtcagcagcactttattttttgaatatcagacgatcgaggcgctcgtcgctcacttaatcaaaacgaaaaaagacgcgatgatcaaactgacaggacaaacgcctgttcaggaagaacagaaggcaacaccagaaccgcaggctgtacagccggctaagccgcttcgcactgactggcggcggagggaaaagcgggcagccaaagagcccgtccggcaaagttcggttcgcgacgtggccatcatcggtgtttcaggacgctacccgcaggcaaaaacagcggctgagctttgggccaatattaaaaaaggaaaaaactgcatagaagaaatcccgcgggaacgctggaactggcaggattactacgatgaagagaaaggtaaagaaggctctatttatacgaaatggggcggcttcattgaggatatggacaagtttgatccgctgttctttcagatttctcctttggaagcggagcgaatggacccgcaggagcgattatttttagaaacggcgtatgcgagtatcgaggatgccggctatacgcctgacaatctgtgccaaagcagaaaaatcggtgtttttgccggcgcgatgaacaaaaactacccgacaggctacggctactggtccattgccaacagggtatcttacctttttgatttccaagggccgagcattgccgttgacacagcctgctcctcttctttgacggccattcatctggcacttgagagcatatacagcggttcaagcgaatgcgcgattgctggtggcgtaaacatagtgaccgccccgattcattatatgaatctgtcagtcatgaacatgctttccgcaagcgacacgtgtaaatcgttcggagaccgcgcggacggttttgtcgacggagaaggcgtgggagcggtcgtgttaaagccgttggaccaagcgatcgccgataacgatcacatttacggtgtgattaaaggaagcaccattaacagcggaggcaaaacgaacggatacaccgttccgaatccgaatgcgcaggccgccttaataaaagaagctttcgaaagggcaaacgtcccggcgcgcaccgtcagttatattgaagcccacggcacggggaccgcattaggggatccgattgaaatcgccggattaacgaaagcatttgaagaggatacaacagacaaacagttttgcgccatcggctcagcaaaatcaaatatcggccattgcgaaagcgcagcgggcattgcgggtctgacaaaaatattattccagctcaaagaccgccaaattgcgccgtccctgcacgcggaacggctgaacccaaatattgatttcgcgtatacgccgtttgccgttcagcaggagctcggtgagtggaaacgtcccgtcatcggcggcaaagagcttccgagaagggcggggttaagcagcttcggcgcgggaggagcaaacgcccaccttatcatagaagaatatacggcagacaaagtgcctgatgagacgccggcagatcagcccgccatcatcgtcctgtccgcgaaaaacagcgaacggctcactgaaaaagcaaaacagctcagagacgctatccgtgaaaaaagatacaacggcagcgaccttatgagcatagcctttactctccagactggccgggtgccgatggaagagcgtctcggttttatcgtccattcactacatgaacttgaggaaaaactgaacggatttattgccgaacaaaacagcgccggactgcaccgtgacggcacggaagaaaacaaacggatgcttgccgtattttcggcggatgatgatatggaaacaatcatagacgcttggatcagcaaaagaaaatattctaagctgcttgagctttgggtaaaaggattggacatcaattgggcgaaattatacggagaccgtcctccggcccgcatcagcctgcctgcttatccgtttgcgaaagaacgcttctggcatcagcagcctgtacaaagcaaggctgcgcccgttaaggcgccggctgatgaaactgatccggcagaacagtttgaagtgatggcttttagagaagttcttaaagaacaggctctgccggctgccggagaaaaacaagtcgaaacggtgatttctttcttaactgatcagaagaagcagcaggaagccgtctctgtgatcaaatcgtatgacagtgacattgacgttatttttatcgctcagggagaccggtatgaggccttgtccgccggccgctgccaagtggtgcgggaagatccgcaatcatatgtgaacgcttttgcggatattcaaaaagagtacggtgaagcttccgccattttgtatttatgggcgcttgaagataaaagctgcatcgaagattattcatgtattgtccatattctcaaagcaatggctgagaccggtctgcagccggaaaggctgttattggcgggggaatatgcatccggtctggaaaggtgctacttggaatcatggatcggctttgagcgttcgctcggcattgttctcccgaaaacaagtgttaccggccacttcagaaaagccggtgcggccataacggactggatgagaaccatttgggatgagctgaaagctgaaacagaccataccgttttcttggaagagggaaaacgatatgtctatcacaccgaaccaaccggactaacgaaagaaaacggcaggatcagaaccggcggaacatatctcattacaggcggattaggagggctcggctacttatttgcccgccatctcgcccggaactaccaggcaaatgtcattctcacggggcggtcgccgatcaatgaagaaaagaaagaaaaaatgaaaggcctggaaaatctcggcgcgggtgttctttacgccgaagccgatgtttgtgatccgatcggaatgggcgactgcatcaagcgcgcgaaagaacgattcggagccattcacggcgtcattcatgcggcgggcatcgaaagcagaacatccgtctttgaaaatgaaatcgggaatttccgcagtacgcttgaaccgaaaataaacggaagcctgcttcttgacgagtggctgaaaaacgaaacgcctgatttcatctgctacttttcatccacatcggctgttttaggagatttcggctgctgtgattacgcggtcgcgaacaggttccaaatggcgtatgcccgctataaaaacgaacaatccgaaagcggaaacgcttttgtcataaactggccggtctggaaaaacggcggaatggccgtcggcggtgaagagacgacgggcatgtacctgaaatcaagcggccagcgcctgttagaaacagatgaaggcattgagctgtttgagcgcatcatttctcaagacaacacccagtgccttgtcattgccggcaaaagaagccgtgccgaacgatttttaggcatacggcgggacgaatcatcaaaaccggatgcgcttttggaaaccgtgagccgccgcatcccggaagaaagcacggaaaaacggctcgaagcggatttgaaagagctgatacacagtctgctgaaaatatctaaagataaactcgtcctgcataaaaactgggcggaattcggatttgattccatctatttagccaaatttgccgctcttttgtcgagtcattacggcattgaagttactccggcgttattttacagctatgccacgctcggagacgtcatcagctattacctgacagaacacaaagaaacgatcgaaacgttttaccgaacggaagaaaccgaaacagaagccgccgctccggataacaaggagtatacggatcaggagatcatcgccatgatgaaacaggtctctgaggggacattagattttaaaagagtgcaagacatcatagaagggagtaagacctatgaatcataaagaacttctcgatgcctacagatcaggaacgctcaccatcgctgaagtagaacaaaagctccaggctttcaagcggacaactgcaaaacgtccgctttctgaaggccagaaaggtttgtggatgcttcagaaaatgtttccggagatgagcgcatataacattccgttatgctttcgttttcaaaagctggatatcgagacattcaaaaacgcccttttgtccgtgcagcgccagcaccctattttgaccagtgtgataaaagaggaaaacggccttccgtatcagatagaagatacggatcggcattttccgattgaagaaatggatctttctgaattaagcgggcgtgacgttctttcgtttattaaagaaaaagcaaaagaaccgttcgcgcttgaaaccgggccgctccttcgtgttcatgtattccggcgggcgaagcgggagccgattgtgttaatcaccattcaccatatcatttttgacggcgtctctcttatgacgtttatgtcggcgctgctggacgcttatgtaaaagcaagtgaaggcaaagaacctgtcatggttcagcaggccgcagattatcatgattttgtgaaatgggaaaaagagctgctggaaagcgaagcgggaaaaacgcatctctcttattggaaaaagcagctggaaggaccgctgccggtgcttgagcttccgtcggattatccgagatcatcggttcaaacttgcaaagggcaggcgtatcagcgcttgcttcctgatgaactgaaccggcagattaaagtgtgcgcccaaaaacataatgtcaatgaatccgttgtgtatctcgctattttcaaagggctgctctatcaatatacgaatcaggaagatgtcatcgtcggcatgccgacgatggggcgctctgaggctcaatttgagtctgtcatcggatactttattaatatgatcgcggtcagaagcagggagacgggcgccaaatcctttacggcgtttttgaaggagctgcagctgacactggcagaagggctggaccatgccgcgtatccgtttcccgcgcttgtcaaagaattgaagacggaacgctcgcctgcggtttcgcctgtttttcaaaccgcgtttttctatcaaaacttcttccggacagaaggagcggaaaagctggcggaactatatcaatcactcggcatcgaaatgatagaagacattcatcaggaaggcgaatttgagcttgcgcttgaagtctataaaaaagaaacaggaaccgtcctgcaatttctgtacaacccggatgtctacagcccttctttcatcgaacggatggcggagcattatatgaaactggcagaaaaggtgctttctgatccggagatcgcttttgaagcctgttccggcctgctcaatcaaaaacgtgaagcaagccgttcatcccatcagccgaatgagcgctgcattcatgaagtgtttgcggaaaaagccggacgccaccctgacagagaagccgtcacattcggtgaaaacagtcttacatatcgcgaattagatgaacgaagcacggcgctcgccgtgcacctgcaagaaaagggcgtcacaccggaatgcccggtcggcatttgtacggagcgttcttttgagatggtcatcggcatcctcgccattttaaaagcgggaggcgcgtatgtgccgctggacccggcttttccaaacgaacggatggcgcacgtgttgactgacagcggcgtttcaatcgtattaacgcaagcaaagacgcgcggcatgattgaacagttggccatcggcggtgtgagcacggtggaaattgaaaacagcggacgttctgtcagcggggcaaaactgacgccgcgttcaaaaccgcatcatctcgcttatattctatatacgtccggaagcacgggaaaaccgaaaggcgtcatggttgagcacagggccatcatgaatacgctgcagtttttggaagctgagtatccggtcgcacaagaggatgcctatttgttaaaaacgaattacgtatttgacgtttcgatttctgaattattcggctggtttatcggaaacggacggcttgtcattttgccgcctggtgcagaaaaaaatccgcagctttgcatggaatacatccaaacccaccaggtcacgcacctgaattttgctcccgccgtgtttaatgtatttctggaaacggtaaagcggcatacggcatttacagaagacggccctgtgaaatatgtgatggtggccggtgaggcgtttccgaaagatttagtcaaaaagtcagtttccatcttcaaacatgccagaattgaaaacatatacggcccgacggaaacatctatttatgccgcttactacagctgcggccaaaaggaaatcacaagcaggaatacgccgatcgggaaaccgattcacaatacgcggctttatatcgtcgatgaaaagctcagccccgtccctgacggtgtggccggggagctttgcgtggccggcgccggtctggccagaggctattacaatcagcctgagctgacggcggcatcatttattgataatccgtttagtgaaggagaaaaactttacaagacaggtgatttagccagatggctgcctgacggaaatatagaatatgccggccggattgacagtcaggtgaaaattcgcggcttccgcatcgaattgggagcgattgaaacgaaattgaacgaacatccggacattcttgatcaggcggttgttgttcaggaaaagaacggacataaaaagctgattgcttattatacggcccgctccggtcatacggctgatgaaaaagcgctccgcaaccatcttttatcgagtctgccggattatatggcgcctgctcattttatccgtctggatgcgctgccgttaacaccgagcggaaaagtgaaccgcaaagacctaaaacagcgcaaggtaattgttcacaggtctgaaaagacgggcagactgccgttatcagaagcggaagcgaaagtgaccgcaatatgggaagacctgctgaatacggcgggcatcaaaaccgaagacggctttttcgatgtgggaggcgactcgcttctggctgttgcggcggcagaacgcattaaacaggagctggaatgcgattttaccgtcacggatttattcgaacactctaccattcaggcgatcagccgatttattgttgaaactaaacagacggctgaatcagaggtatcaggccaagatgaaagagaaagagaacaaacaccgcaaaacggggtgccgtcttactttgacgacagtgtggcgatagtggggatttcctgccagttccccggcgcgaaaaatcatcatgagttttggaagcagttaagagaaggaaaggaaagcgtccggttctactcggaagaagaacttcgggaagccggcgtgcctgaagatttgatcgaaaatcccgactatgtgccggcattatcgacgatagaaggaaaagatctctttgaccctgagttctttcacatttctccgaaagacgcagaatttatggatcctcagcttcggcttctgctgcttcattcttggaaagccgtcgaggacgcgggatatgtatccaaagagattccgaagacaagcgtatatatgtcggcaagcaataattcgtatcggtcgcttttaccggaaaaaacgacagaaggccatgaatctcctgacggctatgtctcatgggtgttagcgcagagcggcacgattccgacgatggtttcccataagctcggattaaaagggccaagctatttcgttcattccaattgctcatcatcattagtcggtctttattcagcctatagaagcatcacgagcggagaatcggaatacgcgctcgtcggcggagcaacgctgcatgcagcgaccggcatcggctatgtgcatcaaaacggattgaatttttcaagcgacgggcatgtcaaggcatttgacgcttcagccgacggtatggcgggcggagaaggagcggccgtcattctgctgaaaaaggcgtcgcaagccgttcaggacggagatcacatatacgccatgctcagaggcatcggtctgaacaatgacggagcggataaagtcggtttttacgcaccgagtgtaaaaggtcagactgacgtcatccagcatgttttagacagcacgaatattcacccggagacgatttcctatatcgaagcgcacggcactggaacgacattgggtgatccgattgaaatgtccgcgctgcagcaagtgtataaacgttacacggaccgggagcagtattgcggaatcggctccgtaaaaacgaatatcgggcatttggatacagcagcgggtctggccgggtgcatcaaagtcgccatgagtttatatcatcgggagctggcgcctaccattaattacacgtcaccgaacccgaatatcaaattcagcggttcgccgttttatgtggcggataagagaaaactgcttccggagagagagacgccgcaccgggcagcgttaagctcattcggactcggaggaacaaacgcacacgccatttttgaacagtatgaaaacaaaacgatcagcggattaaatgacggacagccgccttatatcgttccgctgtcagcgagaaataagcagcgtcttactgcctatgcatcttgtttatccggctttctggatgaagccgaaaacgatgtttccttgcatgatctggcatttacgtatcagaccggacgtgaagcgatggaagagagagccgtttttatcagtcatgatcatcacgatttgaagcgtcagctgcaggattttatcaacggcaatgaccaaaacatcttacggggcaaaaaagtgagaagcagagaagtgtcggctcaggagatggaagagcttgcggcatgtcagacacgtgatgaaaagctgaaagcatttgcggcgctctggattgaaggagcgcgtgttgattggggcttattgtatcaggattccgcgccgcgaagaatcagtgcgccgacctacccgttcgcagaggagcgcttctggccggaagaaactgtgaagcaaactgataccaagtttttgcatccgctggtacatcagaatacatccgtcttgcaggagcagcggttcagttcggaattcacgggaaaagagtattttattgccgagcatatcattaaaggaatggcgatcgtgccggctgccgtcacccttgagatggcacgggccgcggcggagaaaagcatcggcggggcaacagaggattctctcggcctgcgcttaaagaatatcgtatgggtacgcccggtgatagccgatcaggacgctgtccgtgtccatatcggactttatgaagaagaggacggacagattcaatacagaatgtacggcggtaacgattctatcggtgaagaagctcccctttataatcagggcatcgctgaaatcatccggaaggaaccggaggaagcggcggatattgagcagctgaagcgccggtgcacgcagggaacaatcgaatctcaagcgttttacaaaggaatgatcggagctgattacgggccgggctacaaaggtgtacagcttgtatacaaaggcgaagaccgtctgcttgctaaattgaagcttcctgaatccgtctcccatacgaaagctgattatatccttcatccgagtatgatggacggtgcgcttcaggccgccgaatatttgcaaaacgtgacgagagcgctgctggcagaaagcggggaaccattcaaagccgcattgccgtttgctttagaggagctggacgttctgaatccgtgcgctgatgatatgtgggtgcacgtcacattcagtgcgaacaataaagccggcgatcctatccaaaaagcagatattgatttatatgacaataacggcgggctttgtgtgcggatgagaggtttctcaacgcggatcatggaagaaaatgcgggtgccggcgttcccatcagccgtacggacacattgctcgctgaaccggtctggaaagagcagccggaaccggccgatcatgcgccttcgtatgaacagcatatcattttcctttgtgagttcgatgaagccgttaaacaagctgtcgaagcaaagcttgaacatgcaagcgtcattatcttggacgatcgtcccgcatctattgcagagcggtatcattcttatgcgggtcagctgtttggccatatcaaaaccataatgaaaagcaagccgaagggccgcgtgctttttcaggctgttacgcggtcagcaggcttacagcaggtgttctcaggcattaccggcctcttcaaaaccgcatgccttgaacattccaagctgatctgtcaaatgatcgaagccgaggagaaagaaagtgctgaaggcatcgcggaaaaagcgtccgaaaaccgtatgcatgccgaaagcgtccatgtgaaatatgaagacggcaagcgctttgccgctgattgggaagaggtggatatttctcaagcggagccggatattccgtggaaagacgaaggcgtttatctcattacaggaggtgccggaggtttaggtctgatttttgcaaaagagatcgcaaaccgtacaaaagacgccgtcatcatactaaccggccggtccgctctcagagaaaagcagaaagacatgctggaaacagtacgtgctgccggcgcttctgttttctacgagcagaccgatgtcacggacgaagcagaagtataccgattgatccgcaatatccgcaaacggcacggcaagctggacgggattgttcacagtgccggcattataaaagacaactacatggtgaagaagacggcagaggaattccaacacgttctcgctccgaaagtgaagggccttgtgtatcttgatgaagcgtcacaacatgagaaattagatgtctttattgtcttctcatccttatcaggtgtgcttggaagcgtcggccaggctgattatgcgtctgcaaatgtctttatggagatgtatgccgagcaccgccgttctttacaagccgcaggacaaagatacggaaagacgctttctgtcagctggccgttatggaaagaaggcggaatgcaggcaggaaagcagacggaagatatgctgatgcaggaggcgggaatcgcaccgctcggcacagatgccggcatcaaggctttatatcaaggcttgatgagcgggacagcccggatgacggttcttgaaggagatgtgaaaaacatgaaagcaaaactgtttcgcaaagagaatgatcatccggaagcagagaccggcgtacgtcatgacattgatgctgacagcctgcttgaaaaagtgaagcatctgttaaaacagcagacggcctcactgttaaaagtaaacattgacaaaattgatcctcacgaagaaatgacaaaatacgggctggattctatctcgatgactgagtttacgaaccagttaaacaaaacgtaccggcttacgttaacgccgacgattttctttgatcatccgacaatccatgaatttgccgttcatttaatcagtgaatacgaagaggaatttgccggacggtttgcggtaaatacaaaaacggttcaatcggcaagaccggtaaaagagactcaaatcacgcgcccggccgttaagcggcgccgcactctgcctgagacacttccgcagacagtgcagcgggaccaagggccggaaccgatcgcaatcgtaggcatcagcgggattttcccgatggcagaagacattgaagctttctggcagaacctgaaagaaggcaaagactgcatgaccgagattccgaaagaccgctgggactggcgggactattacggggatcccgcaaaagaagcaaataaaacaaacgtcaaccaaggcgggtttattgacggaattgccgaatttgatccgttgtttttcgggatttcaccccgggaagcggagcaaatggaccctcagcagcgcctcttgctgacgtatgcgtggaaagcgattgaagatgccggatatgcgtcaaagagtctctcaggcacaaagacaggtgtgtttatcgggaccggaaacaccggctacggttctcttttagccaatgccgatgcggcgattgaagggtcatccgcggcgaatacaagtccgtctgtcggaccgaaccgtgtcagctatacgctcaatctgcacgggccgagcgagccgattgataccgcctgctcaagctcgctcgttgccatacaccatgccgtttcttcaattgaagaagggacgtgcgacatggctttggcgggaggaatcaatacgattgttcttccggatgtgtatatcagttttgacaaagcgggcgcgctgagtaaagaaggaagatgcaaaacgttctccgatcaggctgacggttttgcccatggtgaaggagccgggctctttttcctcaaaaagctgaaagccgctgaggcggatggggaccatatttacggcgtcattaaaggaagcgcggtgaatcacggcggccgtgcggcatctttaacaacgcctaacccgaaacaacaggcggaagtcattaaagccgcatacaaaaaagcgggcattgatccgaaaacagtctcttatatcgaagcgcacggcaccggaacagaactgggggatcccgttgaaattaacggcctgaaacaagcgttcagctcgtttgcagacggaaaagagaaagcggccggctattgcggcttagggtcggtcaaaacgaatatcggccatttatcccttgccgcgggagcagcgggcattattaaaattttgctgcagatgaagcatcgcacattagtcaaaagtctccactgtgagacggtaaatccgtacattcagcttgaagacagcccgttttatctggtgcgggagacgatggaatggaagacgcagacggacgaacgcggaaacgaacagccgcgccgcgcgggcatcagctcattcggcatcggaggcgtaaatgcccacgtcgtcatcgaagaatacattccagaagacagagaggaagcagatgattctcatatcgacccatgtcttttcgttctgtccgccaaaaatgaaaaacgcctgaaagagcaggcaaaacagctgaaacgtgcgcttactgaaaaacggtacgatcattccagcctcgtttctatggcatatactctccaaatcggaagggacgccatggaagaacgcctggcggttattgccggatccgcagaagaactgcaggaaaaactgtcacagtttatcactggagataagcatgcggatttgtacagaggaagaatagacaaaggcacgctgcaaatgctgacggaagatgaagaaattcaagaagccgttgaaaaatggatggcacgcggcaaatacgcgaagctgcttgaattatgggtcaaagggctgaacgtcgattgggcgaagctgtatggagaccggccgcctaaacgcatgagcctgccgtcgtatccttttgcaaaagaccgctattgggcggcgaaacacaccggaaaacacgaaaaaacaagcacagtatctgccggaaaacaagacgcgcttcatccgcttctgcacagaaatacttcaaaccttgcagaacagcggttcagctcaatctatacaggagaagaattttaccttgcggatcatgttgtaaaaggcgtgccgattttaccgggtgtggcacatcttgaaatggcgcgcgcagcaatggaacaggcatctgaagtaccggccggacaaggaagcatcaagcttaagaatacggtttgggtgcggccgatcaccattgaagacgagccggtccatgtcaacatccgcctcattcctgaaacggcaaatgacgttcaattcgacatttacagcggccgggaaacagatcagccgtccgtttacagccaaggggcagtatcagtccgccctgacgcaaaggctccggtcattgatctgcaaaaactgagatcacaatccgccgagacaccgttttctgcagatgaagtgtacgatatgtaccgcaaaatcggttttgattacggcccggctttccggggtgtcaaagcgatttatacaggtgatgatttcgtattgggcagactgtctcttgatacggcttgtgcggacacggtgcaggagtatgtcatgcatccgggcttaatggactctgcattgcaggcatcaagcatattaaccggaacaaatgatgaaaaactgatgcttccgtttgcggttcaggagcttgaagtattcagcgcatgcgctgccgagatgtgggtttacgccagactttctgaagaccacaaagccggccagattgaaaagcgcgatcttgatatttgtgatgaaaacggcaaggtttgcgtaagtctgaaaggtttgtcattcagaacggctgaaaaagaacctgagaaaaaagaaaaagctccggaaacgctcatgcttgagccggtatggacacgaagcgatgaaactgccgttcaaacggaaccggtttttgcccggcatatcgtaatgctttgtgacacagacgccggattaaaacaagccgttgaagccgcgggagctgaatgtattgaaatgacctccccgcacgggaaagcggcggcgcgcttccgtgattatacaggacggatattggagacgctgcaaaaactgctgaaggaagagacggaaggagacgtccttatccagacggttctcgctaaaacagataagcatcagctgctctcagggatttcagctctgttaaaaacagccggcctggaacataaaaaactgaaaacccagctgattgaaatagaaccggcggaaaacggcagaatcacagacatcatcagagaaaataaaacaagggctgatgacagccatatcaaatatgaaaacggcatccgatacagcgcagatgtcaaagaaacggccgtgtccggcggaaaaatacgcattccgtggaacgacggaggcatttatctcattaccggaggagccgggggcttaggatttattttcgcgaaagaaattgcccggaaagttaaagagccgacactggttttgacaggccgttccgcattaagcgagaatcaaaggatgcagctgcaatcgcttgaatcactcggagcaaaagcggagtacaaacaggctgatgtaacaaacgctcaaactgcggcagacctggtcaaaacaattgaaacggaatatggcggccttcacggcatcattcatagcgcgggtgtgatgaaagatcaatatatcgcaaagaaaacaaccgaagagttttacagtgtattggctcctaaaacggacggatttgtcaaccttgatgaagcaaccgagcatttagcgctggactttttcatcgttttctcatccatttccggtgtcaccgggaatgcgggacaggcggattatgcggcggcaaacgcatttatggacagctatgcggcataccgcaacgcgctggttacggcaatgtaccgccacggtcacacattgtcaatcaattggccgctttggaaagacggcggaatgcaagtcaacgaagaaatggcgaagctcaccgaaaaaagaaccggcgtaacaccgatgcgcactgaaaccggaatagaagctctttacaaagcatggagcatggggaaaacaagtgtgctcgtcatggaaggaaaccgcgccgtaatgcgggaaaaactgcttcaaaagactcccgcagccgcttttgcaccggttaagaaaacggaggaaacgcctgcgccgaaagacctgacggccaaacttcaggaattgctggcaaaagaagtttccgggcttctgaaaataaacattgaagaaatcgatatcgaattggagttcaatcaatacggatttgattccattacgctgacggaattcgccaacaagctgaatgacacttatcagcttgatctcacaccgaccatattttttgaatatgcgacgattcaaaccttggcgcatcatttagcagaagactatcaaacacaatttgcaggcagcacacagccgaaagaagaaaaacaaagcggtgtaacagatgatggcggcatcagactggcagggaacaaacgatttgcaaaaacagccgtacagcctgttcagactgcggctgaacataaaccggaaccgattgccattgtcggcatgagcggagtgtttccgaaagccgcaaatattgatgagtattggcgcaatttagaagagggaaaagattgtataacagaggtgccggcggatcgctgggactggcgggagtattacggtgacccgcttaacgaagccaacaaaacaaatgtaaagtggggcggatttattgacggagttgcggaatttgatccgctgttcttcggaatttcaccgctggaagccgaacagatggatccccagcagcgcttgttaatgatgtatgcgtggaaggcgatagaagatgcgggatattccgctaaaagcctttccggcacgaaaacaggcctgtatatcggcacggggaataccggatacggctcactgttttccgacctggatatcggcggtgcgtcagccgcaaatatgagtccgtcagcagggccgaaccgcgtcagctatatgctcaatctgcacgggccgagtgaaccgatcgacacggcttgttccagctcgctggtcgcgattcatcacgccgtatgcgccattgaaaacgggaactgcgagatggcgatcgccggcggcgtgaataccgtcgtcacaccgcaaggccacatcgcttatgacaaagcgggtgcgctgagcaaagaagggaaatgcaaaacgttctccgacagggcggacggatttgccgtcagtgaaggtgccggaattctgtttttgaaaaagctgtcagaagcggaaaaagcgggcgatcatatttacggcgtcattaaaggcagcgcggtcaaccacggcggacgcgcgaactccttgacgacaccgaacccgaaagcccaggcggaagtcgtcagaacggcttatgacaaagcaggcattgatccgagaaccgtcacttatatagaagcgcacggaaccggaacggagcttggcgatccggtcgaaatcaacggcctgaaatccgcctttcaaaagctgtacgaaaaaacaggcgattccgccgtttacgcgagtcactgcggtctgggatcggctaaaaccaatatcggccacctgtcactggcagccggtgtcgcgggtgtgatcaaagtgctgatgcagatgaagcataaaacacttgcaaaaagcctccacagcgaggtcatcaacccgtatatcaagctgaaagacagtccgttttacatcgtacaggaaaaaagagaatggacggcattgaaagacgaaaacggcaatcatctgccgcgccgtgcgggaatcagttctttcggcatcggcggcgtaaacgcccatgtcgtcattgaagaatatatcccgaaggaagaaagaaaaacagctgttttcacacaccctcaaatctttgtgctgtcggccaaagaagaagaacgtctgcaggaacaggcgcaacagttggcgcaagcttcttttacggatgcggatcttgccgatgttgcttacacgcttcagcagggacgtgatgcgatggaagaaagagcggccattatcgcttcctcggccgaagaactgcgggacaagctaaagagctgtgcgaaaggatgttatgacaaagcgggcatttataaaggaaaagcgggggcgggtaaaaccccgctgaaatccattctggcaggcgcaaacggcgaagcggatatcgaagagctgataagccgccgagagaatggcaagcttgcggaattatgggtgcagggcgcggatatcaaatgggacggcttatattctgatatcaagccccaacggatgagtcttcctgcttacccgtttgcgaaagagcggtactggatcacggacaaccggccgaaagcagaaaaaccgcaagctgtgccgacggcgcgggtgctgcacccgctgcttcacgaaaatgtatcggatttaacagagcagcggtaccgatccgaatttacgggacaagagacgattttcaccgatcatcttattaaaggcaagccggtcatgccgggcgttgcctacttggaaatggccagggcggcggttgctcaggcagtcaaagggcaaaaggaacgtccttctgtcatccgtctgaaaaacatcgtttgggttcggccgatcgaagcgggaaaccgcccgattgaagcgcaaatcagcctgaacccgagggaaaacggtgaaatcgtgtatgacatttacaccgattcacaaacagaagcaagcggcaggcagatacactgtcagggggctgccggcattctcggcgccggtgaggctccgcaccgtgatataggcgcactgaaagctcaatgcggtcgcagcatgctgacttctgagcagtgttacggtttattcagcaaaatcggcattgactacggtcccggacaacaaggaattcagcacattcatatcggaagcaatcaagcattagctgagctccgtctgccttccttcctcgaagaaacggcagatcaatacgttcttcacccgtgtatgcttgattcagctttgcaagcgacaatcggactgaagctgcatgcaggtgataaccagctgtcactgccgttcgcccttgaggaactggacattttcagcccgtgcacgacaagcatgtgggcgtatgtcagctcccggggaacggatgaaaaaatacagcggctggacattgacttatgcgatgagacaggccgcgtctgtgtcaggattaaagggatttcttccagaatgatggaaggcccggcgccggaaacatcattaaatggagcaaaccttctggctccggtatgggatcttgcggaattccgtgaccaaagcccggcatataagacggaagaggttgtctttatcgcaggggatgaggaaagcgcggcttttcaattgcatcatccttctgcgaaacggcttcatatcaacccggaggatgaaatagaggctgttgcggctgaaatgaaagcaagagggtctttcgggcatatcgtatggatcgctccttttcacagcgatgatgacatggtgaaagctcaagatgcgggcgtcatccagatgtacagagtgattaaggcgatgcttgctttaggatacggaggcaagcgaatcagcttgactgcagtcacaataaaaacacagtccgtacagccggcggacatcattgatccggctcatgcaggcattcacggtttgatcggttcgctcgcaaaagagtatccgaactggcaaacacggctgattgatgccggatgtccggaagatgtttcaaaggcggagctgttctcagcgccgtttgatgagcaaggcaacacttgggcgtaccggaacaatcactggtacaaacagcgccttattcctgtacagcagccggtgtcaagccggcccgcttaccaaaaaggcggcgtttatgtcgtcatcggcggcgcggggggcatcggcgaggcatggagcgaatatgccgtgaaaacgtatcaggcgcgagtcgtttggatcggcagacgaaaacataacagcgccatccaggaaaaaatcgacagactcagccaatttgggccggcgccgatttatattgaagctgacgcggcaaatccggatgagctcacacgggcatatgaaacgattaaacgcacgcacccgcaaattaacggaatcatccattccgcaattgttttagaggatcagagcctggcgaatatgccggaaagtcgtttgaaaagcgtgctcgctgcaaaagtcaatgtcagcgtgaatatggcccgcgtgttccaaaatgagccgctggactttgctttgttcttctcatctgttcaatcatttgcacgagcggccggacaaagcaattatgctgccgggtgcagtttcaaagatgcctttgccgctcatttggctcaagtccggccgtattcggcggcagtgatgaattggagctattggggcagtgtcggaatcgtatcatctgccgaatatcaagaacggatgaaacaggcgggagtcggatcaattgaagcgcccgaagcaatggcggcgcttgaacgattgctcggcggcccattgaatcagttcgtcatgatgaaacaggcggaagagccggaggaaaaaccggaagaaatgatagaagtataccctgaacatcacggctcggcgatgcaaaaactgcgaagctatcagcctaaagtaacaagacatgtacaacaattgagttaaggaggggacggctttgcaaaacactgaagatcttctttacaaactattggcaggccagctgaaatctgtcggattttttacggaaaacgaaacgcagcctgtcatgcaggggttttacggcaggtggctggaagaaagcatctccatcttggtgcaaaaaggctttttgaaacagtctggcagtacgtatgtgttaacgggtccgatagagcgtgcggacgttctgtggcaagaatgggatgaaaagaaagctcctttactcaaggacagcagcaaacgggcgatgatcaccttagtggagaccgctctcagagctttgccggatattttatccggcagagtttctgccactgatgttctgtttcctgattcctcaatggaattggttgaaggaatctataaaaacaatgaaacggcagactactttaatgaggtgctcgctgacacattgacggctttcattgaagaacgcctgaaagaagacccgaacgcggaaatccggatattagagatcggagcggggacgggcgggacgagcgcggccgttttcaaaagattaaaagaggtcaaacctcatgtgaaagaatattgctacaccgatctgtcaaaggcctttttcatgcatgctgaaaaagaatacggtcccgacaatccgtatttgacttataagcggtttaatgtggaagagcccccggctttgcagggtatagaggcgggtgcatatgacgcggtaattgcggcaaatgtgcttcacgcgacaaaaaatattcggcggacacttcgcaatgccaaagcggtgcttaaaaagaatgggattttgctattaaatgagatcagcagccattcggtttattctcatctgacattcggtcttttggaaggctggtggctgtatgaagacgccaaactgcgtattcccggatgccctgggctgtatcctgaagcgtggcagtctgcgctggaaagcgagggatatcggtacgttacatttatggcggaatcgtcacatcacctcggccagcagatcgtggcggcagaaagcgacggcgtcatcaggcaaaagcagccggacgcgccggcggttgaagaaattgcggcttccaaagagccggctgatttcacagaaccgtctttctcagtcacagaccggacggtgcaattcataaaagaaacgttagccaagtccataaagcttgctcccgagcgcattcagccggaaaccagctttgaaaaatacggcatcgactccattttgcaggtgaattttatccgtgaactggaaacattgacgggcgagctgccgaaaacggtcttatttgaacacacgaatacgaaagaacttgccgagtatttgctggaaacttacccggataagctgcaacaggcattcggagccgatcaagcgcctcctgaaacggagcatccggaacctgcaatgaatgaaccggtgccgcttgtcacggaaacgcggcgatttatcactgaacaaaaagagccaaaagcgccaaagccggaaacagaaaacgtcaccgataatcgctcagatcgtgacgacattgccattatcggcatcagcggccgctatcccgagtctgaaaccctcgatgagctgtgggagcatttaaaagccggagacagctgtattacggaagctccggaaaacagatggaagtccggtcttctgaaaacgatggcaaaagaaacacgaaaagaagaacgcaaaacacggtacggcggatttctgaagcatattgacgcttttgaccatcacttgtttgacatccgggaagaccatgtgatggagatgacgcctgagctccgtctaagccttgaaaccgtatgggaaacatttgaaaacggcggctactcgttagaaagagtaaacgaatggcaggaatcagacagcgggatcggtgtatttatgggcagtatgtacaatcaatatttctggaatatcccgtcattggaaaaagctgcactcagctctaacggaggggattggcatatcgccaaccgcatttcccactttttcaatttaacgggtccgagcatgggcgttacgaccgcatgctccagctcactgagcgccattcatctcgcctgtgaaagcctgaagcttaacagctgttccatggcgattgccggaggggtcaatctcacgcttgaaccgtctaaatatgatgcgctcgaacgggcgaatttgcttgagcagggaagtgaaagcaaaagcttcggaaccggcacgggcctgatgccgggagaaggagtcggagcagtgctcttgaagccgctctccaaagcggttgccgacaaagaccatatttacgggatcattaaaagcagcgcgttgtgccatagcggcggaaggcagatgtacacggctccggatccgaaacagcaggcgaagctcatggcggcttccattgacaaggccggaatcaatccggaaacaatcagttatgttgaatcagcggcaaacggctctgtattgggagatccgattgaggtcattgccctgacaaacgcgttctcgcaatataccgataaaaaacgattttgcgcgcttggatccgtcaagtcaaatctcggccatttagaggcggcctccgggatgtcccagctcgcgaaagtgctgctgcaaatggagcgggaaacattagttccaaccattaatgcaaaaccgcaaaatccgaatatcgcgcttgaacaaacggccttttacctgcaggagaaaaccgagtattgggagcgtctgaaggatgccgagacgggagacatcataccgcggagaagcatgatcaattccttcggggcaggcggggcatatgcaaatctcatcgtagaagaatatatcaatccgaattctaatcatgcccgtcacggcaatgaggaatatattttccctgtgtcagcgaaaacaaaatggagttttgaagcctatcttgagagactggcggcctttttagaaaagacgccatctcttcatccggccgccatcgcatccgcgctgcaaaaaagaacgcatcatccggagtatcgggcggcatttacggctgcttccgttcaggaactgtcggaaaaactggccgcttaccgcatggatcagcggaatctcaatttctccgattctgatatcggccggcgtgcgcggcaatgggaaaaaggagagaatatcacgtttgatcagttgcagcaagagcacgccgttcatctgccggcctacgcttttgaccacgggacttcttttcatttcggtgaatcagaaaacgctgccggcgttcaggcggtatacagtgatgacgacccatacgtgaaagggcatcaattcagcggagaaccggtactcgtcggcgctacatataacagtctggcagtcgatcatttttgtgatctttttcctgaagcagagggaggacatattaaaaaactgaattacgtcagccccattaccgtaaaaaaaggcgatcgcatcgagctgaaaacagaatcgaaacaaaacggggatggatttgaactgagcataatgcaccgcagccgcacgtctcctgattggagcatagcggcgtatgccgagtgcagcccgtatccgtttcaaaagcagcacgcggatctggcggccattcagcgctcataccgggaagtgggccggatagatgagttatacggagacggaacgggaaccgtcgtgtggggagaagaatttaaaacgatcacccgcctgtacaaaggcactgatgccgttttagcgaaagtgaacctgaacaatagcgactcacaacaagcgcatcattatgccataaatccgttaatcgccaacagtgcttacttggcctcgctttctttattggaccaaacagaggcggaaagctatctgccgttcggcattaattccgtcaccttcagcagcccggaaaatcttaccgattgctggctgcacatcaagctggccaaacaaacgggggaaatgattctgattaacgcagatgtcatcagcagccgatcggaagtggtgatgcgttttgaaggctatgccctgaaacggttccgcccgaaaaccgaacagatgaatcagccggcccgaacggctgttaagaatgcgggagcaccgatttctgccggcagtctgacagatgatatccgcagctacgtccttggcaagctcgccaagatgatggatgaacccgcgtcctctcttcgttctgacgcgaatatcatggaattgggacttgattcagcgagtctgatcgggctgacaaaagagatcggccaagaggcggacatcgatgtgaatccaacattgtttttcgagtatccgacggcggaggagctgacccgccacttcgcgtcagcatatgagagcaagttttctcaattgcttgccgatcataagcattcagaagaggctggggtcacggaaacagaagagcgcactttaccgaagaaacagcatacgccttgtgaaaacgccgatgtcaagcaaggaatcgcgattatcggtatgtcagctcagtttccgcaatccccggatatccagtctttttgggggcacatcgtaaacggggatcgctgtattaccgaaattccggcggaccgctgggactggcgccgttacgccggcgatgagaatgacacgagtctcagatggggcggttttattgacggtgtcggagaatttgacccgctctttttcggaatttctcctaaagaggcatcacaaatggggccggagcagtttctgcttttgatgcatacatggaaggcaatggaggatgcgggcctgacaaataaggcattatcaagcaggacgacaggcgttttcgttgccgcgggcaacagcgatccgaacaatggaacagccattccgtccatcattccgaacaggatatcatatgccttgaatttacaaggaccgagtgaatattacgaggctgcctgcacgtcaacgctggtggcattgcacagggcggttcaatcaatccgtcataacgaatgtgagcaggctgtcgtgggcgccgccaatattctgcaatcgccgaaaggttttatcggttttgactcaatgggatatttaagcaaaaacggccgggcgaaatcgttccaaaaagatgcggatggctttgtcagaagcgaaggggcgggcgtgatcatcatcaaaccgcttgaggcggcaattgaagacggcgatcatattcacatggtcattaaaggaacaggagtgtctcacggcggtaaaggcatgtcgcttcacgcaccgaatccggcgggaatgaaggccgcgatgaaaaaagcgtacgaagacaccgatgttgatccgcaaaccgtcacttatattgaagcgcacggcattgcctccgaaatggcagatgcgctggagtttaatgcaatcaaagcgggttacggcgagtctgcaaatcaagaggaaagcacgccttgttatatcagcaccgtgaaaccttgcatcgggcacggcgaactcgcttccggactggccgcccttataaaagtagcgatggccatgaagcatcataccatcccgggcattcccggatttacagctgcaaatgagcaaatggctattcaaaaaagccgcttccgtttcaccgaagacaatcaggaatggacacagctcaccgaccatacgggcagaccgatcccgcgccgggccgcaattaacagctatggcttcggcggcatgaatgcgcatgtcgtcttggaacagtacagcccgagccataaagacaaagaatctgagcatgacccgcagcttatcgtgctttctgctaagagcgaagggcgtcttaaggcggccgcaggtcagctggctgattttgtgcaaactggagatactccgtcattgcgggatattgcttatacgcttcagaccggccgtgaggcgatgaactgccgcttggcactcgttgcccgcaatcaagatgaattgctggaaaaactgaaagagtacagagcattttccgaagaaagcaatggaatgaaaagcttctttacaggcagtcagcagactggatcaggagatatcggcgttttactggaagggactctcggtacagtcgtcacggagacgctgttggctgaaaacaatctggaaaagcttgcattttgctgggtgaaaggagcggatataccgtgggacagactccaccaaggcgaatctgttcaaagagtgccgcttccgacatatccttttgaacaccacaagtattggaacggcggtcagccagaagagatcagccttgcaccggtttcccaggaccctcagctccgccgcgagagcgcagctgacattgtggctgacattttggggatgaaggcagcggaaattgatcaaaataagcccctgactgaatacggattcgattcaatctcctgtattcagctgctgaaaaaacttgaggacggagacagccgcatcagtctggaagctcttcagaaatgcagcactcttcaggagatcggcatgctgttaaaaacgaaccaaccgcatgaggcgggccggaattttcccgaactcgtcaagctgaatgaaagagaaaaaggccgtcctgttttttggtttcacggcggaacaggaggcgttgaagcataccagccattcgccaaaaagagtcagcgtcctttttacggcatccaggcaagaggtttgacagggaaagagccgctgcaaggaatcgaagagacggccgcttcttatatgagaatcatccaagcggtacagccgaaaggcccttatgacctcggcggatattccttgggcggaatgcttgcatatgaaaccgcgcgcctcttgcaggaggaaggtcatacagtaaaaagcgccgtcatgatcgacaccccgtacagtgaaaaatggaaagaaagaaaaccatctgttaagtcagtcatgctgcaaacgatcaatacgatgcttacggcatatcttaagcctgaaaaccttgaagaggcattaatcagcagagaagacattaccgtccaggctgaggaagaagaagtattgaaagaattgatcggccttgccaaaaagcgcggtctgccaaaatccgaagaagcgatccggatgcagctggagcaaatgatgaagacgcagctcgcttacggaatggaagagtatgacatgaagccgctgcctcatccggaagcgctgcaatgctactacttccgtaataaaagcggtttgttcctcggagatcttgaacgttatctgacagcagaggaagaacaaattccgttagaccatgatgcgtattggaaagaatgggaacaccagatgaaacactttcacctgctggacgtccactcctccaatcatgtcacaatgctgtcggaaccaaagccgcaaaacgccattaaggcattctgcgaaaaactgtacgcaaacaaaggaacgataagcgcaaatttccttaaatctttcagaaaaaagctggacgaaacaaatgagttggtaaaacggtaatagagaacggccggagcaatccggccgttttttttatacatagaactaaattcattatgtactaaatatttactattatattgatttcctgtttataagacattaaaaaaacccccgataaacagggggcgatattaaaatctgacaggcaatgtttcaagccctctcaaaaacacgttttttctccatgttacatcctcgggcgcgcctttcagctctatattcgggaaccgttttaaaagcgaagtaaaggcaatggatgcttccatccgggcgagcggagccccgagacaaaaatgaatgccgaatccaaaagagatatgacggttcggtgttctcgctatatttaatgtatcaggatcatcgaaatattccgggtcccgattggctgaaccgatgccgataaatatcatatcgccttttttaatagaaacatctttataggtgaaatcttcaagcgcccatcgattcgccatcatgatgacgggagaggtgtaacgcaaaagctcttcgaccgccgtctggatattttcgggctgccgctttatcttctccatctggtctttgtgcagaagaagcgccagggtgccggagccgagaaggttaaccgttgtttcaagcccggcaacgactaacaaaaacagcatggaatacagctctgattcactcagcttttggccgtcctcttcagcgtaaataagcttggttgtcagatcttcagccggatgttttcttttttcttcgatcagtgttttcatatattgtttaaattctttgagagcctggttggtcgcatcttgtccgctttctgacgtgtcaaccatcgcgttagtccacacttgaaatttggcgcggtcctctttcgaaattccgagcagctcggaaatgacgataaacggaaggggtgccgcgaaatctctcataatatcagggtctgcttttttttccatttcatccagcagctcttctgtgatctgctctatcccggtgcgaagctgctcaatcatccggggagtgaacccctgatgcaccaaagatcgaagacgtgaatgatccggagggtcttttgccagcatatgctctgagacaaaatcgatatcttcgctgacattcagctttgcgatcagctccttcggcatgacccgtcttacatctctcgtaattctgccgtcttttaaaaacgccatacaatcatcataacgcgtgatgagccatgccggaaaggtgcctccgaaacgctgcagttcgaatttatgtatggggtcctgctctctgaatctgcttaaaaccgcaaaagggtcttcgtgaaactcgggtgagtgtgggtgaaacattgttttttccatctggatttccccgccttcatgtttttgaaaagacataaccaacagccggtgcctgccgaccggacggcattcctccttttatctgccgaagacactgatcacaacggctcataagtatgtctaaaatatataaggaaacagaagccggttcaatagataaatcgtaaagccgccattttcgttaattatcaacaaaacagcaaactttttttgccaattcatcatgtgtgttaaatccggctaatatacatatttacgcttcatatcaacttcttaaggaggatgtgaatgaatgcgtttatgaaatgggcggcaagtctgcttttggtgatctctcttcagttcggccttacgggcgccggcatccattcggacagtgctgctcgtgccgcatcccgatacgatcaggtgctgtatttcccgctgtcaaaatatccagagacgggaaatcatataaaagacgccatttcggcaggtcattctgagatttgtacaattgatcggggcggagcggagaatagaaggaaagaatcattgaaaggaattccgacaaagcccgggtttgaccgtgatgaatggcccatggcagtctgcacagaaggcggggcgggggctgatatcagatatgtaaccccgtcggataaccgcggggccggttcatgggttggaaatcaaatgagcggctattccgacggcacgagagtattatttatcgttcagtaacttctccggttcgccggagtttttttatgctttgaaaaagcggcacgccggctggacatatgaaatggcaaagagtaaacttatatgttggaatcagcataagaaaggattggatcacattgacagtgactacataccgaaatattgcacttttacttctttgtttaacagcgggaattgtggatgtgatcggttatttaagcctgggacatatctttactgccaatatgacggggaatatcgttctgttcggcctggcgatcggcaattcatggcaccttgccgtactcaaatcgttaacctcgttaatcggatttattgccggcgttattgccgcggccctgcttgtgggcaataaaaagaaatcattctggccccctgcggtaactgccgctttagctattgaaggagctgttttgctgctgtttgctttgttctcttgcttttttgcagatgccatttctgtttatgtgctgattatgctgctcagcttcgcaatgggaatgcagacgacagccgcgagaaaacttggtgtagcggggatttccacgaccgtattaacgggaacgctcgctaatttttttgaagatctcaccgcaaggttttacaaagcggacaagcggaagcagtttacgagagatgctgtattgcgcgcacttgccttggttctgtattgctttggggcggtcataggcgcttttgccgaaccggattataagtttgccgtgatctggctcccgattatcattattttaggcattatgctttgcgcattcacgatgttccacggatattctgaagaaaaaaaccaataaaaaaacgccgctgattcagggcgttttttctttttattgctctttccgggtcccgattgtatacacggcccgatctgtatgtacctttaatccgtcttgctccttttggatggtaatgtcgccgagcagaggaatttcatacgcatcttgaggaagcgggacatttccttcctccgtataggttgtgccgtgcccttttaagacgagttcttcatccgctacatagtcatcgggatggtttgtccgccggacgagaacatcatcaaggtgaagcatgatccggtccatatcagaaatctcgtttcggctgtctgtcagctctccttttctgatatcaagcgtttgtccgatctgtttttgcagccattcagacaattcggtgtttgtaagtgccattgtgattcctccttttatctacaccatacttattccctatttttttagaaatacaccgccttgcattgatctttttttctgacagccggttctgacctgttccgagttccttcattataaatgtttcatctattcacctgaaaaacggagtcatctgccggtgcagacgaccccgttctcatgataaaaaggttactctttcggcacggcgttttcagcgttcactgcgcccgctccgtaaatgttcggatcttcatttgtccattgatccggactttgtttgatcaatgttttcacttcgtcaggcgaaagctgcgggttttgctgaaggattaaggcagcgatgcccgcacagatcggagtggccatggacgtgcccgaaagactgaaatacaaggagcctactcggtttgatttctgtaatttgtcaagatatgaacgcggagaacggagagatactatatcgaccccgggcgcaagaatgtcaggcttctcttttccgtacaccgtcgggccgcggcttgagaaagaagcgaccgtatcgtcctcattgctggctgtatcattgtcatcataggcgcctaccgtgatgaccttctcgctgacaccggggcttgaaatcgtttgagcttccggaccggagttgcccgcggcgacgcagacgacgattccttcattccatgcctcttcaacggccttgacgagcgggtcgtccgtttctttatcatatctgagcgcatctccgcccagtgacatgctgatgattctgatcgggttctttgtgtgttctttattatattgtatgcaccattccacaccttcaatgatatcagccaaggttcctgatcctgatttgtttaaaaccttgactccgatcagatcggcttccggcgccggcccctgatatttacccgaagatgaagcgccgctgcttgcgatatcaccggcgcaatgggtgccgtgcccgttgtcatcatacggttctgtcttttgattgacaaagtccgcaaatccgataatcctgccttctaaatcgggatgctgatagattccggtatcaataacggcgacggttacgccttttcctgttaatacggtgccgttacgggtcacttcttttgcatgagacgattcagctgccgtatcaaggagagcttttacttcacggtttaaatagattttacgaatatcccggcattgcgaaagaagcatgtgaagggcggacggagtgacttcggcgctgcagcagttgattgtttgaaactgcttttttatggtgcagcgtttttcttttgataagacctgtcctgtgctgtgaaaaccggattcatggcagccctcttcaaattcaatgatgactgacattttctttctgtttttcacctttttttcgaaaaaattgtgcaaaaagcaaggtgtccatttgaaaggtttatataactgtaatacgttttctctgagcggccagtccagcttatgagcatttgaccgcaccatttgtaccattgagtaaccaaacatatatacttttcctcccattctggcgattctctctataccatatgaacaggccgtatgttcggtcagtttgtttgtccttcaggagagctggttacttgcggctttttcaggagaagaaatcgagttggatcggaacgtttgttcgtttatgatgaatccggcggaaggaggtatacacatgaacatcatattgagacattccttggaaaaacagcttccgattgatattatatatatgaaaaaagacggctctatttcaaaacggaccattatgataaaaaaaggggatgagcgggctgtaacggcattttgctgtacaaaaaggcagatgagaacttttttgacgggctccattctgtcctgcgcatttgcttcgggaggcggatattcatttttaaaagcgtattcttgatgccgtccgtttccggccgtgaatctcccgcccctgaaaattcgggcgttcctccctttttttttgccctctctcaaccttttttcactgatgcccggcatttgagcgcttgaaccgtgacaatccattgatttttcgaaaccgggaagtttttcactgatgataatgttaatagaatgttaagataagacctattgacaaaaatccatataatgaatatttcatttttcagaaaggagcaaagaaggagagctgatgaaaagaattttacttaatgtcatcattatcgtagcaatggtcttactaataagatgtgctcattatgcgtcagaccctgatccctcgaattcttctgatacatacacagattttaaagatctggctgaacatgaagaccccgatgattatcatatatcgtacaataagcgaaaggggagccccgtattgatcatgtcgccgcacggagggagaattgagggcggggtgagcgagatcgtccgctctttcagggatgattattcaacctacctgtttgagggattaaaagcgcatgataaccagactcttcatattacgagcaccaagttcgatgagccttcagcagtcgaaagcattaagcagcaccattatgttatcgcagttcacggttataaaggcgacgagaaaaatactcttgtcggaggaagcgaccggaagcgggcgaaaaaattggtgagagctctcaaacgaaacggatttcctgcagaattggcaacctcaaaaaccggtctggccggggttgacaccgaaaatatcaataaccaggctcaaaccgggcttagtatacagcttgagatcagcagagaacagcgggaagcgttttttgataattttgattaccgcgaaagggaattcacaaaaacggaggaattttaccggtttgtccgtacgataaaaagagtgatcaatcaagagtattcgtgagcttaaaaaaagacaaaccagtgaaaggtgagtaaactgaaaaaaaaggaggtttgtcccttggcaaaacatcacttttatttaaaagcaaattggcccggaaatcgcaatgacgtcggcgatattaaaagcggccggctggaaacggctgtgtccattcctaaggaaatggacggacccggagaaggcacaaatcctgatgaaatgctgcttggagcggccgcgacctgttatattataacgcttgcggcgatgatggaaagaagcggtctggataaagaagatctacatatggaatctgaaggaattgtagacgtcacgaacggtgtgttcacgtaccagaaaatcattcaccgcccgtttatattattaaagccggatgcagccgaaacggactttacgctcgccaggaagttagcgcaaaaagcggagtcctcctgtatgatttcacgagcgatccaaggaaacgtggagatggagcttgaggttgaagtaaaagctgcccgcgcttgacgagttcaaacggtcagctccgggccgtttgattttttttagctttttgagacttggaacggttcagcaggatgacgcccgtgatgacaaaaataagcccgatcatcattttggctgtcatggcttccttaaaaacaaaaaagccgacaattgccgttaaagccgtgccgacacctgaccatgtcgcgtatgcggcggataaatcaaggcttttcaaagagaagctcaaaaacataaaagaggctccgattccggcaatgacgccgagagcgggccataagtgcgtaaaaccgtccgacagcttcagcatcgtgcttccaaacacttctgatacaatggctaatgccaggcagagtaatcctttcatatcatgcttctcctttctaccaattcatcagaatgacaccggccaataagaatacaagtccgatgacggcctgcttgtccagtttttcatgaaaccatttcgctccgataatggatgcgagcaccgttccggctccgctccatgttgcataggataagctgagcggaatgagattcagtgtcagtgaaagcatataaaaggccaatgaatagcctgccactacaagcgcgctcggcaaaaaccgcgtaaatccgcgggagaccttcagcatggccgcgccgattgactctgataaaatagcaattgtgaggaagatataacccagaatcatatcaaatccccctctcatcataatccttatgccttttgtttaaggcagtaaaataaaataatatccgaactttgcccgccaagtcaagacattaggcctatataaaaaggcccctgaaaggagccctttttgattgtcttagtagtaatacggatagtaagggtagccgtaacctccgtacaaatacggattgaacaaagcgcttccgacaagccccccgacaagccctccgacaaacggtccgccgtaaaaaccaaacggccgtccgaacccgccaaaccaagggcggccaaaccaaggccggccaaaaccaaaacccggccgcccgaagccgaatccgaatccgggacgcccgaacccgaagcccggccgtccaaacccaaatccgggccgtccaaactgtctcatatcactatctgcttcgtatgtgtattcttcattcataatttaggtacctccaagaataaatttgagatgataacagagtattcagcccaccaatttttgattgggcgtttatcaaaaaataaaggagtgatcttttgtgggcctgtatcagtccgattggtcaaaaaaacctccgcacacacacgcataccgggctgttacggatgtagtgcaggggcattaccatgtgatcgaaggcttttcgcagccggagaacggcagcaatacagatgagcatacacatttctatacgggcatcacctcgtttgaaaacggccattttcataggtattacggcatttccggccctgccatcccgagggttgacggaacacattaccatgagctttcagagaccacctttgccgcctacaatgagccgattcagatccagcacggcggcgtcgtttacgatccgcgggagaaaggacggaaaacgcaccgccatacgctcaaaggaaaaacgagagaggttgtcggaaacgagccgatcgggtggtagcggatgtttagcgctcaggaaaaagggcaaaatggataggtgcctgaagaaatgaatgctataattagggggagatttataaaagagagtgatacatattgaaaaataaaaaacagcctgtcgtcatactcgtcggaccgacggcagtcggaaaaacaaaactaagcatcggactcgcgaaaatgctgaatgcggaaatcatcagcggagattccatgcaggtatataaagggatggacatcggaacggccaaagtcaccgaagaagagacagaaggcgtgccgcatcacctgattgatattttggagccgtccgacactttttcaacggcagattatcagaaaatggtaaggggaaaaatcaccgagattgccggtagaggaaagctgccgatgattgtcggggggacgggtctgtacattcagtccgtgctgtatgactatacgttcacggaaaactccggcgaccctgtattccgggagcgcatggagaaactggcggctgaagaaggggcggaagcgcttcatgccaagcttgcggcagccgatccggaagcggcggcagccattcatcaaaacaatacgcgaagagtcatccgcgcactcgaaatcctgcatgtatcgggaaaaacaatgtcagagcatcttaaaacccaaaaacgggagctgctttacaatgcggttcttatcggtcttacaatggacagagaagtgctgtacggccggattaacgagcgcgttgacctgatgctggaaaccggccttcttgacgaagtaaagcggctgtatgatatgaatatccgggacagccaatcgattcaggcgatcggctataaagagctgtatgaatatcttgatggaaaagtgccgctccctcaggctgtggagcaattaaaacaaaattcaaggcgatatgcgaaacgccagctgacctggtttcgcaataaaatgcccgtttcatggacagatatgacgccgcctgttgatattgagcagaaaaaaaaggaaattttcgagtgcatagcaggaaaactggaaatttaatcgaaacagtattgtattgagaaccaaggaggacgaaacatgaaaccgattaatattcaagatcagtttttgaatcaaatccgaaaagacaatacgttcgtcacggtgtttttactcaacggctttcagcttcgcggccaggtaaaaggctttgacaactttaccgttttgctcgaaacggaggggaagcagcagcttatttataaacatgccatctccacgttcgccccgcaaaaaaacgtccagcttgagcttgaatagactttttgacaaagaccatgaacaatggtctttttctatgcgcgtctgtatattgcaggccgtatatcggaaagataaaagggggtacggaaaatcgtgttcgaaagtgaaaatgaactgagaagaatcaggattacgctcgtttggatcgctgtttttttgctgtttggagcttgcagcaatcacgagacggtggtgacggatgatgacggcggcttggcggatgccgaaccgcagacagaaggcgtggtgcagctggaacataatcgtttcggcattgtcgaggacggttacttaaaaatataccgctatgatgaaaaaacggataaaatcgaactgaaaaaagaaacggcgctggatgagcttgaataaatttcacaagcgttcgaatttacaaagcgggccgcacaagctacactaagtactgacattgatcatgcagagggtgagacgattgaaacacaaggtgataatcaaccattgggaagaaacttgtgaagatgattcctgctatgaatatggaaccagcatcatcgttgacggcaaagaactgatcagagaggcttccatcacaagcgctctgaaagccgtactgaaagaaatcggtgctgatgtggagattgaagaaaccgttgaaagcgaaaaaaaatgtgattcttacaaaaaataagaataaaagtctagactactaagcagttttttttcatgttatgatagacatcggcttacacatgacaccttgagtaggatgagagatgattctcgttctgctctcttttttgggcgttaatcgggccggagccaaagtccgctctttcaaaaatatgaattttttataaatcgatctcaatatgttgtgtttttctgagaggttagtatactatatatagtgttaagagattcattatttttgataggtcgtgataaggatggttcaaatcatatttgattcaaagacagggaatgttcagcgttttgtgaataaaacagactttcagctgatccgcaaggtggacgaaacggaccacgtggacactccgtttgttttggtcacctacacgacaaacttcggtcaggtaccggcatcaacacaatcatttctcgaaaaatacgcccatctcttattaggagtcgctgcgagcggcaacaaagtatggggcgataactttgcaaaaagcgccgataccatctctagacaatatcaggtgccgatcttgcacaaatttgaactcagcggcacatctaaagacgttgaattgtttactcaggaggtagaaagagttgtcacaaaatcaagtgccaaaatggatccagttaaataacgaaatcatgatccaacaagatggaaaattccagtttgataaagataaagaggctgtacatagctattttgtagactatatcaatcaaaacacagttttctttcacgatttaaaagagaagctggattatttgattgaaaaccaatactacgaagaggaattcttaagcctttattcttttgaagacattaaagaagtgtttaagacagcttacgctaagaagtttcgttttccttccttcatgagtgcgtttaaattctataatgactatgctttgaaaacgaatgacaagaaaaaaatcctcgagcgttatgaggaccggatctcaatcgtcgcgctgttctttgcaaacggcgacactgagaaagcaaaagaatatgtgaacttgatgatcaatcaggaatatcagccaagcacaccgacatttttgaatgccggcagaaaacgccgcggagaacttgtgagctgtttcttgctcgaagtcaatgattccttaaacgatatttcacgggcgatcgatatttccatgcagctgtctaaattgggcggcggggtttctcttaatctgtccaagctccgcgcgaaaggtgaagcgattaaagatgttgagaatgccacaaaaggcgttgtaggcgtcatgaagcttcttgataacgcgttccgttacgctgaccaaatggggcaaagacaaggctctggcgcggcgtacttaaacattttccaccgcgatatcaatgactttcttgatacgaaaaagatttctgcggatgaagatgtgcgtgtcaaaacgctttctatcggtgtcgtcattccggataagttcgttgagcttgcacgtgaggacaaagcggcttatgtattctatccgcacacgatttataaagaatacggccagcatatggatgagatggacatgacggcgatgtatgaggaacttgtcgacaacccgcgtgtcaaaaaagaaaaagtgaatgcgcgcaaattgcttgaaaagcttgccgttctccgttctgagtcaggttatccatacattatgttccaggacaacgtaaacaaagagcatgcgaataaccacgtatcaaaagtgaaattctcgaacctttgctctgaagtgcttcaggcgtcacaggtttcggcttacacagattatgacgaggaagacgaaatcggcttggacatttcctgcaaccttggttcattaaatatactgaatgtcatgaaacataaatcgattgagcgcacggtgaaactcgcgacggattccctgactcatgtatctgagacgacggatatccgcaacgcgccggcagtcagacgcgcgaacaaagcgatgaagtcgatcggtttaggcgccatgaaccttcacggctacctggcccaaaacggcatcgcttatgaaagcccggaagcaagagatttcgcgaatacgttctttatgatggtgaacttttattccatccagcgttcagctgagcttgcgaaagaaaaaggcgaaacgtttgagcattatgaaggctccacttatgcaacgggagaatatttcaataaatacatcgaaaaagagttctcaccggcatacgaaaaaatcgctgcgctctttgaaggcatgcacatcccgacaatcgaagactggaaagagctgaaggcgtttgtcgctgaaaacggcatgtaccacagctacagactgtgcatcgcgccgacaggctccatttcctacgtccaatccagcacggcgtccgttatgccgatcatggaacggatcgaagaaagaacatacggaaattcaaaaacgtattacccgatgccggggttagcgtctaataactggttcttctacaaagaagcttatgatatggacatgttcaaagtggtggatatgatcgcgacaatccagcagcatatcgatcagggaatcagctttaccctgtttttgaaagatacgatgacaactcgtgatctgaaccgtattgatctgtatgcccaccatagaggcatcaaaaccatttactatgcaagaacgaaagataccgggcaggacagctgtctttcttgtgtcgtttgattaaaggagagttaacagtgacaaaaatttatgacgcagcaaactggtcaaagcatgaagatgatttcacccaaatgttttacaaccaaaacgtaaagcagttttggcttccggaagagatcgcattaaacggcgatcttcttacttggaagtatttgggtaaaaatgagcaggatacgtacatgaaggtgctcgccggcctgacactgcttgatacagagcaggggaacacaggcatgccgattgtggccgagcacgtcgagggccatcagcgaaaagcggttcttaatttcatggcgatgatggaaaacgcggtgcacgcaaaatcatattcaaatatttttatgacgcttgctccgactgaaacgatcaacgaagtatttgaatgggttaaacaaaataaatatttgcagaaaaaagcgcaaatgattgtcgggctttacaaagccattcaaaaagatgatgaaatttcactgtttaaagcgatggtcgcatcggtttacttagaaagcttccttttctacagcggtttctattatccgttatatttctacggacagggaaaactgatgcaaagcggtgagatcatcaacctgattcttcgtgatgaagcgatccacggtgtatatgtcggactgctggcacaggaaatatacaataaacaaacagaagcgaaaaaagcggaacttcgcgaatttgcggttgagcttttagaagagctttatcacaatgagcttgaatatacagaggatctctacgaccaagtcgggctgtctcatgacgtaaagaaattcatccgctataacgccaataaagctttgatgaacttagggttcgatccttactttgaagaagaggatattaatccgatcgtattaaacggattaaacaccaaaacaaaatcacatgatttcttctccatgaaagggaacggctacaaaaaggcgaccgtagaaccgattaaggacgaagatttttattttggccaagacgaagagcagatataatatctgctcttttggcttgaatggagaggtaagacaggaggaacgggcatgaataaaatggatgaaatcatcttggctgcaccgcggagtgacgtctttcaaaacgaaatgctgacatttcagggagtcaacagcgaggatgaacgtatcataaaaattatggctcaaattgaggcgcatttttttgaaatcagaagaggcgacgcggaagaggacccgcgatttaaacagccgattccgtatgtcgtcatccgccgtgatgatgaggtgtttgtgtatgagcggctcgcgggcggaggggaatcgcgcctccataataagctttctctcggcttcggcggacacatgaaccctatggaaggggcggcttcattttcggaagtgctgaaacagaacaccgaccgggagctggcggaagaactgtacattcgcgaggaggacaaacaaaacattgtcacactcggcttgatcaatgatgatgaaaacgatgtagggaaggtgcatatcggcatcctttctgcgctccagttagcgcctgcagcacaagtcgaagtgaaagaaaaagatcaaatcgccgggcgctggatgaaactgagcgaactgaaagaggaaaatgtgtatcagcgtcttgaagcttggtctcagtttgtcgccgatatacttcaataacaaaaaacccccgttcgtcccaaaaaagggagagcaggggttttttcgtttagtcttgcacaatgaaggcatcaaatccggctttttcggcccgcgctgccaacgcttcagcataatctctgaaagagaatgcgccgatctgcactttaaataagccgccttttggaagcacaatcgcgtcaaaacctttagacaccgcatcggcggcaagcgcatcagcatttgctttcacgttgaatgcgccgatttgcactttatataagtcagcctttttttttagaccgaaagcttgctccaagcccttggcatgtcctcttgcaaggctttcaataaaactggctgttttcagtttgtttgcatcagctgacgtatcaacaaaaccattctccgtcaaaatcgccggcatccttgtctcccgcagcacatggaagttggctgttttttttccgcggtcattaaaacccgatgcttgaattacttgcgtgtggacggctgattggtaagtcgaggtcggcgctccgacaccggggtaaatatagctttcgaatccggttccgcctcctgagttaatatgaatggataaaaaataatctgcgccccagctgttggcggcatccgttctttccgtcaggctgaccgtcttatcgcttgtcctgctcatcgtgacagaaactccttcatactcattcgtcagaatcgtgcgcaaagccagtgcgatctccagcgtgaccgctttttcctgaagtccgtttccggttgcacctgaatcagttccgccatgaccggggtctataaaaattttaaccattctccatcacctcattacagcatatgatgatgttcaaaaggtgcttgtacggctgtcattcatgaaaaaaatgagagatacacccaacatttcccggaaaataaaaataaatggtttgtcctcccgtttctgctgaatacaataagaaatgaaaaatatttctcgggaaagcgcaggattcaacatcattcccgaagagaacggaaaaagtgacagataaagaggaaaacgggcctcatgatgataggcggatgtcaccgaacctcttcatcatgagtaagataaagagagaacagagaggtgagcatgttggagcgcgctgtaacctataaaaataacggacaaattaacatcattcttaatggccaaaagcaagtgctgacaaatgcagaagctgaggcggaatatcaggccgccctgcaaaaaaatgaagccaagcacagcattctgaaagaaattgaaaaagaaatgaacacattagtgggtatggaagaaatgaaacgcaacattaaagaaatttacgcttggatattcgtcaaccaaaaacgggccgaacaagggctgaaagtcggaaaacaagctcttcatatgatgttcaaagggaacccaggcacagggaaaaccaccgtcgcgagactgatcggcaagcttttcttcgaaatgaacgttctttccaaaggacatctgatcgaagcggaacgtgccgatctcgtcggtgaatacatcggacacacggcgcaaaaaacgagagatctgattaaaaaatcgcttgggggtattttattcattgatgaagcatactcacttgcaaggggcggagaaaaggatttcggtaaagaggcgattgatacgcttgtcaaacatatggaagacaaacagcatgaatttattctgatcctggcagggtactcgagagaaatgacacatttcctgtcattaaatcccggcctgcaatcgcgttttcctatcagcatcgattttccggattactctgtcactcagctgatggacatcgcaaagcgcatgatagcagagcgggagtatcaattaagccaggaagccgagtggaagttaaaagattacttaatgacagtgaaaagcacgacaagccccattaaattcagcaacgggcgctttgtcagaaacgtgattgaaaaatcaatccgcgctcaggccatgagacttttaatgggagaccaatacttaaaaaacgatttaatgacgatcaagagccaggatttacttataaaagatgaggcggcagctcacgaatagacctctcagccggtttgaggggtctcttttttatttctctctttaaaacccgccggatgtgtggtatacgccctgcgggtttggtatgatagtactactgcccaatacgacacagaaaggaacatccatttgaacgaacaggaaggaaaaaaagaaacggtcattttggtcggctgccagcttccgcacatgacagatgagcactttgaacattccatggaagagcttgcttcattgacaaaaacggctgacggaacggtgctgacccggattacgcaaaaacggaacagagcggatgccgctacatacataggcaaggggaaagtagacgagctgaaggcgctgtgtgaagagcttgaagcggatctggttatttttaatgatgaactgtcaccgagccagcttaaatcactcgccactgcaattgaagcgaagatcatcgaccgcacgcagcttattttggatattttcgcaaaaagggcgaagacgagagaaggaaagcttcagatcgaattggcccagcttcaatacgcgctgccgcgtctgagcggacaaggaatcaatctctcaagacaaggcggcggaatcgggacgagagggcccggtgagacaaagcttgaaacagaccggcgccacattagaaaccgcatacacgaaattaacgtgcagctgtcaacggttatccgccacagaagccgttatcgggagagacgcaaaaagaacggcgtgcttcaggctgcactcgtcggttataccaatgcaggaaaatcaacgtggttcaatcaattaacaagctcagacagctatgaagaagatctgctgtttgcaacacttgatccgatgacgagaaagatggcgctcccaagcggctacagcgtccttttgtctgatacggtcggtttcattcaggatctgccgacgacgctgattgccgctttccgttcaacgcttgaggaagtgaaggaagcagacttgatcattcatgtcattgattcatccaatgaagattatgccgggcatgaacagactgtcctcggtctgttaaaagagcttgaggcagatgatattccggtgctgaccgcttataacaaacgtgacgagacacttcctgacttcatcccgacagcgggagaaggccacatcatgatcagcgccagaatcgccggggatgaagcaaaactaaaagcggaaatcgaagcttatttgcgccgagagctgatgatgccgtatgaagttcatgtgcctgccgccgaaggcaaattgatgtcacgcatcaaatcagagaccatgatcgacagcctttattttaatgaagaaaatgaacgctacgaagtctcaggttatgtacaggaagaacaaagcatactcggagaattgaagaaattcatgtaaggaaggtatacacaacatgtttgacacactgacccacggcgctcttttacaaaaaaccgccgaagaaacagaagcggaaatctccgccgttcataaaagaatagaagaaatcagtgaacggaatgaatggagagtcctgcaaagctacagaaaacataaagtaagcgatacgcattttacgccttcaaccggatacggttatgatgatatcggacgagatacactggagaagatctatgctgatgtgttcggaggagaggcggggcttgtgcggccgcaaatcatttccggaacgcatgcgatttcaatcgcgctcttcggtgtgctgagacccggggacgaattgctttatatcacaggcaagccttacgatacactcgaggaaatcgtcggagtaagaggcggggagtattcaggctcgcttaaggaatttcaaatcggatacaatgcagtcgatttaacatcagaaggcagagtggactttgaagcggtccgggctgcaatccaaccgaatacaaaagtggtcggcatccagcgttcaaaaggatatgcgaatcgtccgtctttcagaataaatgaaattgaagagatgattcgtttcgtaaaggaaatcaaagaagatgtcattgtttttgtggacaattgctacggagaatttgcagaagagcgggaaccctgccacgtcggagcggatcttatggccggctccctgattaaaaacccgggcggcggccttgctaaaacgggcggctatcttgtagggaaagccaagtggattgaggcctgctcttaccggatgacctccccgggaatcggaagtgaagccggggcttcgctttattcactgcaggaaatgtatcaaggtttctttctcgctccgcatgtagtggcgcaaagcttgaagggcgcggtatttaccgcctgttttcttgaaaagctcggctttacgtcaaaccctgcatggaatgcgccgagaacggatctgattcaatcagttgagtttcaggaccctgataagatgatcgctttttgccaggcgatacaatatgcttcaccgattaatgcgcatgtgacgccttatccgagctatatgccgggatatgaagacgatgtcattatggcagcgggcactttcgtacagggagcaagcattgaattatcagcagatggacctatcagaccgccttatgtcgcgtatgtccaaggaggattaacctacgcgcacgtgaaaaatgcgatttgcagcgccgtaaatgctttaatggaaaaagagctgatttaggccggttgcaattttcaaagaatttgatgttaagattcctcacattgtgttgacacaaaatataacatcacctataatgagactaagataagaaaaggaggaaattgagatgagtgataacattcgccgctcaatgcctttatttccaattggaattgtcatgcagttaacagaactttctgcccggcaaattcgatattatgaggaaaatggattgatatttccagcgagaagcgaaggaaatagacgattattttcattccatgatgtagataaactgttagaaatcaaaaatctgattgaacaaggcgtcaatatggcggggatcaaacaaattctggataaggcatctgccgaaccggaagaaaaatccgaaaaaacagccaaaccgatgaagcacaatctgtctgatgacgaactcagaaagcttctgaaaaacgaactgatgcaggcaggccgtttccagcggggaaatactttccgccaaggtgacatgtcccgattctttcattaatccgttagcaactgttttgctatatacatttaccttttagaggaggagttttacgaaatggcaaagtacacaagagaagacatcgtaaaattagtaaatgaggaaaacgtaaagtatatccgccttcaattcacagacattctcggaacgattaaaaacgtggaaattcctgtgagccagcttgaaaaagcacttgataataaatgcatgttcgacggttcttccatcgaaggtttcgtccgtatcgaagagtctgatatgtacttatatcctgatctgaacacatttgtaatcttcccatggacggctgaaaaaggtaaagtagcacgcttcatctgtgacatttacaatccggacggcacgccgttcgaaggtgacccgcgtaacaacctcaaacggattctgaaagaaatgaaagaactcggtttcagcgatttcaatcttggacctgagcctgaattcttcctgtttaaattagatgaaaaaggcgaaccgacgcttgaattgaacgataaaggcggatacttcgatctggctccgactgacttgggagaaaactgccgccgcgatatcgtgcttgagcttgaagaaatgggctttgaaatcgaagcatctcaccatgaagttgctccgggtcagcacgaaatcgattttaaatatgccggtgccatccgttcttgtgacgacatccaaactttcaaactggttgtcaaaacgatcgcccgcaaacacggtctgcatgcgacattcatgccaaaaccgctgttcggcgtaaacggttccggtatgcactgcaacctatcactctttaaagataacgttaacgcattctttgataaagacgctgatcttcagctgagtgaaacagcaaaacatttcattgccggtatcgtaaaacacgcgacaagctttacggctgtcacaaacccgacagtgaactcttacaaacgccttgttccgggctatgaagcaccttgctacgtggcatggagcgcacaaaacagaagcccgctgatccgtatcccggcttcccgcggcatcagcacgcgtgttgaagtccgcagcgtagacccggcggcaaacccgtacttggcgttaagcgtattgcttgcagcaggccttgacggaatcaaaaacaaacttgaagcaccggctccgattgaccgcaacatctacgtcatgagcaaagaagagcgcatggaaaacggcatcgtagatcttccggcgacactggcggaagctctcgacgaattcaaatcaaacgaagtcatggttgcagcgctcggcgagcacctgttcgaacacttcatcgaagcaaaagaaatcgaatgggatatgttccgcacgcaagttcacccttgggagcgcgaacagtacatgtctcagtattaatcgctcaatcccttggcactattggtgtcaggggattttttgattttgtcataagattaagaggtcgatattttggtccttgaccaaaatatgaccaaaaaaaattgaagttatgaatctaactccataattgaggccacgtattaattgtaatcccttattcggtttaggatgaaggctacatgaagccaattatgctctaaaattgaaccggccatttttattttcaaaaagcaggagcaggaaattcatcaattttgatacgaagtaaactataaggtttctgtcgtaagtcttctccataatgaaatctagcctgccgatgtaattggttcacgatgacgtataagtatccatccggaccaatcgaaaaagtatccggccataaaattatcggatcatgtgcgatcgtttccattgtgccattcggcagcatctttcgaatactattgttctcataatctccggcataaacggctccttttgcatctgtaatcattccatcagacgcgcctttttctccccaatacgccacataataaagtaaatccatgtccgatatatttctatctctcagggcttctgttgagatagagaacaaatggcggctggtcaggggacaaaaaaataatacctttccgtcaggagagatcgcaataccgtcggatgccagcctaaatggggaagttgaaccatccctgttacgattcatcaaaattttgccttctactttcggtataaaagaggaatccggtgaagttggatttgctccatttaaccgtctaaatgcgtttccggtttctaaatcaacgacgataatagctcctggtcctttggaagaagaatccgttatataggcataacctgcagttccaacacgaaaatcaaatcggacatcattcaggtaagttgttggaaggacaacatcttctgtaaaggtatacactcttctgattgtattggtttttaaatcaacagcgactaattttgccccgcctttaattggttcagaaaaattgggcgccgctgtatctagtatccaaagcgttcctcttccatcagcaactacactttggacactgatgaaagtcattttgatattctcagggttaaccaaattggtttgtaaatcaggataaggctgcaatttatccccaattatttccgcaaccgtaaatttaacatcgtctccccatttcggaaaacaaatgaatatacgaccggtttctgagacagtaacaccggtaggcatagctccataaaatgcataaaccagttctaaatcaccaaaatatttttcaaaaggcagcataggtttcataatatcctcctcaaccaattaaacgggatatcacttatatatgattcgcattttttcaagtgcatgtttcttaataagttttactaaacaaaagatgatggaagtgcttatcatttaataaatcagtcaggtgacacatggggtttttacttaacgtctgtcgaagcagccggcaattacaacatggtacgtcctttggtcggttttaaattctctgaaaaaagagttgaaaaagcagaaaagattttataatatgaaatcaagttagtttgttcgatcaacaaactaataaaaccactttaattgcccatcatgtaaaggtcttaaatgggagggggataagaggctcgatttaattggaggtatataaaaagtgaaagccaagcttttatcctgttcactatgatgaaaatgctctgtgaaagtaaatcgctatcatttttttgaaagcgcttttataaagccttcactggccgataaaattgaagaaatgttataccatttcataatgttccttatgtaaaggatcgaaaaggggaggaaatcatgctcagtgaaaatgtaaagaagatcagcatggttgaaaaagttggatatgcgtctggagattttgcatgtaatttaatttatgcaacagtgtctacttatcttttgttcttctatacagatatatttggtttaccggcagcaacagccggtacgatgtttttagtggttagaatcatcgacgctctcgctgatccttttatcggaacaatagttgacagaacaaatagcaggtttgggcgcttcagaccgtatcttttattcggagcttttccatttgtcatattggcaatactctgttttacaaccccggatttttcggatatggggaaattaatatatgcttatatcacctatgtcggcttgtcgcttacatacacaatgataaacgtgccatatggcgcgttaacatctgcaatgacccgaaataatcaagaagttgttagtataacgtctgtccgtatgttatttgcgaatcttgggggacttgtcgttgcattttttgttcccttactggctgcttatttaagcgatactttcggcagcgaatctcttggctggcagctaaccatgggtattatgggagttataggcgggtgccttttaatcttttgttttaaaagcacaaaagagcgtgtcacgcttcaaaaatctgaagaaaaaattaaattatcggatatatttgagcaatttcgtgttaatcggcctctagttgtattaagtattttctttattattatttttggagtgaattcaatcagtaattcggttggcatctattacgtaacgtataatttagaaagagcggatttagtgaagtggtacggtttgttgggaagtttgcctgctttggtcattttaccgtttataccaaagcttcatcaattattagggaagaagaaattactaaattatgcattattactgaatatgatcggcctcttagctttactgttcgttccgtcaagtaatatattcctgatactttcctttcgattgctggctgctgccggaagtctcactgccgggggctatatgtgggcgcttatacctgaaacaatcgaatatggagagtataagaccgggaaaagaatgggcggtctcatatacgctattatcggatttttctttaaattcggcatggccttgggaggggttgtaccgggtttggttttagatcagtttggatatgtggcaaatcaggtgcaaacgccggaggcattgacgggaattttaattacagcaaccattattcccgtgttcttactggttctggccatgattgatattaatttctataacttagatgagaaaaaatataaaaacatggtgcgagaattagagaatagagacaaagtttatttggatcatattgacgatttcaaagcttaaaacatgatgagtcaacagaaaatagctgaggaggcgttctgcatgaagattatcaatccagtacttaaaggattcaaccccgatccgagtatttgcagggttggagaggattattatatcgctgtatctacatttgagtggtttccgggagtccagatacaccactcaaaagatttagtcaattggcacttagttgcacatccattacagagagtttcgcaattagacatgaaaggaaatcctaattcaggcggggtctgggcgccatgtttaagttacagtgacggaaagttttggctgatctatacggatgttaaggtcgtagatggcgcctggaaagattgccacaattatttagtgacttgtgacacgattgatggtgattggggggagccgatcacattaaacagctcgggttttgatgcttctttattccatgatacggatgggaaaaaatatttattaaatatgttatgggatcagcgtattgatcggcactcctttggaggcattgtcatgcaggaatattctgataaggagcaaaaactgatcggtaaaccgaaagtgatatttaaaggaactgaaagaaagctgacggaagcgccgcatctttatcatatcgggaactattattatttattaaccgcagaaggaggaacgcggttcgaacatgctgctacaattgcccgttctgcgaatattgaggggccatatgaagttcatcctgataacccaatcttaacgtcatggcatgatccaggaaacccattgcaaaaatgcgggcatgcatctattgttcacacacatacagatgagtggtatttagctcatttaacgggacgtcccattcatctggacgatgattcaatttttcagcagagaggatattgtcctttgggcagagaaacagctattcaaaagctctattggaaagatggctggccttatgtagaaggcggaaaagaagggagcttggaagtggatgcaccttctatacctgaaacaatgtttgaagacacgtatccggaagttgatgaatttgaggatgcagcattaaatattaattttcaaacattaagaatcccttttacggagaaattaggttcattaactcaagcgccaaatcatttacgattatacggccatgaatccttaacttcgacgtttactcaggcatttgtagccagacgctggcaaagtctccattttgaagcggaaacggctgttgcgttttatccggaaaattttcagcaagccgctggtttggtgaactattacaatacagagaactggacggctcttcaagtcacgcatgatgaagaacttggccgtattcttgatttaacgatatgtgataacttttctttttcacaaccgttaaaaaataaaattgtaattccccgtgaagtcaagtacgtctatttaaaagtgaatattgaaaacgaaaaatattattatttctattcatttaacaaagaagattggcacaaaatcgacattgcattggaatcgaaaaaattatcagatgattatatccgaggcgggggattctttacaggagcttttgtagggatgcaatgccaagatacgagcggaaatcaaattccggccgacttcagatatttccgttataaagaaaaatgaatgtccgcatgaaaaaggagctttctattttggaactcctttttcatattagaatgtgcctgtgtggaaaaacacgtcagatatgctcccattcaggatgaaaataacaaaacaaaaaacccatctttaaagatgagcgtaaaacatagaagtttatacatttcagttatgaaccatgtcgagaaaatgatcaatcacaatagaggacattcctaaagcgggtgcattttttcctaagaaagatggtaatagttcatagctattgtctaggtgggaataaacccttgacgacacttcacttctcattgaatttaaaaccataggatgcgattcaattatgctatttcttaaaattacggcctgtgggttgaaagtatttaaaatattggtaaggcctattcctaaatagaatccaaaattctgtaatgcgtttaaggttccgatatcattcagatgggcgaggtctatgatatcttgataggacagttttttctctttggtctgaagagattttaataaagccttctctgaagcatacaattcccagcagcctcggtttccgcaactgcatttaggaccattaaagtctattgtcatatgtcccatttctccagagaagccgcttactcctctatataaatgattgttgataataacaccgatccctatccctgtgctgatacttacgtaaataatgttatcgtgattttttgcagctccaaatactttctctccatatgcgccagcgtttgcctcattttcaataaaaacaggcacattgtacttctcttgtatcgaagattttaagtcaatatctctccagttggagttcggagtgaaaacaattttttgatctttatcaatgagtccaggcacgcaaatacctataccaataagcccgtacggagattggggcatatgcgtaataaagtgatgaatcatatcaatcaaaatgtctttcgttatttctggagaattggattccaaatggcagtattgatcaagaacgatcgttccttcaaggtctgttaaaatgccattgatataatccacaccaacatctattcctacggagtatcctgcctttttattaaaaacaagcatgactggtcttctgccgccgcttgattgtccctgacctatttcaaatacgaggttttctttcattaatgtgtttacctgtgacgaaacagttgatttatttaatccggtcatttcagataattttgctcttgaaataggagaattcttaagtatttcgtttagtaataacttttggttaacttttttgacaaaggcttgatcagcgatatccacttcatccactccatttgtataatctttaaattaagttgaacgttctgtgttatcgtgcgaaacgcagtacatagcgaatgcaacctttattatatctaatgtgttcgtaaaaaactaaaaaaaatattgaaaatactgatgaggttatataagatgaaaataagttagtttgtttaggcaacaaactaatatataacatgacataaaagcatctgtatttgaatgatcatgtttagaatttatttttaagggggaaatcacacatggctcactctcattccggttcagtcggctattttgaaagcgtaaacaaagtgatttacgaagggaaagattccactaatcctttagcatttaaatattataatcctcaagaagtaatcggcgaaaagacaatgaaagagcatctgcgattttctattgcctattggcatacatttaccgctgacggcacagacatgtttggcgcagctacgatgcagagaccgtgggatcactataaaggcatggatctggcgagagcgagggtagatgcagcgtttgagatgtttgaaaaactggatgcgccattttttgcttttcatgaccgggatatcgcaccggaaggaagtacgttaaaagagacaaatcaaaatctggatataatcgtggacatgataaaagactacatgagaaccagcagcgttaagcttttatggaatactgcaaatatgttcacgaatccccgttttgtgcatggtgcggcgacttcttgtaatgcagatgtatttgcgtatgccgcagcccaagtaaaaaaaggattagaaacagcaaaagagcttggcgccgagaactatgtattttggggcggacgtgaagggtacgaaactttgttaaataccgatttaaaatttgagcttgataatatggccagatttatgcatatggcagtggattatgcgaaggaaatcgggtatacagggcagtttttgattgaaccaaaaccaaaagagccgaccacccatcaatatgatacggacgcagcaacaaccattgcctttttaaagcaatacggcttagacaatcattttaaattaaatctcgaagccaatcatgccacattagccgggcatacattcgaacatgaattacgcatggcgagagtgcatggccttctcggctctgttgacgcgaatcagggtgatccgcttttaggctgggacacagatgaatttccgacagatttatattctgcgacattagcaatgtacgaaatcctgcaaaatggcggtcttggaagcggaggattaaactttgacgcaaaggtcaggagatcttcttttgagcctgatgatttactatatgcccatgttgcagggatggatacatttgcaagaggattgaaagccgcacacaagttaatcgaagatcgtgtgtttgaagatgtgattcaacaccgttaccgcagctttactgaagggattggccttgaaattgcagaaggaagagctaatttcaagacgcttgagcaatatgcgctgaacaatcagccaattaaaaacgaatcagggagacaggaacggttaaaagcgatattaaaccaatacattttacaggtataacaaatgaaaaaagaagttccagatcccgctgtaaaaagatgcaggcagccaagttcccaattgcccgtcatgaagttactgttatggcgggtcatttcaatggggatctatttagagaggaaggagtgaaaaaatgaagtatgtcattggaatagaccttggaacgagtgccgttaaaaccattttagtcaatcaaaacggcaaggtttgtgcagaagcgtccaaaagttatccgctcatccaagagaaggcgggatatagtgagcaaaatcctgaagactgggtgcagcaaacaattgaagcattggctgaattgatttcgatatccaacgtccaatctggggatattgacgggattagctattcaggacaaatgcatgggttagtactgcttgaccaagatcggcaggtgctgcgtcatgcgattctttggaatgatactagaacgacgcctcaatgcagcaggataaccgagacatttggcgatcatctgcttgatatcacaaaaaatcgtgtccttgaagggtttacattacctaaaatgttatgggtgaaggaacatgagcctgaactttttaacaaaaccgctgtttttctgcttccgaaagactatgtgagattccgcatgaccggcgccgttcacaccgaatactccgatgcggcaggaacgttacttttacatatgacccgcaaagagtggagcgatgagatttgcaatcaatttggtatttcagcagaaatttgtcctccgctggttgaatcccatgactgtgtaggatcgctgcttccgagcgttgcggcgaagacagggctgctcgaaaaaacaaaagtatacgctgggggagcagataatgcttgcggtgctgtcggagccggtattctttcttcgggaaaaacattatgcagtatcgggacgtcaggagtcatactttcctgtgaagaagacaaagaaagggactttaaagggaaagtgcacttttttaatcatggaaagaaggattctttttatacgatgggagtcacgctcgctgcagggtacagcttggactggtttaaaagaacgtttgcgccgaacgaatcgtttgaacaattattgcagggcgtggaatctgttccgataggagcaaatggactgctgtacactccttacttggtcggtgaaagaacgccgcatgctgattcatctattcggggaagcttgatcggaatggacggagcccataaaagagagcactttttgagggcgataatggaaggcatcacattctctttatatgaatcaattgagctattccgcgaagcgggaaaatcagttgatacggttgtctctattggcgggggagctaaaaatgaaacgtggcttcaaatgcaggctgatattttcaatacgagggtggttaagttagaaaatgaacaaggtccggccatgggggctgcgatgttagccgccttcggaagcgggtggtttgactctcttgaagaatgtgcagagcagttcattcatgaagcagctgcattttatccaaaagaacaaaatgttcaaaaatataaaacattattcgagttgtataagaacatttacgctcacacaaaagatctcaatacagctttaaagagctttcgacaaacctaattttcaggaggtcagttgagggatatcaaagcaacggcagcgctaatgtaacttcaaatgtgttagctattgaaggaaactgataagcattcttgtaagttgtgactgcatcagtctaaactcatatgacgatgaattgagaagtatacacacaaaacatcccctcacattgcgtgagggggatgttttttattattgagattttcctgtttcttgaatccgtggagatagcctttctgcaatggattcgcaggtattactcaacttcaggagttccttagaaaatgaagaaagaacctcgccaaattggccaggttctttttatattgcacaaaaacagacacggtgatataatcagaacacgcgcgctttctgtgtgaaaagtcatagttatccatcttatattatgattatatcatgctgaaaagctcttgtcaaatttttttgaaggggagatatagaatgagttctttggttctcggcattcacgaaattgaaaaaacacagcctttgctcattggaggaaaagggttacatttaggggaattatcaaaaattcaaggaatacaagtaccggaaggattttgtgtcacaaccgcaggatatcgaaaagccattgaacaaaacgaaacgttacaagcgctgttgggtcaactgaccatgctgaaagcggagaatcgggatcaaattggtgaagtcagcaaaaaaatccggcaaaccattatggaagcagaaattccttcagatgtagtcaaagcagttgcttgctatctctcccgatttggcgaaaaacatgcctatgccgtacgttccagtgcgacagctgaggatttaccgcatgcctctttcgccggtcaacaagacacctatttaaatattaccggcgtcgatgcgatcttgcagcatatcagtaaatgttgggcgtccctatttacggatcgcgcggtcatttaccgtatgcaaaatggatttgatcacagccaagtttatttatccgttatcatccaaaggatggtgttccctcaggcttcggggattttatttaccgctgatccgatgaccggaaaccgaaagctgctatccattgatgccggttttggacttggtgaagcactggtctccggcttagtctctgccgattgttataaagtacaggacgggcaaatcgtcgataagagaatagaaactaaaaaattggctatctatggacgaaaagaaggcggaacggaaacacgggagattgatcttgatcagcaaaagattcaaacactgactgatgaacaaattttacagctggcacgtatcgggagacagatcgaagctcatttcggccagccgcaagatatcgaatggtgtttggaccgcgatactttttatattgtccaaagtcgtccgatcacaacgttataccccgttcctgaagcgaacgatcaagaaaatcacgtctatatctctgtcggtcatcagcaaatgatgacggatcccataaaaccccttggattgtctttttttctgttgacgactgctgcacccatgcgtaaagccggcggaaggctattcgttgatgtcacacatcaactggcatcccctaatgtcagagaagttttcttaaaaggcatggggcagcacgatccgctcttaaaagacgcacttatgaccataatagagcggcatgatttcattaagccgatacatgataaaacggcgccgattcccggcaaaggcaatgcagatatgccggatcaagctgaaaacgatccggcaattgtttctgatttgattaagagcagtcaggcatcgatagaagagctaaaacaaaacatccagacgaaatcaggatctgatttatttcgttttattttggaagatatccaggaattaaagaatattttatttaatccaaaaagttcggtattgattcgaactgcaatggatgcttcatcatggattaacgaaaaaatgaacgagtggttaggtgaaaaaaacgcagcagatacgctttctcaatctgtacctcataatattacttcagaaatggggcttgtgctattggacgtcgccgatgtgatccgtccttatccagaagtaattgcctatttagagaatgtaaaagatgatcactttttggatgggctggtgaagtttgaaggcgggcgggaaacccatgacgctatctatgcttatctcaacaagtacggaatgcgatgtgccggagaaattgatatcacaagaactcgatggagcgaaaaaccaattgcacttgtccctatgattcttaataatctcaaaaactttgagtcaaatgccagccagcggaaatttgagcaagggcggcaggaggcgttgaagaaagaacaagagttattagaccgattgaagcaattaccggacggtgaacaaaaagccagagaaactaaacgaatgatccaaatcatccggaacttcagcgggttcagagaatatccaaaatatggcatgatcagccgctacttcgtttataaacaggctttactgaaagaagccgaacaactcgcaaaagcggggttattcatgaaaaagaagacatatactatctcacttttgaagaacttcaggaagtcgtacgcacaaataaattggattaccaaatcatcagcacacgaaaaggcgagtacaaagtatatgaaaaactatctccgccgcgtgttatcacgtctgacggtgaaatcgttacaggcgagtacaaacgagaaaatctcccggccggagcgattgcagggctgcccgtttcctcgggagtcatagagggccgggcacgggttattttaaacatggaagatgccgatttggaagatggagatatattagttacctcctatactgatcccagctggacaccattgtttgtatccataaaaggcctggtcactgaagttggcggactgatgacccatggagcggttatcgcgcgtgaatacggcttacctgcagttgttggagttgaaaatgcaacccaattgataaaagatgggcagcgaatccgcgttcatggaacagaaggctctattgaaatattataatagcgggtgtgtgcagcacgtcaccagctatttcccgcattttaactgacaaagaccgaacaaaaagaaaagccggaacctcttagaagaggaatccggtttttttatgtgaaaatgacttaatgtgtgaacaccgtattttgtgggcggaccctttttaaatgagtgtggaaggccgctaagataccaaacaaaaaagattcagtgactaaatctaacgaatgacaattttataaaggtgagtaatatcctttttaagttcacaacatctgtaatcctgatgaattaaaaaccgccttagttttttaacaactatttaggggttttgttcatgaacaagtctttattccgaattggattgttcgctttattcttcatagcggcaatattggcgcaggcaggggaggaaactctcccgcttaccagagtaaaaataaaaaatgtttatcttagatagattttttaaaaagtaaaaacgccataaaacttcttatggcgtctgtccgaactaagggatgcaatgtttgggagacgaatataaatcgtcaatgtgctagaaaaggaatgcagcacctacaatgattaacaaaatgaacagcacaacgatcaatacgaaagaacttccaccgtaatttccaccgtagttccccatattattgccacctcctgttgttaggatagtacataatatgccggatgataaatttcgacatagatttaagtctaaataagaaaaaatggatattaagtctaaaatgaagagcttctaaaaatatgaaataatgggaagttaactgaaagagagaaatggatgggacggtttgctgtttaaagaggagggatatggcacaacatgccataaaactgtgtatgaaagtggtgagccatgaagttgcttcatcatgcagagccacatacgaagaggtacagggaaatcatagttaacgaaaatattcatcatttcccgggcaagcgcagtatacgacaaatcaaaacaaatcacaaagggacgcaaggtacgatacaaggaggctgcttgagggtttgtgatgccgataaagtttccgtttcaaaacggtcatatgtttattcgacactttacctttattcctgcagaatgattgtaaaagaaagtcccgcaaaactgccgactttcctaacggaatttagatctcaacagatctaaagaaaccatcgacactatcaccggtgccgctatcatatttcaggatgtattctcctttttggttaacgctgaattcttgaatgaacgttttccccgcatttaatgtcgtagaggatataaggaagaagctgcctgattgagtgaggtataacgatgaccggggcggctgcggatcaactgaaacgaagtatattcccaagcaaggagtatttctttaacctgaaacttttataaagctttaacgtattactttataaaggtaaataaggaggcttctgaatgggattaaaaaatttctttaatactgagttaaaatgctctatctgcggaaaaacattaaaatcaggggatgagataacagcttatcttacacttccaagtgagaagaaaatgcctgtggggagaatggacaaagtgttaagcaaacactctgataaggtctgctgtaaaaagtgcagtgagtaggtttttagtgttatgaggaacctctggtgggtttcctcataacagctacgcttcggcaatgaatgaccttgctttatattggtatcagggttagttcaggcagtacttgcaaaatgaataaccgccgaatggtctgtaaagtttcttttctgaactaaatgacaaagtcttattcagtctgggttgggcgctgagcaagaatagagattaaaggctgccgtatcattcccggcagccttaatgattaggaagtaaaatcgataaccatgcggccggtcactttaccttgctccatttcttcaaaaatatcattcacatcttcgatcgggcgttttgtcactttaggtacaactttaccgtccgcagcaaattgaaaagcttccttcaggtcttctctggtacctactaatgaacctactacctgaattccatctaacacgagacggggaatatctaaatccattttgtccaccggtaaaccgactgcgactacacgggctcctgcttttacaacatcaatcgcttgattgaaaggggttttagagacagccgtgatgaccacagcatcaagccctaaatcgttagtcacttcttttaccttagcgacggggtcttcgtttaaactgtttacaaccgcatcagcgcctaagctcttagcaaaattcaatttttcatcactaatgtcgaaagcaatcactttagcgttaaagacgttttttgcatattgaacagccaagttgcctaaaccgccgactccaaatacaccgatccattgacctggtttaatttcactgactttaaccgctttataagttgttacacctgcacaagtaatgctgcttgctgctgcaggatctaaattttccggcacctttattgcataatcaaccgctacgattgcttcttcagccattgcgccgtcaactgtatagccggcattttttacatcccggcacaaggtttcccggccagttaagcaatattcacagcagccgcagctttcaaacatccaggcaatagagacgcggtcaccttttttcaggcttgttacgccttcaccaatctcagtcacaatgcctattccctcatgacctaaagtgacgccagtaacatccccgaaatcagcatttttaacatgcaagtcagtatgacatacaccgcagtattccatcttaactttggcttcaccatgtcgcaaaggacgtaattctttttgtacgatcgctatacttttgtcttttgttgctactacagctttcaaatcatacacccctttcaaatattagcagaaaatttttacttatcttacaatttagcatactgctcttattttgaaaacccttacatttttgcgggcaagtgcctctacaaaaattgagggagctatgaagggaggattctacggatgatttgtcatccgaatggtgtttaaatgggggtttgtctccaaatgcacagaatgctttgcttttgtggtcataatctttctatagatatttgacttgcactgcagagaattacactggcaggatatgattttacctttagtgaaaagaatttcacgggtaatcatttgaacttgagctcggctgataaggtgaatggtgatgcaaacagaaatcattacttattgattacaaaagaagcaggctgcggagacgtgtggatttcacggattcgaacacgatgagccggatgcagattggtgagcgatacacagtcaaggtatttccttgaccttttttatgggtatactgataattaaaagtaatcatagtatactaaagttacaataaaagtaacgaaatacaaattttaaggagttgcataaaatcattcttttaaagagaaggggatcaggttggatcagttaataaatcctacgaaacattctttttattttaggctaagtaaacatgactgttataaagttagaacaggaaagtgctccttagatttaactgataaggaatttaatgctttagaaggcgaagagcatgaatatgcattaaaatgcagaagattggctgcgcactacataaaaccggacatgcataaaaaacattcaggaatatatgcaagcgtaaatgcttgcggtcatatttcgtttagtgatggtcagcacaggatgtgtatctgcaaaaggtcaggtgtcgataaattacttattcatttatcaaacaacggagattatatatgtcatatatgccaggacaaaaacaaaaaattaacagttaaagaaaaattgaagcaaaggttttttaaaaaggattcgaataaacttgcaagagaaaatgattttattgatgatgagttttttgattaaaccaatcttttatttcaaatggaggggtacatttgggtatactcaactttttcaagaacaaagttaaaaatgaacaaaatgagaataaaaataataatatgaacactgttggcgttaataacgaaacagagatggtatcgaaaaaagaaaatttcccaatcttgattcaagagacaggcttctcaaggaaatatgaagaaaagtctgcatttttcgagtatatagactttaaggttgcaggaacatcacactatcaaaaagatattaagaaagccatcaagactgaggatgaagacagctttttcttcgatgaaaaatatgatggtatgacaaataaagagattctagaatcaacttttgatgagccgatatttatttatcataattcccttttctcaaattgtgaattgcggttagaagagaacaacaagtacgatccggaagctatagctgtctatgtaaatgattgcaaagtaggacatgttcctcgaaagaattttcaagaaggcaagaaatacatttacgatcagttaaagagtggtataaggcacccgatatcagcaagtttgtatggggggaaatataaagttaaccgcgatgatacaaagattgaaacaggagaaacagattataaaattgaatgtcaaatagtgattaaaacagacaaatagacaataaaactacgatattgtaagtgcgaagtaaatgaacggggcggtgacttgaagctgaattcaacaagattaaagagctatacctacacattggctttttcaagtttgtcgtatggtttgattttcgggctatatatgtttgtatactcgggttttgtgccaattgcattagttactgtagttatcattgctttttacgcattgattacttactttttgtttgctgttcctgtgcaactatggctaagaaagaagcctaaaaagtttagtttggttcatcttttcatttataccgcagtcgcttttttagctgtgttcttgttctggcacataggtaatccgtcaattgatttcacggttttcagaagtttcatttattacataaagagcattgctgctgcgttcatatattggttctgggactctatatttctgagaaattacaatgttcaccggaagtaaagctgatgttcccaaaagaaagcgggtgaggaaaaatggaatacattgagttgactagggacaatattgatgacaatcatatttgctgtgcgttaggtacgaaacaatatgaggatgcggtaaatgaaaagaagagctggctcaaagatcggatgagtgatggcttggtgttctaccgcctaaacgaacgggccaaagtttttattgaatatttacctgcagaagaagcgtgggtcccggtaagtgtacctaattttatgtttattaattgcctttgggtctcaggtaaatataagaataacggacatgcgaaacacttgttagaaaaatgtgtgtcagatgcaaaatcccgcggtatggatgggatagttcatatagtggggaagaaaaaactcccttatttaagtgataagcatttcttcgagcatatgggatttgctgtgcaagatgaagcagaaccctattttcagttggtgtcactgacgtggaaggaacatgcacatcctcctgtatttaaaaaacaggtgaaaagtaattccgttaatgatgagggaatcataatattttatacagctcaatgcccatttgcagtcggagtgttaaaggatttaaaggaactgactgaaaagaaagggcttcattttcaggccctgagaataacgtcaaaagatatggcgcaaaaatccccggcagtttggacgactttcagcgtgttttataatgggacatttctcactcatgagatgatgagcgtaaataagtttgaaaaaatactgaataagcttttaatggcttaactttgttttattactattgctcgtttctatattcgatactgagggtttttcaggaaaattgttcagtactttacattgcgggcggcaaatgaatgattattgtttttgataaagatgataacacccatcattatagtaaaaatagattgtgataagttcttcaacaaacgaagaagttcttttcaaaggtcgataacaatgaaacaggagactgcaaatgcaaaaaattgaaacccatcgcttaattttaagaaattttaccgagaaagatgcgcaaggtctgttggaatattcggcacatccgagagtgaattgctttcttgatgacagaatatctacgttagaagaagctgccgtaaacgttcaaaaaagaagccgagatgactcttatattgcagtttgtttaaaagacagtaatgatctagtcggagaactattttatttaaaagaagagccagatacctattccgtttgttggaattttaatgcccgttttgaagggatgggatacgcaagtgaaagtgcgaaggctttctttgagtatctctttatgcaaaaagaagcaagaaggctttatgcatatgttgaagatgataactgcaggtcacaaaaactatgtgagagattaggaatgcgtaaagaaggttattttcttgaatttatttcatttactgcacacgaggatggaacacctaaatatgaaaacacataccaatacgcattgctaaagaaagaatggttaaaacaaaaacatagttaatagaatttgtggggaaataacctctcctttactgaaaaaaccctgctgaaagcaggtttttttgtatttaggttacctagtaacgatcaaaaagattcagcttgaaggttgggaaaaacatgaaaatcattatagcaatgttgtaaaattatagagaggagattgtgatggacattttgcagtttagcgacagaaggtgcaggaagtaattcgaatcagcaatgttcaattcattttgatgcatttaaagaagcgcttgagaatggaaaagtggttgatactcaaaatgtgaaaagcagttcagagtcaagacctattttacggtgagaccggaaatattctcttcatcttctgatgctgttcaaagctgacacctcttgatgcttatgtataagaaaataataccattgaaatatatgtaacatcaatgaataaggttggaaacggagggttcaaagttggtgcgatcttgtgtaaaagaaaggatcaggatgaatgtgaccagcatccaccctgaccaatggggttcacagtgttctatttcattgtattccaatcggaataatattacaagggtaaaaaaagaaataatcggaatgttttcggcttcttctgtccctggagcgggaaacggaaagtgagatgtttgaatgaaaataaatgattatctgaaggaaaggtttccgactttaaaattagtgcccggcatttatcatcaatgggacgtgggaattcatttttctctcggcggcaatatgtatcaatttaatgaaagcggtgttttgaatcttgagtattttcagcttgttcatcatcaaaccgccgcacttttcaatgagctgtttgaacatagagatgacatgttccttgttgccaacgtatataagcacaaaactcaaggtaatcacgcgagaaaattaaaggtttatcagccgtttctgaagtgtaaggatgatttatatcggatccagttgaagacctgcccctgtccgtttgaagaagatgatgcagaagaatatgaaatgcagcagttttctttattatgtaaacggaaagatctgcgtattcctcaattacttaaggcagccgtccacgaagattttccgctgaagccaaggttcgggggctgttccgttgggtatcccgatgttttctttgtgaatatgacaaaagatattattttctttctgtatgatgacagagggtgtgaagtcatcgctcttgatgccggaagaatacgaaagctttatgatcaatatcacgattggattgaattggactgaaaatgaacacatgaattcgaatccgcttgtgccggctttgttcttgcctagtccggctgcatgagtataatgggcagaattgaagggcgccggaaactttttttcctcttataccggccttctgcatgttaagcttctgtatttattttgaatgaattcctatttataaaacggctgaatagaataacataaaagcttttttacacagtgcaggaggagagaaatgtgagggctgaacaccgtgattgtatggaaattggaatttattcatttgcagaattatatcccgatcctctgacagggaaaacagtcagcgcaaagcagcggatagatgaattgatgaagctggcgaaactggctgacgacgcagggcttgatgtattcggtgtaggcgagcatcatcgtcttgattatgcggtatcttcgccgccggccatcttatcagcgatttcacagatcactgaaaatattaagctgaccagtgccacgactgtattatccaccgcagatcccgtccgtttatttgaggattttgcaacgcttgatctgatttcagacggccgggcggaaatcattgcgggacggggcgcatttttagactcgtttcctctcttcggttatgacgtaggccattataaagaactgtttgaagaacacattaacctttttttaaaactaaattccggggaagaatcggttacctggaaaggacgttaccggccgccgctgcgcgaggcagaaatttctcctcggccttttcgcggaagcattccgctatggttaggtgtttcggggactccggaaagcgcagaacgagccgggcgtgcaggtgcgggtttggcattagctgtactgagcggtgatccgatgtcatctaagccgcttgttgacaaataccgagaagcggcttttaaagccggtcatcctccggaaaatgtgaaggttgccgtaaccggacatatgttcatttcaaaaacgaatgaacaggcaatacaagaattttacccgtatcattcaaattactggtctcacgttcattcatatcacgggatcgatgagcctttaacgaaggaagattttgagcgggcgtccggaaaagaaacagctttatttgtgggaagttcacagcagatcattgaaaaaatcatgcatcaatatgagttgttcgggcatcagcgatttctcgcgcaaatcgatataggaggtatgccgtttaaaaaagccgcggaaaacatcgaacgattagcagcggaagtagcaccggttatccgaaaagaaaccggcaaatccagcgaatgaagttctgagcaaaaggggcgggccggtttttggcaatcgcggattcgacaacagaatcggcccggctttttctttatgattataaaaaacaaaggggaaagcgcgaacctcattgctttttcctatcaagaaaaggaaggtcatttcatcctctatcgtgaagtgtatatactgaaaggtttttattaacaaaagagggaggatgatgcagtaatgaagggtttagtcaaagctgcagttttaactgttactcttggaattggaggcgctttctattcaagtgatgcatctgcgcacgggtatataaaagagcccgtcagcagagcgtacatgggagctttagagaaacaaacattgggctggacggccgctgcgcagaaatatggctccgtcattgataatcctcagtctgtagaagggccgaaaggatttccggctgcaggtccgccggatggaagaattgcgtctgcaaatgggggatcgggacaaattgacttcggtttagacaagcagactgcagattattgggtaaaacaaaacatccgcggcggttttaacaccttcacttggtactacacggctcctcatgcgacatcaaagtggcactattatatcaccaagaaaaactggaatccgaataaacctttgtcaagagatgaatttgaattaatcggaacggtaaaccacgacggttccaaggcagatacgaatctgactcataagatttttgtgccgactgatcgaagcgggtatcatgtcattttgggggtatgggacgttgcggatacttccaatgccttctataacgtcatcgatgtaaatcttacacaataatctatgaattactgatcggctgcatgttgattcatcggccgatctttttagttttaatgtgtgaatgaaaaggggaaaaacagcagagcgccataaacatttcatttatggcgccgtacgatcatggaggtgctgctgacatggatgcggaggtaagaggattcttaataaccgccgaggaaagaagccccaacgatgattaataaaatgaatagcaccacgattaacgcaaaggagctaccataaccacctgagaatcccatataatctcacctcctaaagaggattaatacatactatgccgaaatgaaaagtttgatagggatgctagtttactttttgaaaaaaggttatttagtctatatttcctccacatggccatccgttaaaatgagtgtaagcaggaatcgtactgcttcctgtaatagaaatggataggctcatatattgagcagttgcgaagaggatgcgcagttggcttgtttttttaaaaatgaaaatgtaacacacgctattaggattggacccttttgattcaacggaacaggctgaagaaatgattggttggtttcaagagcagtagcatgaaaaaagtggatgtgatgaggaatagagaaaaaagatgcgaaaggcataatcggaaccatgtatcaaaacggactgcctggtgatatacgcgtatactccattccgaatgggaacgtaacgatctaaacagaagaacttcaagtgttctgcggtaaataaaaaaagccgatgaaggcttaaaattgattagacgctgtaaagcattctttttgctgcgctttctgcagacggagtttgattgtaagaaacgattccgatcatcactaacaagataatgaaaaccaatatgctccacaacactatttttaaagactttgacatggcataccctcactttgaaagactttaccggggctgcgatcggagcccgcacttcaagtatagtcgttataacggtgaaaaatgtacagtatcccgttatcaaaataaaaacttgcgggcgctgccgcaagttttctctgtattaaggtctgtggaattcaatatgctgattatcacgatcgaaccatcctctgaatgcccaattgatccagcccccgtctcctttgttatcaaaggaaccgtcttcgaagacccagattccgtaagtaatgccgtcataaacggctgatccgtaaaattgaacgccgttaaagcggtcttcatattcttgatttaaattgaacaccatgacgttgtacttctgtcctgatgcgtaaaatgttgtttccatgacattttttacccagccggttcggttttgatctgacttaaccgcttcagcaatgcgatctgaaattccgagaacatctacgtttacgttcagcccggcatcaacacctgctgcttttacgttttggcctgctgtttggggtaatttactttctaacggatttgcaacgggtgaaacgtgaggcgcgtttgcgtgttcagactgactggctgctgaggcactggctgtgaaaggaattgttagagataaagctaagcatgatccgactattgttctggcgattttcatgtctatgacctcctgaggaaatttttaaaaattgttgcaaattcatggtatcgcagagaaattgaccaagcaaagagtagattttctcaaaagtcatgtcgttctatttgtgttgttttctgtaaatgaaatacttttcattaggcgaaaagggaagaaaataatagagtctttttatgtattgtgataagatgaccggattttgggtgaaaaaagcccggagaaacgccataataagaaaaacacccgggtttaccgggtgtaaaaagtgttgatatgtcaagtcagcagcattttttacattttttgcattttcttttataaacaacgatgtaatcataatcaagatgctttttatcttgtttcttcttttgtttaggctgctttggctggtgatcataatgtccgttcatacccatatccatatccatactcatattcctccttttttcatctgacggtagtattctatgacagaaagcatggatggcttggacaaatgaaacggtatgctgaaaaagaggcatctcattcggtataaaaaacaggatcatacccgcccgatagaaaagagaggagatgatcctgatattgagaccctatttgataaccgcaattgcaatgccgtaccctttttcagcactgtataaggccgtcagtttcaataccttccagccttccgcggctttagtcccggttccgttatgagccgtgatataatctcccgggctgaccgtactgtcgacccgtacgtaatgccggccgttgagtccgacaatatgccattcgtctctggccgcgcgtgcttcatagtcagcttcaagagccggactgcagtccgggttttgtttcggtacgcgtaccgtttctcctgtttcttcgtcagtcacattttcgtatatgaaaccgccgaactcatttgtcaaaaagcggctttgccatccgaagcttgcggctcctgagataaaagcggctgtttctgaaatgacgccgagcatataatctccgacgtgagccggttcaattttttcgcctttcactgtgacgatcgtcccggcgggaatcgtctggccggttacactttcaaaatattctccgtaccctgacagggaagaggtgacagctccggcgaacgtaccgtggccgcccgctgaatccagtttccatttgatggactgatgccctccggcaaccgtgtatggttcttccaatgtaatgctttctgatgacagaatcgttctggagactttgccgcctgtaatatggacattgtttgaagcggcgataaatgcccttgaaccttcagaacttgaacctccggaagagctgatgatcgcatttctgtcacccctagccgtaatatcgcctgttcccgcaataacggcgcttgtcgggttgaatgcaaaaccggagctggtcgcgagctgtgcgcctccctttaaattgacggggatctgctcataagtctgtccttttatagatgcggccgcgctgtaaccttccgcttgcaccccgagaatgacagcctgactgttaggggacgtaattccgacggaaccgccgtctccgatcattgtaccgttcataatatttacgttatattggcctccgccgattgagatgcctttaggagaagacttgtatatatcaaaatttaaaattttaacataatcggttttattagatccgccggatatattgatgtcaaccccggcttgtgtaaagccgcgtattttaatgccgttgatcgtaatattttgactgcggtattgaagagccacgactggattcccgccatagtcgtatgagggatcaccaatagctgtgaatccgtttacattaacgtttttataggcagagatgaccagcgccctcggggtcacaccgtcatagagagcattgaataccggttcaatcgcggtgcaatcggttaaagtaacatcataagccgtcgtgctttcgggatctgaggcctgatgatggccgatatgacgaatatcaaatgaacgtacatcacgatacgaaacatgaccgataatatgaacattttgagaagccggccacaggctgtgcgcctttacctcaatcccgcggatatttccgctcgtatagttatttaaaagccacacatgtttagagccgtcgtcaatttcaatgccgttcgagtttgcgctgccctcagcatgctctgtgccgcgggggtttccggaatggcagttggaaatgaaaatatattcgctgtaatgggtggtaatgccgtcgtctccggcgccgtatgccacacagttatcaatccatatataacggcagccgtctttcgtccattctgtgtcaggcaaatgatcgtaagtcggagatgtaatatctataccatgcagacccgcgttaaccgtttcaacattcttaatccagccgtattgcacattagcaaatgttaaacagctggaaaactgtcctccggggttcctgactccgcattgacgatcaggattccagtctaaagtcatgttctggacaaaaatattacggtttccattttcgtaatcatcgttagtaacgacccattcgtatgcgggagtgtcctcatgaagcttaagcacggtaatcccttgtccctcaccggaaatggtagtccaggaggggagttttatcccttgaaccaaaaattctcctgcgggaacatttactttgacccggccgttcccgatcgctctccgaaaggcttccgtattgtcccggccgtcagggaccgctccgtaatcctccacattcacttcccgggtgattttattcataagcatttcgtattctgtatcaagccgttcttttaaaagtgaggtgaccattccttccgccgtcacccgggcatctgcgatctcaagattatcatccgttgcggaatgcttaataaaattctgcatccttgctttgagatgctccaattcagagggatgtgcagggcgagactgcaatggggcgtttaaagacggatcaggaaagtttttaaattgaaccattctaaagacacctctttcttttgatataagcgcctgaggcaggggacagaaaaatcgcgcgccctttaagcgcttattcttcaaattctttattcagaacgaaattccttttgaaaccaaggtgaaatttaaaaaaagctctgttgaaagaacggatataaagctttacattattgtaattgaaactgtcatgtgaaaatggaggaaaaaactgataggaggggtcctcattttaggtttattctcattgtcttcgccgtgcttcctcttcggctgcatatacaccaaaatcaacattcttatcagttaaatggtataatggggcacggattggtcatcaatacgactgaaatagggaagcaaaaggagcagcgaacatgactttacaaatcaaaattaaatattcagatgatacgcaaacgagaatcagtaaaattgaacagggcgattggattgacctgcgggcagctgaagatataacaatcaaaaaaggcgaattcaaacttattccgcttggagttgcgatggaactgccggaaggatacgaggcccatgtcgttccgcgttcaagtacatataagcatttcggtatcattcagacaaattcaatgggagtcattgatgaatcatataaaggcgacaatgacttctggttttttcctgcattcgctcttcgggataccgacatttccaagggggagcggatctgccaattcagaatcatgaagaaaatgcctgaagtggagctgatcgaagtagacaagctcggaaacaatgaccggggcggactgggatcaacaggcacgaaataaaacgaaaaaaagactgcttaacagcagtctttttttatggaaacaacagttacattcaatttgtttcgaggattcttaaattgggaaatcaaacaaaactaaggagaagggtttcatttttatcatttaagctttccgtctctttgaacagaaagactttcttaggttaaaggatagaggttgttttgatgtttttattcttcaagatgaacggaggttttgtccaacgtatataatattgtgacaaaagtgcaaacaaaagaaaggatgatgttatggaaaaaagggttagaagagtagaccgtaaagcagctggcaaagaggcagagcagaagaaaccgtccaaagtcaccctgttctgccgttcgcttcaaaggctgaagcatttgtattgtaacataaacatacaaatgccatcaataaccaaaaaaggaatttcagttttaattttaccgtttttgcttctgccgttctttcgggctgatgccgcttcagatatttacggcagtttcgaggaattaaagctgaatgaagatccttccgatttttccatttcaacgcgggagcatgacccttctgtcctcatattagctatacacggcggaggcatagagccggggaccagtgagttagccagagaaattgccgaaaaccggagtttatatttatttgaagggttaaaatcagccggtaatgcggctctgcatttgacaagttcgcatttcgatgaacctaaggccgtgcaaatggtgaaagagcactctaatgtcatttcattgcacggttacggcagtgatgataaaaagataaaaatcggcggtacagacagagaacgggccgaacttttgaccgatgtgctgaaacggcacgggtatccagccgttcttcttggcacaaatgataaatatgcaggcgtcagtccgaacaaccttgccaatcaatcttcatccggattgagtatccaaatcgaaatgagcaccggcttcagaacatcactatttgacacttttacgctgaaaagcagagcatccacacaaaataagaccttttatcaattcacaaaaacgatttctgattttatcagtgacaattattaataagcacgcctattttgtcggcggggctttttcttttgaaatttatgaaactttaagttcttaagatcgtatacataattgacaggatgaaagaaaagaggtgggcaaatgaaagtgatgatcgggtctatcattcttcttgtcatcatcggattcggtttatggctgatgcttagtccaatctttaaacaagtgggaagcggagccaaaaaattaaaaaagtcatgggaggaagaagatcagcatgagcgaaaataagcgcggaaacacaaaaaaaattctcggcggtgtgattataggtgcagcccttttaattgcgggcgtcacagcgtcactattcattgaaaaaataccgaacggttatgtcggggttgtatactcaccgaatggcggggtaaaatccgacacattggaccaaggctggcacttagtcggattatttaataaagtaacggaatacccggtgcgtatgcagacagtgaataatgaaaatataaaagtggcaacctctgacggtaaaaatattgaaatggatatcgcttataactatgtcgtgcagcctgataaagtagtcgatctgtttaacaaattcggggcggtagatgtggaaacgatcgaaaatacatatttaaaaacaaggctgtgggatgcggcgcgaaaatcaatcagcaaatactcggttattgacacatacgggcaaaaatctgcagaagccgctgccgatgttcaaaagagatttgctgatgatatgaagagtcttggatttttaattgatgatctgacgcttggcgtaccaaagccggataaagccacacaggaagccatcgatgcaagggtgaagtcttcacaggaacttgaacggacacaaactgaaattaaaatagccgaagccgaagcgaaaaagaaaaaaattgaagcggaagggatcgctgactataacgaaatcattaagaaatcaatgtccgatgaaatgatcaaatataaatggattgaaaaatgggacggaaaaacgccgaaagcgacaggcacagactcactgctgcagctgccgctggacgatcagaagcaaaagtaaaaagagaaggaggcgattgcctcctttttatgttttttcctgagggtctttttccggcactaattcttcagacgcctcggtttgatagctccatagcgtgctatccgtctctgttgtgtcctgataatcttcgggaagtacatattgctgcaaataccggtgaaaaaatgcctcaaaaacagaaatgcaaagtgcagagataaccgatgccgcggcaggagagacattaaacccgccaatgttcatcaggaatatccataatataatgaatgaaattccgaaatcagctgcaacggctgtgaaattgcttgttctcggcagaatcatgcaatcacccgcaaaataagtgattaaacttaagatcactgtaataaacagaacgtttaaaaaggttacttggtacataagatccagaacaatgtacagtaaagcaagtgtgagcgccgttttagaagcgaaagcaattacgtgtttcatttgaaccaccttcgttatttcgtttattcttcattataagcaatccgcaaatttttaaactggtatatagtggttataaagtaaaatgtgaatagacatcacaggattcacaagttaaaatatgtaaaaagggggatgaaaatgaaaaaatattggatatgtattgctgtttttttattatgttttagcggaatacactcagctaaagcggctaccattgaattcggatcaaaaacaagcttcactttggagggaaacgcaaaagagtttcatattgaaaatccgggggctgtagctgccgacgattattttttaggctataagttcaccataatgaacgactcttcgtgcggtttaagcatgaaactccagcggatggcgctgaacggaaatttttatacattaagttctaaaaactacagcggcagctggctaaacctcagtgcccaggataaaaaatcaattgatccgtatcacaaatacaggattctggttgaaagttcttcaaacgtctgtggtcccgtctatattaaagggttttacggtgtagaatattatcattttgattgaaaatagatactcgctaaaggcagcgggtttttttatatttaaatataacttattgtactatgtactaaatattcatatataaattttgatgcacccgcccaaagaaaagataaacaaaagcaaattcatcacgcacaaatatacaaagttgaaaaatggatgaaaagtttcttgagggaaacattattagttgacttcaaaagtgtgatgtcggataataagaatgtaagtttttcctccttagcagattcgtttcttaagccagggcgaatctgctttttttatgcaaaaaaacccctctgtaaggggttttttacgataaatgaagtttaatagaattaatggacggctctgaatacgccgatcacttttcccaaaatgcttacgttttgcaggataatcggctccatcgtcggattttccggctgcagccgaacataattgtcttctttatagaagcgcttaaccgtcgcttcatcatcttcggtcatagctacgacgatttctccgttattggccgtgttctgctgtttgacaatgacgtaatctttgtcaaaaatgccggcgtcaatcatactttctcccatgatttctaacataaagacatgttcgcccggaggaaccatccggtcaggaagcggaaaatactcgtcgatattttcaacagccgtaatcggaatacccgccgtcactttcccgatgaccggaacgtttacgacctggcttttcggaatatggacttcttcttcatccaatacctcaatcgccctcggtttagtagggtcccgtctgatcaggccctttgtctccagccgcgccaaatggccgtgcacggttgaactggaagccagtcctactgcttctcctatctctcttacagaaggcggatatcctttcgtttttacctcttctttaataaaacgcaggatatcaagctgcctttttgatagcttcgtcatatttcgcacctcaaaacgtcgattttaagtagattatagcatgattttcctgacagtacaaacataggttcgaaaaaaacgattgacagaaacatttgttcgtatatactgaaagatataaaaagcgaacaaacattcttatcggaggttgtttacatggcgaaagaatctatcatatttgtcgggctgtttactgcgattttaagtgccgctattttacttgtctcatgtgcgggaaatgatcagtccctcagccaatatgttaaaataaaggttcaggacggcgatacactctggtcacttgcggatcatgtagcagaaaagaaacacattaataaagaagatttcattgagtgggtgacggagaataatcatctccaaactgctgatataaagcccggagacgaacttattcttccgattaagaagaagcatccggccgtatatcagctggccattgtcaattagagaggaaagagagaaatgaaggcgctcatttatgcccgcgtaagcacaaacaaagaacagcagcaaacgtcattaaaaagacaggaagaagagctcagtgagatcgctgctgcaaacggcatggaagtcgtgaaagtcatttctgagaaagccagcggttatgaaatggaccgcgacggagtatttgaaatgcttgatgaaattaaaaaatcacatattgacgcgatattggtgcaggacgaaacgagattgggaagaggaaacgccaagattgcgcttttgcattgtatttacagggagaacgtaaagatatatacgacggctcataaaggtgaactggagctttccgaagctgattcgatggtacttgaaatcgtcagtattgttgaggaatatcaaaggaaaattcacaatatgaaaatccggcggggaatgaaaagagccgtgaaaaacggctacaaacctgaacggaacctgaaaaacagacatgaaaacagcggaaaagaaaaaaaagaggttccggtttcggaaattatcaggctgagagccaacaagcttacctttgcagaaatcgcagcgaccctaagaggattcggctatgacgtgtccaaagccacggttcaccggcggtttcaggaatataccgcagacacagaaggcagctgacgcgcatcagttgtaaaaaagactgcgttttagtagtatataatcaacacgcaccaaaggagcttattatgatttctaaagaaaaaatcgcaagaattaacgaattggctcaaaaagctaaatcaaacacgataacggatgaggaaaaagctgaacagcaaaagcttcgccaggagtatttgaaaggattccgctcctcaatgaaaaatacgttaaagagcgtaaaagtgattgatccggaaggcaacgatgtcacccctgaaaaattaaaaagagaacaacagaaaaataatcttcattaaacagaaagaatacggcaatacgtattcttttttcgtatatactaatatcaggatgtgctttacgacaattttcaacaagtttatctcaaatttaagctgaaagagttgagaaaaagtcagcatcgctttatgatgaaaaggtacaacaataaggaaggggattataatggatacaattgaaaagaaatcagttgccaccattcgtacactatctatagacgcaattgaaaaagcgaattccggacatccgggcatgccgatgggagccgctccgatggcatacacgctgtggacgaaatttatgaatgtaaatccgcagaatccgggctggtttaaccgcgaccgctttgttttatcagcaggccacggttcaatgcttttatacagcatgctgcatttaagcggatatgacctcagcattgaagacttgaaacagttccgtcaatggggaagcaaaacaccgggacatccggagttcgggcatacagccggagtagacgcaacgaccgggccgcttggacaggggattgcgatggcagtgggaatggcaattgcagaacgccatctggctgagacatataaccgtgattcattcaacgtagttgatcattatacatacagtatttgcggagacggcgatttaatggaaggcatttcttccgaagccgcttctcttgcaggccatcttgaattaggccgcctgatcgtattatacgattctaatgacatttccttagacggcgatttagaccgctctttctctgaaaatgtaaagcagcgttttgaagcaataaactgggaagttctttatgttgaggacggaaacaacatcgctgaattgacggctgccattgaaaaagcgcgccagaatgataaaaaaccgactttgattgaagtgaaaaccacgatcggtttcggttctccaaaccgcgcgggcacatccggcgtccacggcgctccgttaggactagaagagagcaagctgacaaaagaagcgtatgcttggacgtttgaagaagatttttatgttccggaagaagtatacgggcatttcaatcaagctgtaaaagaagccggctcgaaaaaagaacaggaatggaatgaactgttcgcggcttataaagaaaaatatcctgagcttgctgaacagctgtcactcggcatgaaaggcgagcttcctaaagactgggatcaggaagttcccgtttatgaaaaaggcagcagccttgcttcccgcgcatcttcaggtgaggtgctgaacgggatcgccaagaaaattcctttctttgtcgggggatctgctgaccttgcgggttcaaataaaacgacaatcaaaaatggaggagacttcacggccaaagactacgccgggaaaaacttctggttcggtgtccgtgaatttgcgatgggcgctgcattaaacggaatggcgcttcacggcggcctccgcgtattcggcggcacattctttgtattctctgattatttaagacctgccattcgtctggcatcattgatgggactccctgtcacttatgtattcacgcatgacagtattgccgtaggagaagacgggccgactcacgaaccgattgagcagcttgcttctttacgcgcacttcctaacctttctgtgatcagacctgctgacggaaatgaaaccgcagctgcatggaaggttgccgttcaaagccaagatcatccgacagctcttgtattgacacgccaaaacctgccgacgattgatcagcaggctgaagaagcgtatgcgggcgtggaaaaaggggcttatatcgtttccaaagcccaaacggaatcaccggccgctcttcttttagcgacaggttctgaagtcggacttgcgatcgaagctcaagcgaaactggctgaagaaaacattcacgtatctgtagtcagcatgccgagctgggaccgctttgaaaaacaatcggccgagtacaaaaacagcgtgcttcctccgaatgtgacgaaacgtcttgcgatcgaaatgggttcaagcttcggatggggcaaatttaccggtcttgaaggagacgttctcgcaattgaccgtttcggtgcttcagctccgggagaaacaattatgaaagaatacgggtttactgcagaaaacgtggttgaccgcgtgaaaaaacttctaaacaaataacgagacaaaagaggatgagtcaaatcatcctctttttcctgtttatgcgacaaaaatagaaggggcggcgtaacagtaatagacaattctttcttttctccttttgtataatagaaagcaataacgaagcgctgtaaaaggggatgaggaaatggaacgtcattactatacgcacctgataaaggatgagtttgcgaaccactacttcgggcgggaaacggctatgtttgagttgtttcgagactatcattggacagatctgacaccccaggaatatcaaatgacagaaaagcaagttcaatatataacggaaccgattccggtgatacatatgcatcagcatctccagctgcatttaaaccgaatgagttacagccgtttggattccatttaccggcttacactgcccggagaaaagggccgcgccaccttcatgatgaaagacagtttaattgagattgcggcttcgggagattatgaggcggaaacgattttctttgagattctgcgtaaaatcagcccctgttttcttgcaatggatttcaagacacggcgctacgggtggttaaatccggtcagagaaagaaattttgtctaaaaacgaggaaaaagagatgtaaatgttgtataatagcctttggtttagtacactttaaactagacaacatgaaggaggaaataaaatgactttatgggttggcatcctagtgggcgttgtcgcattgctcataggtgttgcactcgggttttttattgctcgtaaatatatgatgagctatttgaaaaagaatccgcctattaatgaacaaatgttacgcatgatgatgatgcaaatgggaatgaaaccttctcaaaagaaaattaatcaaatgatgaaagccatgaataatcaagcgaaataatacgtacagattatgatatagagatacatggttataaaaataaaaaacccggagagggttttttattttggcgtcatgtttcaccccaactgccggtgtgcagttctttttggtattgtatgagaaggtggtcaagctcctggctgagttctatcgtaatgtttgatgtcattccgtttgtcatgacgattttaagcagctctgcccgttttttttcaatttcatttaatagatgctctctaatcacagggatatatcctttcatacataaatctttcacctgagtcgctattattatatccacatttatactgtttttcaaataagaaggagtataatatctcgatgtcaaattaaattatataagctttttctataaaaagtaatccttctcgggaaagtgttaaaaaaatgaaatgattttgtcataactcgaagggagtgtgtcatcgtgagttttaattactttctgacgtttggggccggatttctgtctttcatttctccatgctgtctgccgctgtaccccgcctttttatcttacataactggtgtcagtatggacgaggtgaaaacagaaaaggtgatgctgcaaaagcgtggcctcgtgcatacactttgttttttgcttggtttctccgtgatttttatcgcattgggatatggaacttcgtttatcggcagtttttttacccaatatcatgaagcgatccgccagttcggcgctatcatgctgatccttttcgggctgattactgctggcgtgtttcagccgaaattcatgatgaaagagcggcgcattcactttaagcgccgtccggaggggtttatcggttcggttctgatcggtcttgcgtttgcagccggatggtcgccgtgcagcgggcctattttaggagccgtgttttcgctggcaaatacaaatccttcttcagcagtgccgtatatgtttttatatgttctcggttttgcgattccttttcttgttctttcattttttattaccagaatgaattggattcgcaagcatcagctgcttatcatgaaaatcggcggcattcttatgattctgatcggagttatgctgttttttaactggatgagctacattctgatcgttctgtcaaatcttttcggaggatttacgggtctgtaacggattaataacttttgaactattatataccctttcgtttttggtacaataagactagttaatgttaaatatgtggaggggaatatgacacgagttttagttgtagatgacgccaagttcatgagggtgaaaatcagagagattctggaatcggcaaattacacagtggccgggaagcggctgacggcgaggaagctctggcagtatatcaaaaaatccgtcccgacctggtgacaatggatattaccatgccggtcaaaaacggtatacaggcgctgcaggatattttagcttttgacccgaaagcccggatcatcatgtgcaccgccatgcggcagcagcggatcgttctggaagcgattgaattaggcgctaaagactttatcgttaaaccgtttgaagcatctaaagtgctggaggccgtaggccgggtagcgggaacgtaaacgtgttctcttttcaaattggttttttttatgtttttggagtatagtatatagtatcaaactccgtgcaagcaaaggaatgataaagatgatgattataatttcatccgttattgcagcggccatggcaatttccgtgatgatcgtcaggattaaagcctccgacaagcccgcttcacctaaaaaaataattctcccgccgattttcatgagtacgggagcgcttatgttcctttttccgattttcagagtgacgggcgaagaatttttggaggccattacgctgggcgtgatcttctctatttttctgattaaaacatctaaatttgagattaaaaataatgaaatctatttaaaacggtcaaaagcgtttgtgtttatcctgattggtttgctggttatcagaatcgctatgaaatctattttgagcacgacgattgattacggagctttaagcggaatgttttggattctggctttcggaatgattgtcccgtggcgcatcgcgatgtttatgtcttaccgcaaactttctaatgaactgaagaccgctgatattcagatgaattaaaacctttccgtccgccggaaaggttttttatttgagcagggcctgataaggagtaagatcaatctgtttttcgcgaagatgcttttttaaaaattgatgatcacgcttaggagtggcgagtatgtaacccctgatgattaaatcacggtttatttgttcagcttcctccgctaaggaaagttcaccgatttttccggcgattttcgctttggctacatcccgaaagagctccggcacgggagcgaccaattcatccaaaaacgccttgtcacccgcattccataagtgcctgcttttttcaatataatagtcctgccaatccagttctgaccggccgtcttctttcggtaagcgttttaaaaattttcgaaacataaaaaacccgccgatagacagcaatccgatcatcacgatgacccaaaataaaataaaccacataaaccagccttctagcattgttctatctcctccttactttaaccatattgtaaacgaagacagaatagaagaacacatgaaaaaaagaatagaaaaaatgatagatgtccagtcattccggttgctagaacatattctatcgtatagtgattctgctatttggccatgggagattcactttgagggtatatgactgatatgaccggacaaaaaagccgcttccattgagggatgaaagcggcttttttatgttatagaggaaattgaaaggaaaatgaggcaggagtctcattaggctccttgttcatggagacggtcagaatatggttggtgaaatcagtgaaaatatgtttgtcattcagataaaaaggaagcaccatttgtttgtttaacgtccgttcaagcgttttaacagagagcataaactcatttcccgaaagagtgacggtgatcgcctgcacctgcttcagcgccgtcaggtcggcttcaatgatatattgacggcttgtttcatatagatcgatcggcagcgtctcgtcataccaagcatacgggtcctcgtaaaactgccgcagccattcttccgtatcatcaaattcttcagcgttttttgagtgattcatggaagcattcctccatattaaaaagccttgctataacgtatgcagaagctttaaatgggtgaatggcacaaaaaaacagacaccggggtctgttttacatatcgtggcttgtattatgtttttgtcttgtatggttgcggttttttacttttttgcttccgctcagcggttcaggctggccggggttatggcccttcggagcatttttatgcatatctttacttgtatttttatttgtcatgttaaagcctcctttttaaggtgttccggctattggtttgtttttctttttttattgttctgccgttcttcttccgtcaggacgagctggtcattttctatataacccgcgcctttgccttggcttttcgcatcattcatgccgttaattacatgattggctttccgttttaccatgatcatcacctcaacattaatatggctctttacagcccgttgtatgaggcggaaaatcggacaaaatttaccgaaaatcatgctgataagacgatcttattgtatttaataaaaacattgatatttacttatgtatgattttatactaagatgaaattgtgagaaaattgtgatggaatgtgaacattcatctaaagaacgatcttgatcattgaagggggattttggagaatgacaaatcagcaaaaagtcgcaacacaagacgttttccaagcaagaaaaacattttcttcaaatgggaaaacatacaactactattcattaaaagcattggaagacgcaggggtcggcaatgtttcaaaacttccttattctattaaggttcttttggaatccgttttgcgtcaggtagacggacgcgtcattacaaaagaacatgttgaaaatttagcaagatggggtactgctgaattaaaagatatcgatgtgccgtttaaaccgtcacgggttattctgcaggactttaccggcgttccggccgtagttgacctggcatctttaagaaaagccatggcctctgtcggcggagaccctgataaaatcaatcctgaaattccggttgacctggtcattgaccactccgtacaagttgacaaagccggtacggaagatgcgttagccattaatatggacttagaattcgaaagaaatgcagaacgttataaatttttaagctgggcaaagaaagcgtttaacaattatcaggccgttccgcctgcaacaggtatcgttcaccaggtaaaccttgagtttttggcaagtgttgttcatacgaaagaggaagacggagaacttgtgacctatcccgatactttggtgggaacagattcccatacaacaatgattaacggaatcggcgtcctcggctggggtgtcggcggtattgaggcggaagcgggaatgctcggccagccttcatatttccctgttcctgaggtcatcggcgcgaaacttgtcggaaaattgcctaatggaacgacggcgactgacttggcgctgaaagtcactcaagtgctgcgtgaaaaaggcgtagtcaataaatttgttgaattcttcggtcctggtgttgctgagcttccgcttgcggatcgggcgactattgccaatatggcgccggaatacggagcgacttgcggattcttcccggttgacgaggaagcactttcttacctgcgtctgaccggccgtgaagaagagcagatcgatattgtggaagcatactgccgcagcaacggtttattctatacgcctgacgcggaagagccgatttttacagacgttgtggaaattgatctgtcaaaaatcgaagcgaacctttcaggcccgaaacgtcctcaggatttaatcccgctttccgttatgcaggaaacgtttaaaaaacatcttgtcagcccggccggcaaccaaggattcggagcggatgctgctgaagagaacaaagaaatttcatttaaacttaacagcggtgaagatgcggttatgaaaacaggggcgattgcaatcgccgctattacaagctgtacgaatacatcaaacccttatgtattaatcggtgccggattggtagccaaaaaagcggtagaattaggcttgaaagtgccgaattatgtgaagacttcacttgcaccggggtctaaggttgttactggatacttagtcaactcaggtctgcttccttacatgaaggagctcggctttaaccttgtagggtatggctgtacgacatgtatcgggaactccggcccgctttctccagagattgaagaagcagttgctaaaaatgatctcttgatcacttctgtcctgtcgggtaacagaaactttgaaggccggatccatccgcttgtcaaaggaaactaccttgcgtcaccgccgcttgttgtcgcatacgcattggcgggcactgtaaacatcaacctgaaaacggacccgatcggtgtcggaaatgacggacaaaatgtttatttcgatgacatctggccgtccatggatgaaatcaattctctcgtcaaacagactgttacgccggaattattccgcaaagagtatgaaacggtatttgacgacaaccagcgctggaacgaaatcgaaacgacggatgaagcgctgtataagtgggaccaggattccacttacattcaaaacccgccgttctttgaggaaatgtctgtagagccgggaaaagttgagcctttaagaggacttcgcgttgtcggcaaattcggcgattccgtgacgactgaccacatttctccggccggagcgatcggaaaagacacaccggcgggcaaatacctgcaggaaaaaggcgtttctcctcgtgactttaactcttacggctcacgccgcggaaaccatgaagtcatgatgagaggaacattcgccaatatccgcattaaaaaccaaatcgcaccgggtacagaaggcggatacacaacacattggcctaccggggaagtgacatctatttatgatgcctgcatgcggtataaagaagataaaacgggtcttgtcgtcctggccggaaaagattacggaatgggctcttcacgtgactgggctgcaaaaggaacaaacctgctcggcatcagaacagtcattgccgaaagctttgaaagaattcacagaagcaacctcgtcttcatgggtgtgctgccgctccagttcaaacagggtgaaaacgcggatacactcggcttaacaggtaaggaagtcattgaggtggatgttgatgaatctgtacgtccgcgcgacttgctgactgtcagagcaatcagtgaagacggtacggtaaaaacgtttgaagtcgttgtccgtttcgacagtgaagtggaaattgattactatcgccacggcggcattttacaaatggtgcttcgcgataaaatgaaacagtagcagaatgaacaaaggagagaaagcagtctgctttctctctttttatgcgggaggccttaagatgcttgcgaaatggctgggcggaatgttacttatcgggttgttagtgtatgcgggctggaacatttattctgtgcaaaaaagtccgaaagaagggacagaagaagggatgaaagcccctgactttacacttgatacattgtcaggaaaaagtatctccctttctgattataaaggaaaaaaagtgctcctcaatttctgggcgacgtggtgcaagccgtgcagaatggaaatgcccgatatgcaggagctgcagaaagaatatcctgatattgcggtagcagccgttaattttacatcctctgaaaaaaatatacaggctgtgaaatcatttgctgatcattatcagctgacctttcctattctgattgacaaaagcggaattaacggggatttcaacgtgctttcttatccgacaacatacatattagacgaaaaaggaaccattcagcacattcgcgtaggcacgatgacaaaaaaagaaatgaaagaaaaactggatctcaaatagaggttcagtttttttattgtaaagggcttaggttttgaaaaattggaaaaaatgaatgaaaacacggaggtgagaagattgaaaaaaatgcgaaaacgttcttttcatgaattggttatggaaaataaacgtgagctgatgaccaatacggaatatttgaatcagcttgaagaaaagctggagcagcggttcaaacaaaaataacctttaatttgcagtcatgtttacacctccttttgcaaaatatactcttaaggagggatgaacatgggcataaacaagaaagacggccagccgcaatacgctccgagccacttagggacaaaacccgttaaatataaacgcaataaaggggaaaagtttcatgacaagtcaaacggacatccgattgtcatgcagacgaaaggcgaataacatcatcaaaggagagcagacattatgacaaacaatgatcaaaaaccgaatccggatgaccgttccgataacgttgaaaagctgcaggatatggtgcagaatacaattgaaaatatagaagaagcgaaagaatcaatggaatttgcgacagatgaggaaaaacagcgcattcaagagaagaatgccagacgcaatgaaagcattgaatcgttccgcagtgaaattcaggatgaatcggctgcaagagaaaacggctatcaatcataataaaaaccagggaaacctggtttttttctctttccggctcgttgtgataaaatggggctaatctgataaaaagggagcagagaacgttgcgtgtgtcaaaaaaagaaatagaagtgcgttatgcggaaacagatcaaatgggcatcgtctatcatgccaattacttagtctggatggaggtcggcagaacggcgctgattaaggaactcggattcctttacaaagatatggaagatagaggagtgctgtcccctgtattggatatcagcatttcttataaaaagccgctccgctacggagaaacggctgtcgtacatacttggattgaagaatataacggatttaaaaccgtttacggctaccacatctataatccggatcaagaacttgccatcaaagcgacatcctctcatatatgcgttgataaagagagcttcaaaccgattcagtttcgcaaggcttttcctgattggcatgccgcttacgaaaaggcaaaaaaataaggagcggctgcagttatggcatttggaattacgcgtaaggaactggaaagatggaagcgggatgtatcggaagggaaaatcgcttttttaacgcattactggctggacgaccgctttccggaggctaagaccgtgacgaaggccggttcaagcgatctcaataaactgatcagatggggagcggagtacgggctgaagccggagtggattcaccataaaaatgaatttccccactttgacctgctcggagaaacgcaaagaagcatattagaaaaagaacgtctgactgatcatctcaaaaggttcaggctgtaaaaaaagaacgcatccgctgcgttctttttttacacgtaatcaaataccggctcttctgcctgatctgaatatgtgactgacaaatcgtgattatcaaagtaccataagtcgctttcttcaataaaaaaggtaatgccttcaacttccgtgctggtgccgatgttcatcggccggtcttttaaaatgccgagagaaaagcctttctggacgttgctgcatcccccgtaacggacaaagaaacggacatggtcgcctgtttccagatcgagctcttctttgtaccaatccagcgcgcctttcgttactttcatgttcatccggaacactccctttttgtttctcatataaagaaattatctctattataaacgcatatggcattttgatgtcaaaattgaagtttcatcaaaaccatttgatcttaggttctgttttgtttataatccgtttgatgtttgccctgtgtctgtagataacaaacgcggtcaagagcgtcactacgattaataaataagggtcttttacaaacagacagtaaataatcgtataaatccctgttaacattgaagacagagaaacaaatttcgtaaggaataaaaatacgaaaaatactgcaaccatcgtaacgaataacagcggagcataaaacagcaggacgccccctgatgtggctacggctttgcctcctttaaactttgcgaacaccgggaatacatggccgatcactgctgccacccctgcgagaagaggatgaatggggacgtgcagtaaatatgggagcgctgcggccagggtgccttttaaaatatcggctgcgacgacgacagatcccgctttaacgccaagcgtgcgaaaagcatttgtagcgcccaaattgccgcttccgtgttctctaatatcgatccctttcgcaagtttgcctacgactaaacctgacgggatgctgcctattacataggccaaaataatcaataaaacaatcaacatctacatttctccttttcaatgtcccttcactctattttaacacgagttgttaccgtctgatgacaagttttttgagaattaagctgacaaagcgctttttttgattccggcgaagcggtcatgtacaatatatcaaaaggagatggtaaagatgcaaaatccttcaaaatcagagattaaagaaattctggaccggagcaaacggatcgcagtcgtcgggctgtcagaccgtcccgaccggacttcttacatggtttccaaagcgatgcaggatgaaggatatgaaattattcccgtcaacccaacgattgatgaggcgcttggcgttaaagccgttgcttcgttaaaagacgtggaggggccgattgatatcgtgaatgtgttcagacgctctgagcagcttcccggcgttgctgaagaatttttacagacggacgctcccgttttttgggcgcagcagggccttgcaaatgaagaagcgtatcgcatgattacagacaaaggacggacggctgttatggatttatgtataaaagtcgcccgcgctgttataaaataggaacaaaaaaggcaaaaatccttggcaaatcaggggtttttgcttttttattgaaagaatactctttgcgtatgatgatgaaacagatacaataaagcatgaacagcttttttagaaacccctttatacaggggtttgcagtctgtttgcgatggccggcataaagctatataatagaaagcgaactcatgttcttatctgccgaaaagggcaccaaaaagatgaaaagccgttcgaatgtatgtcttgcggcctaaaaaaacgagccattcgcttaaatatgttgcgaaatcaagcatattggttataattgtgagtccgaggagaattggaccgaagcttgcgcatactgaaaaacaaagacatgaaaacatttaaaaaagagaatgattaagagcaggttttttgaaaggggtttgtacgtttggctagaaaacagcaatttgattacaacgaagatgccatacaggtgcttgaaggcctggaagccgtcagaaaacgaccgggaatgtacatcggttcgacggacgcacgcggcctgcaccatctggtatatgagatcgtcgacaattccgtcgatgaagttcttgccggctacggagatcatattatcgtaacgatacataaggacaacagcatctctgtacaggacagaggacgcggaatgccgaccgggatgcataagctcggaaagccgacgccggaagttattttcaccgtgctgcatgccggggggaaattcggacagggcggctataaaacaagcggcggtctgcatggtgtcggcgcatctgtcgtaaacgcattatcggagtggctgacagttactattgagcgtgacggatatgtttataaacagcggtttgaaaacggcggcaagcccgtgacttcacttgaaaaaatcggaacgaccaaaaaaacgggaacgcttacccattttaaacctgatccgtcaatgttcagcgcaacggtttataattttgacacgctgtcagaacgtctgcgcgaatcggctttcttgttaaaaggtttgaaaatagaattaattgatgaacggaacggcgtaaaagaagtattttattatgagaacggaattgaagcatttgtcgcttatttaaacgaggaaaaagacgctttatgcgaagtggtgtcctttgaaggcgagcatcatgacattgaagtcgatttcgcgtttcagtttaatgacgggtattcagaaaatatgctgtcattcgttaataacgtcagaacaaaggacggcggcacccacgaatcaggagccaaaacggcaatgacaagagcgtttaacgagtatgcgcgaaaggtcgcccttttaaaagagaaagacaagaatcttgaaggcgccgatatcagggaaggtttgtccgcaatcatttccgtccgtatcccggaggaactgctgcaatttgaaggccagacgaaagggaagctcggcacaagtgaggcgagatccgccgcggatgccgtcatttccgagaatcttgcttatttcttggaagaaaaccgcgatacggcaaccctgcttgtcaaaaaagcgattaaagcaagccaggcccgtgaagcggcccgtaaagcgagagaagaagcgagaagcggcaaaaagcgcaaaaaatcagaagcgacgctgagcggaaaactcacaccggccggttccagaaatccggcgaagaatgaattgtatctggtggagggagactctgcgggaggttctgcaaaacagggaagagaccggaaattccaagccgtgctgccccttcgcggaaaggtcatcaatacagagaaagcaaagcttgcagacatcttcaaaaatgaagaaatcaatacgattattcatgcgatcggcggcggtgtcggcgcagattttgatatagacgacatcaactatgacaagatcatcatcatgacggacgcagataccgacggcgcgcacattcaagtcttgctgttaacgtttttctaccgctatatgaaacctttaatcgagcatggaaaagtcttcatcgcccttccgcctctttacaaagtgagcaaaggaagcggcaagaaagagattattgaatatgcttggtccgacgaagaaatggacggcgttttaaagaaagtcggcaaagggtataccatccagcgctataaaggtctgggagaaatgaacgcagaccagctctgggaaacgacgatgaatcccgaatcgcgaacgctcgtcagagtcaagatcgacgatgcggcacgggtagagcgccgtgtaacgacattaatgggagacaaagtagaaccgagaagaaaatggattgaaaagaatgttgccttcggattagatgaggaaagcaatattttagaaaatgaaaacttgtcggtcgctgaggaggtttaatagtggcacagccagaattatttcatgatttaccgttagaagaagtaatcggcgaccgtttcggacgctacagtaaatacattattcaagacagggcgctgcccgacgctcgtgacggtttaaagccggtgcagcggagaattttatacgccatgcacgcagacggaaatacattcgataaaaatttccgtaaagcggcgaaaacggtcggaaacgttatcggtaattatcatccgcacggtgacagctccgtttatgaagcgatggtgcggatgagccaggattggaaagtgcggaatgtgctgattgagatgcacggcaataacggaagcattgacggtgatccgccggctgccatgcgttatacggaagcgagattatcttctatcgcgtcagagcttttgcgtgatattgataaaaatacggttgaattcgttccgaactttgatgacaccagtaaagagccggttgttttgcccgccatgttccctaacttgcttgtcaacggatcaaccgggatttcagcgggctatgcgactgatattccccctcatcatctgggtgaggtcattgatgccgtcattaaacggattgaatctccggattgcaccgtcgatgacttgatgcaggtgattaaagggcctgactttccgacaggaggcattattcaaggagtcgacggcattcggaaggcttatgaaaccggtaaaggcaaaattattatccgcggcaaggctgaagtggaatccgtaagaggcggacgggagcaaatcgtcattacagaaattccgtttgaagtaaacaaagccaatctcgttaagaaaatggacgaataccgcatagacaaaaaagtcgaaggcatttctgaagtcagggatgaaactgaccgcacagggctccgggtggtcgttgagttaaagaaagaagccgatgcaaaaggcatcctgaatttcttatataaaaacactgatctgcagacaacatataactttaatatggtcgccatacataaccgccggccgatgctgatgagtcttacggccatcctggatgcgtatatttcccatcagaaggaagtggtgacaaaccgctccgtctttgaattgcaaaaagcaaaagagcggcatcacatcgttgaaggactgatgaaggcgctgtctgtgttagatgaggtcatagcggtcatccgggcaagcagcgacaagaaagatgcgaaacaaaacttaatttctaaattcgcatttacggagccgcaggccgaagcgatcgtatccttgcagctgtatcgtctgacaaacacggatattacggcgctaaaagaggaagcggaagagctcagcaagaaaattcaggagctcgaagccattttaagtcatgataaaaagctgttaaaagtcattacaagcagcctgaaaaaattgaaaaagacctatgctgacagcagacgatctgtcatcgaagaaaagattgaggaaattaaaatcaaccttgaagtcatggttgcctctgaggacgtatatgtgacagtcacaaaagacggctatgtaaaacgaacaagccagcggtcatttgctgcttctaacggccaggatttcggtatgaaggatactgacaggctgattcaccaattcgaaatgaatacaacggatgttcttctgctctttacgaataagggaagctatgtttattgtccggttcaccagcttcccgatatcaggtggaaagacatggggcagcacgtaacgaacatcatcacgattgaccgtgatgaaaccatcgtgaaagctataccggtaaaagaatttgatccatcttcatatttattgttcatgacgaaaaacggtatggtgaagagaactgaaatgacgcattacaaagcgcagcgttactcgaaagcgcttgttgcccttaacctcaaaggggatgatgagctgattgatgttcatgtcacagacggcgggagccagctgtttatcgccacccgtctcgggtacggtttatggttcggtgaagatgaagtaaatgtagtcggtgcccgtgcggccggcgtaaagggcataaatttaaaagacggtgataccgtcgtatcagggcaaatcctgcatgagacagattcgctcgtcctcgtcacacagcggggagcgatcaaacggatgaacctatctgaattcgaaaaaacatccagggcgaaacgcggtgtcatcatgctgcgagagcttaaaaagaacccgcatcgcacagtcggcgtattcgcgtgcgctttagccgacatgatcgctgcggaaacagaaaaaggcgagagaatcgaaatcgccgtgaagtccttgcggtcgaatgaccgatacagcaacggctccttctttaccgatgaagatgagacagggccggtaacagatgtatggcgtatccctgcatacgatgtttaagagtaaaaataaaaaacctccgctcattgagcggaggttttactatttagctttcatggctgccgaataagtcagtgatagcgtgaatgacttcgattccctgccatacaaataaattcaatgcagtgaatgaaaacaaccctaaaatcaccattcgtaagataaacaacatgtttaacaacctcctcattttatgttacatagataggcgatgttgaacatgaagctcatcgaaatacgaggactgataaaatttagcgattaaaaagcttttctttcgctgtcttctccgggaagcggggcgtctcctgtctgatatcacgatcagtgagacagaagcggcaaaaagcgccgtcaagatatatgagcccgtcagcgattttttctcatcatcagcattttggccggccttcatttcgtgcatttcctgctggtcggctaccgctttaaaatgatgagcggtatcaaacgcatggggaatggagagcaaatgaaagcttgcaatcgctaaaaataaaatagaagcttttaaaaacaagatttttttcaaatgttctccccccttcataagtctgaatatttttattataataccctaatttaaatgtaaagtaaacacatttattaaatttaaaaaattattatcctggttaagtatataccattccatccatcttttcatctcttttttcttaaagacctatttgttatgatatgcacgcattccttatgacgtgacaacatttttcgggctgtaagataaaaaacggggcatgacagcaaaagatgtgatgaagaaaccgaaacattttcttaaaaaaacttctcaaccactgttgttgtgatataataatacccgttgtgttaaaagatctaacatatgcagcaaaaatgacagtaaaagatatgtaaaagggaggttaaacatggaggctttcatcagtgaaatcataaatgttccaaatgattttatttggaagtatcttgtttatattttagtcgggatcggattgtactttacgttccgttttcgctttattcaattccagtacttttttgaaatgttcagaatcgtcggggagaagccgcaaggaaataaaggagtgtcttcaatgcaggcattctttatctcagccgcttctcgtgtcggaaccggaaacttgaccggcgtcgcgctggcgattgcaacaggcggtcccggcgcagtattttggatgtggatcgtagcgattgtcggtatggcttccagctttgtggaaagcaccttggcgcagctgtataaagtgcgttccggtgacgaattccgcggcggtccggcatattacatggcaaagggactgggcgcccgctggctcggtattttatttgccgtattgattaccgtttctttcggacttatctttaacgccgtgcagtcaaatacgatttctgtggcgtttgacgaagcattccatgtgaataaaacagttatcgcaatcattttagctgtactaacggctttcattatattcggcggtctgaagcgtgttgtttccgtctcgcaattaatcgttccggttatggcgggaatgtatatcctgatcgcgctgtatgtcgtgattgtaaatatctcggcggtacctgagctgcttgttacgattgtgaaaaatgcgttcggttttgagcagatcgtcggcggaagcttaggaagcatcattattatcggagcgcagcgcggcctgttttcaaacgaagcgggaatgggaagcgcgccgaatgcggcagcagctgcacatgtgtcgcatccggctaagcagggattaattcagaccctcggcgtgttctttgatacgtttatcgtttgtacatcgactgcttttatcattttattgtacagctttacgcctaaaggcgacggcatccaagtgacgcaagccgcactgcagcaccatctcggcggatgggcgccgacatttattgcgattgcgatgtttttattcgcattcagctcagtcgtcggcaactattactatggtgaaacgaatatcgaatttattaaaacaagcaaaacatggcttaatatttaccgcgtattcgtcgtagtgatggtggtatacggatgtttggctgacttccagatcgtctgggacatggcaaacttgtttatgggactcttggctctcattaacttagtggcaatcttactgctgagtaatgtagcctacaagatctataaggattatgccgctcagcgcaaaaaaggtcttgatcctgtattcaaagccgagaataccccggagctccagcatattgaaacatgggcggaagaagaaggtacaagccctgaacgtaagactgctaactgaggacacatgcatacaatattcaaaaaacccccttacattttgttgtgaggggttttttatgtgaaaaaacgggttatttttactgaaaacagatttttttgaatttattgtatttttctcttgtgtatgtaagggctttcatataaagtttaactaaaccggtttaccaaaccgatttagtcttaaaggaaaggagtattgatgtggcttctgattatggcatttttacgatcggtgatgcgatgatcaccttaaatcccgcaagcacaggacctttgcgttttgttacccattttgaacgaaaagcaggaggagctgaactgaattttgcgattgcatgcgccagattgaacctgcactcaaagtgggtcagcagactggggaaggatgagttcggcagagtgatttatcagtttgccaaaggagaaggaattgatgtgactgacgtctcctatgttgaaggctttcctacatctttaaatgtcaaagagatcagaaatgacggttcaggcaagacgttttactatcgtttcaattcaccaattctgactcttgcaccggaagatataacagagaatatgtttgccggcattcacatcgttcatcttaccggtgtgttcctcgcacttgataagaaaaatcttgaaattgctgaaagagtgctttccatcgccaaagcaagaaagattcccgtatcttttgatccgaatatcaggctgaagctgtggacgattgaggaggcgcgtgcggcatttcatcaaatctttccgcatactgatattcttctggcgggccgggacgaaatgaaacagctgacaggtataggagaaaatgaagcattagcccggtttgcagagagctattcaatcagtcagcttgttataaaagacggtgaagcaggttctgcgctgtatcatgatcataagtgggttcacaaagaggctttcccggttgcgcctgttgacacggtaggagcgggtgacggctttaatgccggctacctgtacagttatttgcatggttttgaaccggaaaaacgtctggagtttgcaaatgcagtcggtgcgctcgtcaccacagtttccggtgacaatgaagggcttccctgcctagaagaggttttgtcatttgtaaacaaagagactgtgattgaacggtagcaagcacaacttaaaaagcgggtgaaaaaatgaaagcggttcaagtacggaaagcatttgatctgagggtgacggaatgtgagaaaccgtctgttgtccacgcggatgatgttcttgtcaaggtgaagcgggtcggaatttgcggatcagatttgcatatttatcatgggacaaatccgttagcttccctgccgagagtaatcggacatgaagtcacaggggaagtcgcaaagaccggttctcatgtccggcgtttcaagccgggtgaccgggtagtgattgaaccgatatcttattgcggaacatgctatgcctgccggaaaggacgtccgaacgtctgcaaagcgctttcggtgttcggcgttcatgaagatggcgggatgcgggaatatatcgtgcttccggaaaagctgctgcatgctgtttcgcccgatctgccttgggaggaagcggtcatggcagaaccatatacgatcggcgcccaggccgtttggagaggccgtgtcgagaaggaagataccgttttgattcaaggagcgggaccaatcggaatctgcatattaaaaatggcaaagttcaaaggcgcttccgtcatgataaccgacttgaatgatgaacgcttagcattcgctgaaaaaaacggtgcggacgttactgtcaacgcgcaaaaagaagatcccgttttgcgggtgaacgaatggacaaaaaatgaaggcgccaatgtcgtcattgatgctgtctgtctcccctcaacgtttgaaacgtccattgacgcggtgtctccggccggtcatgtggttgtgctaggttttgatgagaggactgccggcatttctcagcttccgatcacaaaaaaggaagtcacgatcaccggttcaagattgcagacgaatcagtttccgtacattacagacttactgaataaaggcctgttaacgcacggcggtcttattacacatacattttcagcagatgacgtccatcaagcatttcagttgatcgaacagcacccgggcaaggtgggaaaagcaatcattacgtttgattaaaggaggagcgagaatgctgcctaagtacgccatttacgaaaaacttctgcatgcacaagtggtggctgtcataaggggacaaaacagccaagaggcgcttgaagtttcaaaagcggccatttcaggaggtatcagcgccattgagcttacatacacaactcctgaagtggaagatgtctttaaggaactccggcatcaagatattcttcttggagccggttctgtaatggataccgaaacagcgagacacgccattttatcaggcgcctcatttatcgtcagctctcattttgtaaaagagatagcatctctatgcaaccagtacagcgtaccgtatcttccgggatgcatgagcgtgtctgatatggctttggcgctcgaagccggatgtgatgtggtaaagctgttccccgctaattcgtttaatccctcatttatcaagtcggtcaacggccctctgccgaatgtccgcattatgccgaccggggtatctcattaaacagcatgaatgactggctttctgccggagcggtcgcggtcggagtgggaagtgacttgataaaagcatatcaaaagggcggctatgaagctgccgtatccctcagcaaagaatacgtctgccgaaaaaacgaatatacggggtgtaacatgaatatcacgtttcgctggtatggccaaggtaatgatacggtgactcttgaacatgtcagacaaattcccggggtcaaaggcatcgtctgggctcttcaccagaagcccgcgggcgaagtatgggaaaaggaggacattgaagcggaagtcagattcattcaatcctatgggtttcatgcagaggtcgtggaaagcgtgaatgttcatgaagccattaaactcggccatgaagaacgcggacaatatatcgaacactataaacagaccattcgcaatctgtccgaattcggcgtgaaagtcatctgttacaatttcatgccgatatttgactggacgcgtaccgatatgttccgcgcgctggaggatgggtcaaccgctttgttttttgaaaaagcgaaagtggaaagtctgcctccggaggaactgatccgcacggttgagaaatcttctgatttgacgcttcccgggtgggagccggagaaaatggcccggatcaaggaactgtttgaggcctatcaaacggtcggtgaaaaacagctttgggccaatctagaattctttttacatgaaatccttcctgtagcggaggaacaccggcattcaaatggccattcatccggatgatccgccctggtcaatttttggcctgccccgtattatcaccggtgagaatgttatgaaaagctgcgagagatttcagattcacccgccaactgtattacgttgtgcacgggttcgatgggagcggatcccgccaatgatatggtgaagatcgccaaacactatgcgggagctgcgccgtttgcccatatacgaaatgtgaaaatctgtgataacggtgattttacggaaacttcgcatcttaccagtgatgggtccattgatattaccggtgtggtaaaagaattgcacggccaaggctacaaaggatatgtacggcctgatcacggccgtcatatctggggcgaacaatgccggccgggctatggtttatatgatcgtgccttaggaattatgtacttgaacggactgtgggatgcgttctcgtctcatgagaaagaggtggaaggatgagaccgattcatgaacgtttatcaggaagaaccgctgtcataacaggcgggagcggtgttctctgttcagcaatggcaaaggagctttcacggcaggggatgaaaattgcgatcgtcagccggaatgctgataaagcagagcgtgcggcgggcgagattgctgacgctggaggaaccgcggtttctgtaccggctgatgtttcagcccgtgattctctcgaaaaggcaaaagacgagattatcagccggttcggttctgtcaatcttttaattaacggagccgggggaaaccacgctgatgcgatcactgccagtgagacgtatgaagaggatgagcagagcccatcattttttgatatggacgaaacgggattttccagcgtattttcaagcaactttaccggtgcatttctggcatcgcaagtgtttggaaaagaccttttgaaggcggaatatcccgcgattattaatgtttcttctatgagcgcgtatacaccgatgacaaaggtgcctgcctacagcgcggctaaggcggcggttcagaattttacgatgtggatggctgttcatttcgcaaaaaaagggctgcgggtgaatgccatcgctccgggtttctttttgactgcgcaaaaccgtgagttattattacaggaagatggaagtctgacagaccgatccaataagattatggcacatacaccgatgaaacgtttcgggaaaccggaagaccttctgggaacgctcctgtggctttcggatgattcatgctcaggctttatcaccggggtcaccgttcccgtcgacggaggttttatggcttattcgggagtgtgacagaatccagttccctgtcagattgtaaacgatttacttctgacttatactagtgaaaaatgaagacagacggggatgagtctatgaaaaccattacaatttctgatgtggcgaaatatgcaaacgtatctaaaagcaccgtatctcaatttttaaatcagcgctatgactatatgagcgagaaaacgaaacaaaaaatagaagcggccattcaagagctgaactatcagccgaatttcgtcgcccgcagcttaaaacagaaatcaacatttacggtaggtgtggtggtggctaatattcttcacaccttttccactcaggtcatcagggcggttgaagactattttcatgaacaaggatttcatattattgtctgcaatgcggatgatgaaccggaaaaagaaaagaaatatattgaaatgctcagggccaagcaggtggacggaattattatttttccgacgggcgaaaatctctccttatatgaaaagatgaaacgcgatacgtttccggtcgtgtttatggacagaaccattgaagaactcgggattccgacagtgatgcttgataaccatcatgcagccggtcttgccgttgaccggtttatcgagagcggcattaagagaatcgcgattattacgacgtccattattcgggaaatcagtccgagggtagagcggattgaagggtataaaaaggcgcttgaccgccacggaatgatggtgcggaacgaatatatcaaaacagccgatgcggctgatatttccaatgttttgtcagagctgttctcacttcaggagcctccgaaagcgatattggcggcaaacgatatcgttcttgttgaggtgctgaagtatatgaaggagcatgatatgacaattcctgataaggcagccgtcatcggaattgatgaagttccttttgcgggtttttttactcctccgattacgacgatcgtccagcctgcggcagaaatggcgcgaaaagcgggaagccttcttcttcgccagatacaagaaaaagatagcggtgaaaaacggatataccgctataaaccggcgcttctcgcaaggcaatccggataaccggtttcattgcataaaccggtttactccggcaatttaaattatgaaataagagggagggattttatgttctcaaaggatagattccctattattcttcttttattttcagccggggtgattaactatttagaccgctcagcgctgtctattgcagcgccgttcatacagcaggatctcacattgtctgcaacccaaatggggctgattttcagcagtttttctgtcggatacgctgtgtttaactttctcggcggtgttgcatctgaccggtacggggctaaattgacattgtgtacggcgatgatcgtttggtctcttttcagcggggcggttgcgcttgctttcggatttgtaagtcttttgattatccgtattttattcggtatgggcgaggggccgctgtcggctgccataagcaaaatggtcaacaattggtttcctccgtctcagcgcgccacggtcatcggcctgacaaacagcggcacgccgctcggcgcggagcgatttccggcccgattgtcgggatgattgctgtggcattcagctggaaggtttcctttgtcctgatcatgatcgtgggtttagtctgggcgtttatctggtttaaatttgtcaaagaacggccggcgccgacggaagacgccccggccatgaaagcggcgattcaatcgcatgagcagcatatcccgatgaccttttatttgaaacaaaaaacggttctcttcacggcttttgcctttttcgcctacaattacatcttatttttcttcttaacatggtttccgagctatctggtgaaagaacgcggtttaagtgttgaatttatgagtgtggtgactgttattccctggattcttggatttatcggtttggcggcaggcggaatgatttctgattatgtattcaaaaaaaccgccggaaaaggggttttattctcacggaaagtcattcttgtcacttgcctgttcgcttccgctgtactgatcggatttgccggacttgttaccactgccgtaagtgccgttattctcgttgctttatcagtcttctttttatatataacgggctctatctattgggcggtgattcacgatgtggttgatcaaaggaatgtcgggtcagtcggcggctttatgcattttcttgcaaacacggccggtattatcgggcctgctttaaccggctttatcgcggataaaagcggatcattctcgggggcgtttttgcttgcaggcggattagctgttttggcctcagctgcggtaatccgtttcgtgcgtccgattatcattcaaacagtttctgaagataaaaaagacaccataccttattcataagtcatcaaagtcattgaggctgtcctgccgataacgggatggccttttcgttctgccgtttgacctgttcctatgataatataggaattgtttacaaaagaagggaagagaagggagcatgaaacagaagccgatatatgtcgaaatcaatattgcatctgatatagaaacactttgggaatatacgcaaaacccgcatcttcataaggaatgggatctgcgtttttctgacattacatatcttcataggctgccagatgaaccgcagagatttctatatgaaacacgaatcggttttgggctgaaggtatccggcacaggcgaatcaataggtgacatgaggcctcgctcgtcagaaagagtgtcttcgctcgcttttgcctctgatcatccgctgtcacttataaaagaaggcaggggctactggaagtatatagagcgggataacggacaaacctcatttttgactcaatatcaatatgaaacggtccgcggtctgccgggaagttggatagaccggtttttatttcgtcctctgctaagctgggctaccgcatggagctttgatgcgttgcggctttggatagaacaaaacagacatccgaagatatcagtccgtttcggatttgtctatgtctgtatgtgtctcgtattcagtctgtattggttttttcaaggctttcatgatggctgtgccgatgcagagatcgtgaggggagcgctggagacagggttaggggtattatggctgcttcccatgcggagaaagtggctgattcacgccgggcagtcagtcttcttttgtgtaacggcactgctatattccggcggcggattcgtgatctctttaggagtgcttacgatagccggcatgattcttaagttcaagctgccgagcgcctggcatacaaaacgaaagagagaagtgaaatgacggattcaatgtatgaaaaagcgattactcattatcaatcactgcacccgatgctgcagaaacggtacagatttgacggatcacgcacgttttgcggagaaggcgttatgtcagaaataaagggaggttcttttcttgtcagaatgcttttaaagaccggtgtttttttcagatgttttttctcagagaggggaaacgatatccctttcactatcgaaaacaaaatcaggcaaaatggcgtggaatggaatcgtacctttttctttaaaagcaaaacgcgtttttttgatgcagtcatggaatatgatgagcgggaaaacagaattcttgattacttcggcaaacctcacatcctactgtctgaactgcatttagaagcgtcttcagacggagggcttgttattacatccggaaggcagtggctcctgataggcggaaagaaaatcccgcttccggcatggctgtgcggcagttcaaccgtttatgaggcttatgatgaggaaatgaattgcttcagcataaaggttcatgtgaaaaaccggatactcggcacgcttttctcttaccgggggactttccgggaaacagagggagaaacatgctgaagcgtcatctcatggtcagcgtgattagctttttgggatttgcggcggctgaagctccgtatatatcagctgctgagacgtttgttttattatccatactttttttcgttcccgctgtattctgctttgcttttcggccgtcaaagaccttagagaatgtgttgttacggagttatcctgttgccgctatatgtgcggcgcttgcgcttgtcacaggcttcagtttttttgcctttgtgtggctcatttatacgcttggactggcactgtatgctgtctggcggctgatgaaaacaaatattcacagaacagaagagatgtctgttatggcgggtttcatttatttggccgggggcggattctggttcttcgcatatgttcttgagattcccgtcatgaatttcggcccgcttatcgttctgctgacggcggtgcactttcactattccgcttttctcattccgatctttaacggattgctcggcaggatcatacgggagaaacgcgtactttaccggtggagcacggtcattattttgatttcgccggtccttattgccttggggattacattttcaaagacacttgatgtgattgctgtcgctctgtacctggcgggtctgtatgtaaatgcatatctcgtctttaaggcgccgtttgttacgaaaacaggcaggatcttgatcaggagttcttcggctgtgttaatgatcacaattgctttttctttgatatattcgtacggtgtctaccgcgaggaggcaacgctcacgatcagccagatgatttggattcacggggccgtcaatgcattcggcgttatcctgccggctttggcggggtggagaatagaaaatcctagaccgttcgatgagaacagtgaaagaacgttcagcagaatttacgggaaaggaacgataggcaaagattttttgactgacattcatgcagcaaatgacatccattataccggccttcaggatcagctgagagaactgcattctgaagacttttcaattgaaaagctggcgccggccgttatttccttttatgaagagacaattgattatgacatcatggcaaaagtgacatggagcggatggtttcgtccgttcgcgtgcgtgtacgagcggttcagcagaagagcggggcagattcatctgtccatgaatccggattggtatatcatgcacagtgatattataggaattgactctgacaaagacggcagaaaaaatgtccgtgcgtggatcagaacaaatgaaaagcaggaaaccgtttttactgcgctgtattcagcgtacagggcaaaaggggaaggatacatgaatatctctcttccgctgccgtacggccaaatgacgggcattttaaagccttatgcgcataagcagaatcttgttttgacaagcagacggcgaaaaagcggagcgggtgatgaagggatttatctccagacaaaatggggaacgtgtcatcttccgctggcagagacatttcttatttcagcccagagcgaaacaagcctgaaggccgttcatcatatgtggctgttcggactgaaatttttaactgtgcattatcggatcactcacgcttccgcaggtaaccgaagcaaataacaagctgcagagccgtctgttcatcaggcggctttttctcatgcaaagattcctacattgagcggcatgatgaaggcagccgggcagatggccctgctgaaaatcttgttctttttgtttatgattccgcacgcactggctctgttagtgatgagaacttttgttcgcaggtgcggaaactgggtcacattgccgtttttatttaaatcattccttttataataggtttttcactcggcattatctttcctttgctgcttggaatgtcgattgagtctgttccggcgggcatgagagcaacatcgatggggcataccaggcgctttatgcactcggtattttcggaggaccttggttgcgggattttttaatgattggctgggctcagagccggattttatttcgctgcagtgctttggctggcggctgtcatacttgctcggggagccgatgcgaaaaattcgtcggaaaaaagcagggaagatgcggcaaagtattatcagacctgattttttatatgcttgcctaaagaaatgatctcattgcgggtaatgaccaaacaagaaattcatttcaagcttgcttttgcgttaggttttatttcagctgaatcaaaactaacgctgtaaacatttttatacgtgtaacgctaactgcaataacacaatgtgcggttattgcagttataaatttctcttttttgtctcaataactaaagtatacttggtttatgagactggtaattcatttctctgtgtaacttcctagaatatatattatgtaaactagaaattatgaagagaatataaaagcgaatccatattctaacagcatccccttttttgtaaggtaatattaaaaaacctctacgtccttaataaattaaattggtcataaaggtttttcagtttgagtattttcatcggttatgtcacttgttgctggtcttcttgatcaagtccacgccatcgtatgccagactttccacacttgcagctttctgcaggatgtaatgatcaaaaaagttcttcgtatagtctgtaacaagatttcgcatctccgtggcatcccgttcgcctctaagttcctcattcacactggtaaacacgatgtcgcagtaatctaaatgcgcagcacgatcaacagagaaataataggtatccatgctattgttagccccaatgatcgcattcatgttatagttcggttcagaaaacagcagcaaaaagggtttcttaaggtcgctgccctgaaggccgaacgctccgctgtccaatccaatcccgcaggcaaaccggtcgtcgtcccggcaaacaatcgccgtcgtagccccgccataagaatgtccgactatgcccatgccgatgtcaagcaacaatctgtccttaaagatggaattcagctctccagagtccagtttgacaagataatcggctgcataccttacatcttccgcctgtaattcacaatactttgttaacttgccaagaatcggcagtgtaaacacgttatggcacatcttaatggcagtttcatcgtcaggacgcatctccatcttaccagacaacgccagcatctccggatcttcagaaaacgccaaaatggcatcagaaaaatcctttgatacattaaacaggcgcccatctttacgcttatacatcgtgctattctgatggccgatgcttaccgccacatatcccatgcttgccaagtctgtacagatcactgtgccccattctggagaaccgcctccgccgcaaacatagaataacaccggataacgcttttctttcccggagagagcaaggtcgtcgtaacattgggtcttgatatctatagagtaagcatccttcaacgcagtgagaagcggctgctcatcaagcatttcgcagacttcaggaaacatgtacgttgatgtagtcttcccttcgctgctgtcggacggatagtacacaaacgccgtcagttctctttttgtatgatctgatgccgtgtactcaaaatccatttgggtgcggccgacagtatagccgccaattggctctggaaatgcgtcataccttttcattctcttgttcccccttaagtaataaaagtggcggatgtgaaatacatacattgcgcgataaacgcttttcaaaactgtgaaacgattacattatatgttcagtgaatcattatctactccttcacgtaaacctccatgtattgctgtttaagatgataaaagcggacatcgttgctgatgtccgcctaaagcttaactaatggggttctgttccccaaatcagttttccttgatgatataatgtaatttttttcgttgttttaaacgtatttgattgaaaaaaggaatgatcgccgctttgtgcataattactccagtcatcattgtgaagacgaagctgaatattccctgtgcttgctcccggtgacagcgttcctgttttaaaacccagttccagataggtatctgcaccttgcttaggtttatgcagcgccgcaaatttgtgggtcagattgccgcatccaatctgcgcgtagtcacagtcaaagttttggcccttgtttttcgcgttataccagtaacgggcagtgacatcttttaaatcaaccgtcgcattgccgttattttttatgtgaagctgcgggcggatttggttgctgttcacacccccatcccctgctttgtattgtacagaaatgccgttttcctgtgcggggttatcttgtgctggcgtttcagggcgttctttcgttgaatctttgttgccgagaatgttttctcttacgaatgttcctgaagcagttaaatctgtaagcggccagccgcctgttttagatgctcccggctttaaagccgaagatgattcctgcttatcagaaagattccagttcacccagctgatgtttttgctgtcgagataattcagccattcccgcgactggtcaaggaatacaccgccatttccagacgcgtcgcttgttccccattccgtcacgaaaataggcgctcctttcctgagtgcatagtttgctttatcccgtaaagattggccgtgtgtgccggcataaaaatgaagcgcgtacatgacgtttgcatcttttagctggtcatcggctgcatcattcacatcttggctccatgtaccggttccgacaatgatgatgttgtctggatcatttttgcggataacggaaatcacttcttccgcatacggtttaatatcacgcttccagttcacatcaccgtttggttcgtttgcaatttcataaatgacgtttggcgtgtttccgtaaagacttgacatttccttaaaaaattcttttgccttctctttatgttggtttgggttgccgtcatttaagatatgccagtcaatgatgacatatatcccaagttcttttgccgcttcaaccgcttcttttactttatttttcacggacggattatcaatataaccgccatctgccgtatacatcgccgcgcggaaaacggttatgccccaatcgtctctcagccattttaagctgtctttattgacaaaatcgccataccattgcagtccatgtgaactgatccctttcaattgtaccgctttgccgtctcggtttacgagctgtgttccttttatgctaagctgaccattcttggctgctggcatttttgcccctgctgcagatgccggcgaagccggcaagccgcccattgtcaataccgtaatcaataaacacgtaataaaaatagaaattgaccgtttcatatctgatcttttcctccttcgcatcattttggctcttcgcttcttatgagctcgaactcattgtaaaaatctttctcatgattgtctatcaacctaatttcttgtttttgggaggtttaaaagcctgtcaatttgctctatctctattgaataagacacacctgacacatatagaacaaagaaaactggactgaatcgggactttacacgttatttttcaatcgaatcgaaaaattaaatgtatttccaacgtagacgcgctaaatgtgatgagtctcaatatggcattgaatcttatgattgctgtaaaaagacgagcccttgcccgtccttgttaatttaaggttgatgtaaggttcggattaatacgggttaaggttggagttgtacaataagattgtacttcagtgtgagattcagccagaagaattcccccttcaataaatcatagaggtgaaaaggtttgagagaaaataaaattttgtcttcattatgttacttcagtatattttttgcaccgtttctgtttccgattatcgtctatttcttaagccaggatgatgtgaaagatcatgcgaaaaaatctttatggacgcatctgattccttatttgatttttggaattggcatcatcgcttcaggtttacttggtatgaatgatatcagacatgccgggcctttcctgcttgcgacttatgctgttacattccttgtggcgatctattttttcatttggaacattgtcaaaggaatcaaagtgttttcggaacaataggaaaaaacggttctgttattaatcagcagaaccgttttttgtatagccattatgataattgtatatctatcgttgtcccttctcccgcggtgctgtgaatggtgatgtcccctccgtgcttttggataatatcctttgctatggccattccaagaccagagcctgcatgcgtcgttcctgtatttgtccccctgtaatagcgatcaaacactttttccagctcctcttcttctatccctttgccgttgtccttaattgtcacatgagttcgttctttttgttcaagctgtacaacgatcttcacatcgggatcattgtgaacgagggcatttaaaatgagattcgtgaccgctctccgaatcaatatcgcatcaaggttcagcatcagcttttccaggttcgtttgaagctcaatggacttatccgcatatctggaatcgtttaaaatatcaattaacgtttcccgcagaagcgatacaaggtttacccgttctttatttaacatcacatcgttgtttttcagccttgtcgttaaatttaaatcttccatcacatctttcatatagagggatttactctcaatgatccgggcgtactctctgatctgctcgactgtgagatgataattcggatctttgatgatttctgcatagccttgaatagatgctaatggtgttttaatgtcatgagaaatatgactgatccactcttcacgcatttgttctaatttatctttttcttttttgcttaaagatagttgttccgataagtgattgacattatagaagacatctttataaatgcctttggatttcattttgatcgtataatctccattagctaaccgctggattccttgaatgacacggccgagcggttttgtgagctgccggctgaatagatagccaatgagtaacgcgatcaatgcatctattgataataatatgatggttcctgcattgaacttcgtcacaaattccttggtatcatatgagaggacaaattttccgagagagggatttttaaaccctataaagtaactgtactccttgccgtttactttttttccgccggcgtaaatggttgacaataactgttcatccttatatttatgtaaatttacaatttcaataggcgtatattttttcttcagtcctttaggttctctatcatgataaacatcctgtccgttttcatctaatatttgaatccatgcattctgctcttttaaagctttttggccctctttgtttactgtgataccattgttcgataacgtgacatattgtcggaatgatcttgtgaaagtttccggtgtactttcttcgtcatgttgggtgttcgcctggaaaacgagccaaaacataaaaataaataaattaatgaagactgtaatgacggtcactatgatgacagataccatgtatctgcctgttaatcgccaattcatccttacgcatcctttacaacaaatttgtagcctaaccctttcacagtgacgagaaagtctggttttgatgggacagtttctattttctcacggagcctgcgtatatgaaccatcaccgtattgtcagaaccgaaaaagtcttctccccatacagcttgatagagtgtttctttactgatcacccgattgggatgctgcagaaaataggtcataagcataagctctttaggtgttagctcaatagccgcttcatttttggtgagctcggcttgttgttggtttaattcaaatggccccttttttatcacggttccggtttgagaaggctgtaagtaagagacccgtctcagctgcgctttgacccggtatgcgacttctttagggctgaaaggttttgtaatgtagtcgtccccgccgatggcaagtcctacaattttatccgtttcctccccctttgcagacaaaaagataataggaatgtgtgaaatgtctcttatttgcttgcagatatcatagccttcaccgtctggcagcatgatatccaatatcacaagatcgggattttcttgatgaaattgagccaatccgtcacgggcagttgaagcggtcactacgcgatcaatgccttctcttattaatacggttttgatcagttccaaaatttctttttcatcgtctatgattaatactttgctgtgaagccgtgacatatattgatcactccttgaagtcattgtcattattatacccaatgtccgtgtatcgttaaaaaaccaacacttctcttccacagaaaataagccaattttctttttcgagtaagaaaattggcttattgcgatgctgatgtctctaacgctttacaacaaatgttgtcacgctttgagccggcagatgggcccaaaaatgattatccgttactttgagatccgttccaggttgaagattgctgctgctgctcgtgatccatctggatacttgcgaagcagatccattctgcaacacgaagttttggttgacccctgtgttatttttattaatggcaacaatcacgactttattgtctcctttataggctgacacataaacattcggctcaggatttttcgttgcatcaatccttacatagccagggcgcacaaattttgagaaatgagccatattgtatccgcgtttgctgatcatcccatcttctttcatagggccgtatgatctgcggatgtaccaccacacataagcttgaaaatctccctctaccattgaatgatgaatatgctctgaaacacctaaagcctcaggccatcgatccgccgagttgttatcactgttcggatagtatacttccgtcatccaaaggtccttccccgctcctttttgtttgaaaagaggataaggaaactgactgacctgagtgccgtacaggtgggttccgaggatatccatattcctaagcgcctgcggatcgttcaaaatggggtccgatatatttttcaggtattgaaatgattccggcgcaatcacacgggcattaatggaaccggcattctctctcatgaaacgcaggatttcttgaggcgtccaccatgtccattcgtgagcgtaatcaggctcgttctgcatagaaatcgcatacagattcacaccattactcttcatgaaattaacgaaatcgttaagatgctgcgcgtatgcagcgtacttatcgtatctcagccgcttagctgatgtgtcaccattatgattgaaagtctcaaccatatcgtttggcggattccaaggggaagcaaaaacgattgctccatgtttgatcgcactctttgcagtctccacttctttgtaccaattatttctattttcatctacatgaattcttaaaaccgaaaaacctaactgattctgcccattgccaaaagcggtctcccgttgagccgcagtcaagtctccaatccaagccgggtggttcattcctccaaaaccgcgaatcacttgtctttctgcagatatattaactgttgcatcacttgctgctgaaacttcagtaactcccggtcctaacagcatgacggacagcattgtgaaacataccaataatacacaaattgttttttttacgctcgacatcatttttttcctctccttcatttgtcttttatagacttagaaaacgtacctttgcttatctttgtgtaaactgccagtaatcaacattaaacaagtttcctgtaccagttccggtaaatacaaagaatacgttgtgaacaccggatgcgccgcttaccgcagtttctatttctctccaggattgcgttccgcctgtggaagggacattcaaggttccgacaagcttaccgtttgcactgtctagtcgcacttctatttttccgccaagagcggacgctacatttgctttaaacgtccttgcaccgcctgacccgaagtctgcatttccaacagcaatccagtctccgttatgaatgtttgtgacatgttgattattgaccggcccgccgggtgcagaggaattctcggtcaaaatccgtccgttccaggcaaacgtttccgcttctacccggtgatatggattcaagttggacagctgtttgacacctgcaaaatttgccgctacctcttgcagggagccatcaggattatgcacaagcttatttatatggggagaacggtatcctttgccggccccgtaaagagcggagctgacagtttgagtatgatacaccacataccactcgtttttaaaattgaaaacagcatggtgattgtttccgccgcctccgaaaaatgctcccggatttttcagaaagtgccctctatacgaaaaagaattcataggacttgagctggtcatatagccgatctcacctggaggtttatcggccgggtgcgcgcccccgaaattgatacaataggaatagtaatattttccgttatacttatgcattcccgaatcttcaaacataaaaggcgcatcaatcgtagatgcacttccggcaacactggtcatatcaggccccaatttcatgactcttgctgttttaggatcggcccattgcccctgtgtgggatttgaaccgcccggaacgcctccgccggcatataggtaaccggtaccgtcatcatctacgaatactgcaggatcaaaaagccatacaacaccggacattcctggtgtacttggcgtcaccagcggttttccgatcggatctgtccatgggccggtcgggctgtctgcggtgagaaccccgatacctccgccgccgtttgcgaaataaaggaaaaatttatccttaccgttgatctttttcaccacggctgacggggcccatgatgctcctgcccatttggcaatcccccgccgccattcaccccattggcacccgctgcgggaatcgctccgtgatctgtccagttcaccatatccgctgaagatatgacggatattttattcaaattggcaaatgaattatccttaatcgtgccgtcgctattatattcatagtcatcgcttgacatatagatgtagactcttccgttataggtcagcgcaaacggatctgcgcccagatggtggtcgataagcggatttgaattcccaacatgttttgcaattggagtgcttaccgcattcgcatattccccaggtaaacagctcaataataaagcaagaacaaataaacatacgctgcactttttcatcagcttaacatcctcctgtttccgcatattagatttttaaaaaatatgataacaacaggtcatgaagaatgcgtaaaatgaatgatttttagagtgaaaacgttgcaaatatctgaccctcttttatgaaaaatgccgccgattgcagtcagcggcattttgccctgaatcacttacattttgtcaaacttcgtgtcgccagcaaacgatcctattgacagttgttcttcaagaacaagtccgtgatgatgccgttcttcaatccttttgataagagatcgaattgtatccgtattttcttcaatattgtgagggtcaaagatcgtcacatggtctccttttaatttgtactcaaggtaatgctgtgcggttgattgcttccatcctctatcggtcaactcgccgcatagaaaatgatgaatgttggcgctcaccgcgccggaattgatcagtttattgtgatatgtgagatagcttctgattttatccttaatggaaggaatggttaataattctctgtaataatccggaatgatatccagattccgatgaatgatctcttcggtttcctcttccgaaaaataattcaccgaaacagctcttttagaatcaagcatcataatgtccgatacgatgcgtccgcgcttctccaaggctttggcaacctcaaaagccaaattcgaccccgaggagtaaccgagtaaaacaaaaggccctcgttcctgaatgcctatcatgctttctgcataccggtcgacgatctcttgctcgtaagacggctcttctaagaaatcagcggcatagacggtgcagcggccgtctagtcttttcgccatttcattatagaccagcccgtacccgattaaaggcgggaaacagaacaaagggattgaaccgttctgattcatcttgacgaatacgttatccgtcttggactcgaaaactgccgcttgaatggcgcgtgccattgtttcgatggtaggaaaatcgtatacggcttgataatgcattttgattcccatacggtcgttgatttgatgaataacttgcaatactttgagcgaatggccgccaacgtcaaagaagttatctttaattcccgggtcactgagagctaaaatgttcttccatatctcggccagctgcttttcaattaacgttccgggcgcttcgtattcggttccggtgagcctatttccctcaggagccggcaaagcttttcgatcgattttcccatttgcggttatcggcatcttctccatttgaacaaagtaagccggtatcatataagcgggcagtttgttcagtaaatgacgcttcagctgcgccgtatttaatgaatcgtctcctgacaagtaggcgcacagctgctttgagccctcttcttcaatcgcgatgacgaccgcttctttgacagattccgattgcaataaagccgcttcgacctcgccaatttcaatccggtagccccggattttcacctgatgatcaattcttcctaaatactcgatattgccgtcaggcagccaccgggcgacatctcccgttttgtacattttttcgcctgcagcaaacgggtgttcaacaaatttctcagccgttaattccgggcggttcaaatatcctctggcaagtccctctcctgccacatagagctcgcccggtatgcccatgacctgaatgcgttgatattcgtccaaaatatacgcttgcagagtaggaataggttgtccgatgttgcttctgccctcgttgatttcccgttccgtgatttctttatatgtgacatgaacggtggtttcggtgatgccgtacatattgattaattgtgttaaaggatatttaagcttccagtctttcaagaaggatggatttaacgcctctccgccaaatatgatttttcggatgtttaaattggattcgggatctgctctctcctcctgcatcagttgataaaaataacttggcgtttgatttaaaatggtcacagcttccgattttaacaattgcaaatacctttccgggttttttgctatttgtttcggaacaatcactaatttgcccccatacagcagcgctccgtacatttcccatactgaaaaatcaaagcagaaggaatgaaacaaagtccaagtgtccgatgcgttaaaatcaaaaacatttttgttgttaaataacagacgaaccacgtttttatgttcaatgagcgtgcctttcggattccccgtagttcctgatgtataaatcacgtaggctaattgatttggcatcacgctcagattgagattagatggttcggcgtcgtatgatgacggatcgtcaaggaagacagtatgactttgataatcggtaccttccagaagatgatgttgcaataataagatagagacgttagaatcctcaagcatataatggatgcgttctttcggataatccggatcgatcggtacgtaaacgcccccggctttcaaaatagcaaggatgcctatcaccatctccggtgaacgttccgccataatgccgacaagctcctcggcctgaagtcctttggcaaccaaggttcgggccagctgattggcgcgttcatttactacccgatatgtcagcttcttatcttcaaaaacaatcgctgcttgctccggcgttcgcttcgcttgttcttcaaacaattgatgaatcgtcttttcctttggatactcagccgccgtatcgttgaacttatctatcagaagcgatcgctcatccgctgttacgatatcaaggtcttgtacgcgaactttctgatcgtccgccatttgcttcatgatttgcatgaaatgcgtctgcatccgttcgacacttgcttgatcataaacatcgcggttgtatacaaaacgaatgtcaatttctccatccggcatcacgataaaagtaaagtcataatgtgtatgttcttccatatgaaaatcgagaatgtctaatgcgttgtcatcctgcttcatatgttctatttgtttctcaaccgggtaattctcaaataccataatatgattgatcaactgctgcttttgctcagtttgagcctgaatgtcatacaacggaaatgtatcatatttttgagaagccagtgcctgctcctggttcactttcaatacttgtgcagctgtcatttcaggctgcgtatgaatacgtacgggaatggtattgataaataaaccgaccatggtttcaattcccggaatttctgccggtctgccggatacgaccgtgccgaagacgacatcctgacttccgttatatctttgcagcaataagccccatgcggtttgtatccatgtattgacggtgacttgctggcggcttgcggcccgtttgatttcgtctgagagctgctttcctaaatgaaacgtatgctctcctttttcgtatcctttcgcctggtttgtctggccggaagattgttcttgtaataaaacagtttgcccttcataaccttccaagtaattacgccaataggctgacgcctgtttgtgatcttgttgatcgagccattcgatatatcggctgtatggagtgacggctccccgcttcagctgcctttgctcgagtatcgcataataggtttcaaacacttctttcgtaacaagaggcaaacaccagccatccattaaaatatgatgaaagctccatatcaatcgcgcttggtcttcctctgtccgcaggattgatacgcgcattaaagcatcccgggtgagattgaatccccgcgccttatctcttctggcaaaatcggcaataaactcgctgcgctgatgactgttcatgctgcgaatatcttcaacggccgtttcaatcggtttttgccggaatacaatctgcaaaggctgatctttccattctgtataaaaaagagtccgaagaatgtcatatttttcggccagatgcgctaaactcatcctgaatgcatcgatatccaagaaacctttcagatcaaaagcggcttgttcaaagtaagcttcggaagccgaatcgatcaagctgtggaacaacattcctttctgcatcggggttaatgggtatatattttcaatgtcaccgagatgactcgtttgctgcacaaattgatccagttcaccgatcgttataccttttaacgaaatatcgcttggcgtcaggtgaatttgatcttgagcatcacaatgtgcgatgacttgctgcaggctgctttttaagagatcggcacaggcttccattgtttctctttgatattgtttaccgctatagctgatggccagcgacaatcggccgtctgaaatcatgccgttgatatcaagtgtataggtcaaggggcgattgtcactggctgttttcccgcttgagtaaggggatacttccatcctgccgttccggacatcttgatcaaattgacccaaataattgaaacgtatttccggatgtctggtccattcatgcgccttcgggtgatcggacaaatatttgatcaggccgtaacctattcctttttgggggatctgacgcaaattttctttcactgttttaatccgctccgggatatcctgatcagctttgatttgaagcgaaaccggatataggcttgtgaaccatcccaccgtacgcgaaatatcgagatccggaatgatagactctctgccgtgtccttcaaggtgaatgagaatgtcttcatatccggtccaacgatgaacagcaattcccagaccggtcagtaataaatcgttcatatcggtcgaataagccctgtgagcgttttttaataaacgttcggtttcctcgacggtccattgaacaatgaccgtttccttgtctttggccagaccggtctcctgtccattgtcctttggcaatgtatgttgcggattatgtttctgtctgaaccagtattgattttccgcttcgaattcctgactttctgcataacgattcaactgttcagcccataacaggtaagagtccgttttcttcggaagccggatcgcttctccgttttgaagctgctcataagctgccgctatatcctcaagtaaaatcctccacgatacgccgtcgatgaccagatgatgaaccgcaatcagcaaatgatctccctcttgacaccggaacaatcccagtttcatgagcggtccttccgctaaatgaatggattgctgaatctcatttgaaatggtttctatcgtctgggacacatttttttcttcgcgtaatgagatcacttcaaggctgaacagatcaccttcttcgatcccccgatttcgggcttcatatccatcttctgtcggaacatagaccatgcgcaaagcatcgtgatgctctgtgatcttcttcatgacttcccgaagcttggattcatccagtccctctttccaataaagcataatcgcttgattgtaatggtgtaattccgggtatttctggtcgaaaaaccaatgctgaatcggtgtcagcagtgcacggcctttgatttctccttgttctgcgattcgggttaccggctctacgtatggaacaagctcggagatggttgggtatttaaacaagtgtttgatttcaaacttatacccggcttggtataatcttgaggacacttgaatcgacttaatggaatcgccccccaattcgaagaaatgatctgagattccgacccgttctaagcctaagaccgactcccacaccgcggccagtattttttccagttctgttcgaggagcttcatagttcatgcctgtaagattctctcttggagaaggaagggatttacggtctattttcccgttgaaagtaagcggcatctcttccagctgaacgaaataagcaggtatcatataggatggaagctgccgggacagctcttcacggagctcgcctgcagttaaagcatgttgtgcggtataataggcgcacaaggatgtttccccatcgatttcccgggcgatgacgatggcttctttgatcgccggcagctgaaaaaaagcgccttcgacttcgccgatttcaatgcggtaaccgcggattttcacctggtgatcaatccggcccaaatactcgatattgccgtccggcagccatcttgccaagtctcccgtccggtatatccgttctcctgatgcaatcggatggtttacaaacttctcggccgtcagttcgggacgattcaagtagccccttgcaagcccatcgcccgctatgcacagttctcccgccacaccgatcggctgcatatgttccaaatcagcatgtaatatatacaattgaatgttggaaatcggtttgcctatcggaatcgttgcatatgtttcttccgtctggcaatcaaagtatgatacatcaattgttgcctcagtcggtccgtacaagttgatgatttgagcctggctcaccgacatgatgatgcgtttgaagcctgcgacatgtacaggcttcaaagcctcaccgcttgcaaacacatgtcttaatgacgctaatttttgtttcaacatcccgcttggcttctgatccatggattccaggaaggcatgcagcatcgccggtacaaaatgcagtgtgctgacgcctttttgtgcaattgtatctaaaatcagctcgggattcttttctcctccgcttggcagcagcaccagtttagaacctgccagcgtccaccagaacagttcccacactgatacatcaaaggtgatcgcagttttttgcagaatcgcatcccgctcatccagagggtatttttcctgcatccacaccagccgattgatgaccgaccggtgctcaaccataacccctttcggcttgcccgttgaacccgatgtataaataacataggccagatgatccggaccagcagccggctctacattcgacccgtcttcacaaaagttgtgcggatctttcatatccagcacttttcccgtaaaaggtactctctcttgcgattgattctgcacgagtaacaacttcgtatccgaatcctccaatatgtatcgaacccgttcctcgggatagcccgggtcaatcggtacatacgccccgccggctttcaagatcccgaagatccctacaatcatatccagggagcgttcggccataatcccgaccggctgatccggctgcacgccttcagattgcagtgtccgagcgagttgattcgccttttcattcaattcccggtacgtcagacggctatcctcgtagacaacagccgtttgatcaggggtgcgttccgcttgttcctccaaaaattgatgaatcgttttttctcttggatactctgcagccgtttgattataggcgatgagttgatttgtctctgagtctgacagaatattaagctgtcggatcataaggtcgggttggaataacaaacttgaaaaaacccggtttacatgttcgatcacttgcatcatatactggcgatcataagcttgttcattataagttaactttaaatgaatcgaatcattttcgatggaaaactgaaataacgtatcagcagcagccgtttctataaaacgaatgggatgaagctgatctagtgatacgatcgtatggatcattggcaaatgatttgaatcgtagttcagatttaatggaccggccattttatcgaaaggaacgtgctgatttaagatggctccgttcagcgtatgcttgaattcattaaatatggatttaaatgtgctgtccgcatttatgttttgtttgattaacatgacttgatctaaacgaaggtcttcatcggtttcgtcttcaaaggccggtacacctacaataacgccctcttcccccgtatatttgtacaaaagacactcgattccgaccaggagaaccatataaacggccattggcgatttattcgtcattttcatgatgcgcagggatacatcggagctcaatgaactgtgaatccggttgggttcactcggcgcatcgtgctctattgttgagtccgacatttgaaacgaagggattgcactgggacgatcttccgcatcgaacatgctgctccagaacaactcctgttgcttgaattctgacattaatatccctccagtaagttttagccggctgaccgctgtccccgtaaaaacatcatgccggggacagccggtaccggccttttttagaaattcaattcgatttcgcttgcaaagtgttcacttctatttactttctcacttaattgaatttcttttaaaggaatcgatgggtcttttatgatcgccgacagaatcatggcgtaatctttgctcagcgtagcgatggttttctgtttaaacagcttcgtgcagtactcaaagcttccttgaatctcgtgcggattcatcacgaaagtcagctgtaaatcaaatttggccgccgtatttgtttgttcatatggtctgaccgcgagagagtccaattcgatatccgtttgttccgtattttgcagaacaaacatcgtatcgaataacggattacggcttaagtcccgtttcactcccagtttctcaactaattcttcaaaaggatattcttgattttcataagctttcagcatcgtttcttttgtttccgttacataatccataaaggtcttttctccagccggagccgtacggatggccagtgtattcacaaacatcccgataatatgctgtaaatcttcatgcattcttcccgcaataggcgtaccgacgacgatatcttcctgaccgctgtatttcgccagcagtatgttataggctgacagcaagatcatgtaagcggtcgatccggtcaattcttccatctgtttaatcccctggaccacagtctcatcgagagcgaaattgtatcgcttgccttcaaagcttcgaattcgcggtctggcaaaatctttcggcagctcaaatggcgggagttcctcatgaaatacattcagccaatagttctcctgccttttgatgcgttccctctgctccgcctgctgctgccatacagtgtaatctttgtattgaatccggagcggggttaattctttgccgtcatacaattgaatcagttcttcaacgaaaatattcatagaagcgccgtctgaaacgatatgatgcatgtcaaacatgaaaacatgtctgtcctgttctaattcgatgagcccggcccgaagcaatggagcctgactgagatcgaaaggccgcacgaaattgcggaacagctcctcgacctgctcatcagctgctttgtacctttctatagagaaatccgcctgcggcttgatcacctgcaccagctctccccgaaccatttcaaatccggttcgtagcgattcatggcgctggatcagactttggaacgcagattgtaaacgattcatatccatcctgccttccaatgtcaaaatccccggcatgttgtaacttagttctccgccttcaatttgtgtagacaggtaaaccatcttttgtacggaagatacaggataaacatctttggcttctgcaacagggatttcatccggtccgctggtttccgcgcccgcaatgaccctcgccatttcttcaaccgtcgggtattgaaacacttctctcaatgaaatgcttttgccgaattgcttatggatcttggtaacgagcgtcatcccccgtaacgaatgcccgccgagatcgaaaaagttatctttgacgccgacttgttctaacttcaatacttctttccagatgtgaaccagctgctcttccggctttgtccttggagcaacatagtcaatcccggtctgcaagcctgcttcaggcagcggtaacgcgctgcgattcacttttccattggaggttaacggcatttgttccagttgcatcaggtatgaaggaaccatgtagcctggtatttgatcggagagtttttctttaagctgattgatcggcagtgacttctcccctgtaaaataggcatacaaatcgctttgtccctctgcattttctctggccaggatcaccgcttcttgtacatgctcgatgttgagaagagcggcttccacctcgccaagttcgatccggtaaccgcgaattttgacctgatgatcctttcttccggcatattcaatgtttccatccggcaggtaacgggcaagatcgcctgttttatacatccgctctccgattacaaacggatcggccacaaacttttcacccgttaattcaggcaagttcagataccctcgtcctactccgtctccggcgatgcacagctcaccctttacacctataggcagcatccggtcatgggaatcaacaatatacacacggttgttgcccagcggcttgccgatcggcacgtaaccgccgtcgtcagcggatgccaatgtctccggtacgatatggaagaccgatgcatccacgcaggtttccgtcggaccgtatacattggttatgagcggcattgatgacccgttcgaagcgaacaattcaagcaattgcgccaccgtcgcctgcgggagcgcctctcctccaataagcatgtgccggatcgttaccccatgaaggctgtctgcagcgataagcaattgcaaatgtgacggtgttccgtctgttacgtcaatgcggtgggtgcgataatagtttgacaaggcataaccgtctgatactgatgctttagggacgatatacagtgcatgtccccctaacagtgccgcgaaaatttgcttgaccgatgcgtcgaaatagtacggtgccaacagagacacacgcaatcccgaatcataagcaccgtacacttgtccgcggagcccctccatcaaatgaagtacctggcgatgctcaatcagcgtgccttttggcttgccggttgtgcctgatgtgtaaatcacatacgccaagtgatccggtccggctgccgtcaccagattcgagccatccccgctgttcattcgttcgtcattcagcagtaaaatctctccggcaaaggatacacgatcttgtaaatggggctgtgccagcagaacctttgctcctgaatcctccagaatatagcggatgcgttcctgcgggctgtccggatccatcggcacatacgcgcccccggctttcaggatcgccataatccccacgatcatttccagagaacgttctgccagaatacccacaggctggtcaggctgcacgccttcgcttcttaaaatccgtgccaggcggttggcccgctcattcagctcacggtatgtgaatcggcttttctcgtaaactgcggccgtaagttccggcgtacgctccgcctgctcctcgaacaattggtgaattgttttgtcccttgggcagtctattgccggttggccccatctctccacaatctgctctttctccttcgcggtgatcatctccagcgatgaaagcggcgcctgcggatcattcgcaatcgcctcgatcaattggataaagtgctttgccatgcgttctgcagtttcctgcttatacagcgctgccgcgtaactgatcatacctgtaattccgtcttcattttctgccgcttggaacgtcaggtcgaacttcgccatcgcatggttgtccggataaggggtaaaacgcacatcatcgaggctcaattctccacgttctgtgttttgccatatgaacatcgtgtcaaacagcggatggcggctgaaatcccgggacacattcagcttgtccaccagttcgtcgaatggatactcctggttttcgtacgcttttaatgtatgctctttgacttcctgcacgtactcccggaatgttttttccccgatcggtttcgttcgtatcgccagcgtgcccacgaacatgccgattaagctttccaaatccgaatgggttcttccggcaatcgggctgcctactacgatgtcttcttgcccgctgtatttggcaagcatggtcgtataagcagccagcagcaccatgtacagtgtgctttcgctcttcaccgccaagcctttcagctgttccgtcagctccggtccgataacaaactcgatttgtcctccttcaaagctccgcgcagccggtcttccgtagtcggttggcatatccagcaccggaacctctccgctgaacacatccagccaatacgcttcctgctgcttcatgcgttcgctttgcatatccgccagctgccacgccgcataatctttatactgaacccgcaatgccggcaattcttttccttcatataatgaaacgaactcttcaatcaaattcttgatagatacgccgtctgaaatgatatgatgcatgtcaaacagcagcaaatggcggtcttttgcaagctcaatcagtcctacccgcagcagcggcgctttctccaagtcaaatgcccgcacaaacccatgaacgaggacttccgcctgttcttctttcacctgagtgaattccactgcaaatgggacgtcgtcataaatccgctgcaccggttctccgtctatcaattcaaagccggtacgcagcgtttcatggcgctgaatcagcttgcgaatcgccttctcgacaagttcccgatccagagctccatcggccctcatgacactcggcatgttgtagctcagctctccgcctttcagctgattcaaaatgtacagccgtttttgcgccgaggagacggcatagtattcttttgcgtcaacggccgggatagatgtatatgctgtgtgtttcattccggtaatcgtttctgccatttcttcaattgttggcgaccggaacacttcccgcagcggcaggctgacccccatcactttgtgcagcttcgccgtcagagtcgttgcccgcagcgagtgaccgccgatgtcgaagaagttatctttcacgccgatacgcggaagtccaagcacctctttccagatatgcgccacctgcgcttccgccgctgtacggggagcaacgtattcgccccctgtttgcacgcctccttctggtgtcggcaatgctttgcggtcgacttttccgtttgccgtgagcggaatcgattcaacaaaagcccatttcacgggaatcatatagtcaggaaggtttttggccagatctttccgtaatgctgaaggatcagtcgcttttgagacgctgcagtacgcgcacaattcattttcacccaaagcgtttttttgaataaggacggctgcttctctcaccgccgggtgattggccaatatgacctcaacttctttcggttcgatccggtagccccttattttcgcctgatcatcaatgcggccgatgtattcgatttgcccgtcctcacgcagccttgccaaatctccggtgcggtacataacggctccctctctgaacggatcaggcaaaaatttctctcccgttaaagccgggttattcgcatagcctctcccggtatttgctccggaaatatacagttctcccgcaatgcccaagggctgaagctgtttgttcttgctgatgacatacatattgttatggcatatcggttttccgatcggcggaaattcaggaatatcatctcccggttgaatggtatacgtcgacaccacatgagtttctgacggaccgtaatgattgtgcaaatgcaagccgtgggtgcggagcacttgctgaaataaacgggatactgtcaattgttctcctgctgtaatcaaatgcttcacacagcgcggaaatgaatatgcatagctctcttcgctaaaaagcattttggcaaaagcagtcgggaaaaagacgatgtccgtctgatgtttattaataaacgaaaacagctgagccgcgtcccgctttattgattccggcacgatgtggagtgtgccgcctctgagcagggctgaaaacagctcttgatagcagacatcaaatgccggagatgcgtattgaagcacattggttttgaaatcgatgcctgagtttgtaaattggtcatacagcaaattggccatatttctatgttcaagcagcacacccttcggtttccccgtcgttcctgatgtataaataacgtaaagcagatcctccgctgtgtttatcgtctgcacattgctcccgtccggttctgtcaccgcttcttctatgaatgtgacaatctgcgttgctgcctcggggactgaccggtctttctctgttacaacatgagtggagctgctgttttcaatgatatagcggattcgttcggcaggatggctcggatcaatcggaacaatggcaccgcccgcttttaaaatgcctaaaacagcaatcgctaatgatggtgaacgcccggcgatcacagccaccggctcctgatgcttcacacctcgcttacggagaatccgcgccagtttattggctgtttcgttcagctctttgtaagaaatctccgccccttcgtattgaactgcgatttcttgcggcgtttgtgccgcctggcgttcaaacatagtatgaatcgtttcgtattcaggcttctctgttcccccggaaagcggagtgagcagctgttctttttcttgctgcgtcagaagttccatttcttctattttgacagacggctgctgcaaaatttggtgaatgagctgttcaaaatgtccgcgaatccgctctgcctctgattgtccatattcattttggttgaaatcaaaatgaacggtgagttgttcgccagggatgacaactacattaaaatcgtaatgggtatgttcttctatatggaaattcacgatatttaaatccgcagcatcatggcccttttcgacttgctgctctatcggataattttcaaagatcagtatatgatcaattaagttttgcttttgttccgtttgggcctgaatttcgtataaaggataggtatcgtatgattgggaagccagagcgttttgttgaaccatttgcatcgtatcagcaaaagtgctgtcctcatcgcagcggatgcgaaccggaatggtattgatgaacaggccgatcatctgttctacatcaggaatttccgccggccttcccgacacgacactgccgaagacaacgtctgcggacccgctgtatttctgtaataaaactccccataacgtttggatcaacgtgtttaatgtaacctgatgctgatttgcgatctgctgtaattgttttgtctgttcgtgatcaaatcggcagatcacattggcataggcgtattctttttgttcatgctgctctattttatgaagaagcgtggtttcacctgtatatccttcaagatacccgctccagtaccgctttgccgctccctgatcttggcggtcaagccactcgatatagtcgctgtaaggagctgccgatgacggttctggttccctgccttcctgtaaggcgcgataatgatcaaacacttccttcgtgataagagacaggcaccagccatccatcacaatatgatggaagctccaaatcaaatgatatttgcggtcttccatacggaaaatcgctatgcgcatcagcggatcccgagccaagtcaaatccttttgccttatcttctctttgataggctgcgattgcatcctctctcaggtgctcctctataccacgcaaatctgcaaaatgaatttgcggtgtttgcgttttatagacaatttgtaaaggagtatcgttccagccgctgtaaaaacgggttctgagcacggcgtatgtttcaaataatcgttcaaggcttgctttaaaccaatcaatctttaactctccctgcaaatcgaacgatgcttgttcaaaataagaacttgaggcctcgtccagcaggctgtggaagagcattcctttctgcatcggagtgagcggatacacgttttcaacctcacctgcatgcggcagttgaatgaggagctgatccaattcgtcaatggacatgccttttaacaaaatatcgcttggcgtcagttccgattgttctttatggacgcaatgcgtaatgattgtccgcaggcggctttgaatcgtttccgataaccgcatgatcgtttcttttgcgtactgtttgctgctgtagctgatcgtaagcttcagccggccgtcggtgatcattccgtttatattcaatacatacggtctttcttgatctccgcttgagtctgaaccgcaagaataagaagataattgaaccccatgctgctgtaaatcttggtcaaactgtcccaggtagttaaagctgatctcaggattgagtttcgatggcattccgccgcttaagtaccttgctattccatatccgatccctttatgcggaatttggcgcaatccttctttggtcgtcttgatataatcagagatctctttgcccggatgcgcgtgcagcacaaccggatacagacttgtaaaccacccgaccgtgcgggagatatctatatcttgtataatctgttctcggccgtgtccctctaaatgaatcggaatttgttccagtcctgaccaatgcgatatggaaagacccagagaagttaagagcaaatcgtttatttccgtgttataagcgcgattcgcttgttttaatagcagctccgtttcctctttcgtccattccacagttgctgtttcactgtcttttgcagttgtatgggtttcatgaaaatctttaggcagcggtttgacttcggtttgttcgatctttgtccaatattcctgttcctgttttatggtttcactttgcgcatattctgaaagtctcttagcccataattggaaagagtctgttttttgcggcagttgaatcactcgcccgttctcggcttgcttgtagccgctaacgatatcttccagtaaaatgcgccatgaaatcccgtctataatcaaatgatggatggcaatgagcagatgatctccatttgcgcattgaaacaacccggctttcattaacggcccatcacttaaacgcatactgctttgtatctcatcagctttggcttcaattgtccgtcccggatcggaatcttctttcagattcaggacttctaagcggtacagtccgctttgggcgatttcttcattctgtgcctcgcagccattttccgtagtccggaacgtcatgcggagcgcatcgtgatgttcagcaagcttttgcagggtttgacgaagctgcgtttcctgaaaaccttccggcgcatgcagcatgacggcttgattataataatgctgatctgtcgttatgtgatcaaagaaccaatgctgaataggagtcaggctgacttttcctttgacctcaccttgatcggctatacgcagattctgcttgatatgcggactcaattctgcaattgttgcatattgaaacaagtctttgatttccattttgtatccttgctgatttaatctggaggatacttgaatggatttaatggaatctccgccaagggcaaagaaattatcaagaatactgacgttttcagcgcctaataccgattcccaggcagaaactaatatttcttccgcttttgttcggggagctttatactctgctctgtcctgcagctcgaaatccggagccggcagcccttttttgtttatttttccgttagaagttaaaggcatttcatcaagctcgataaaataagccggaaccatataacttgcaagggtatgagacaattgtttccggagccgggcagccgttgtttgcccgccgcttacgtaatatgcacacaattgtttaaacccgtggacatcctctctggctgtaacgacagcttccttgatcgcttcttcttgaagcagtgccgcctcgatctcgcctaattcgatacgatagcctctgattttcacttgttcatctattctgcccgcatattcaatgtttccgtccgccagccacttcgccaaatctccggtcttatacatcttcgctccgggttcaaacgggtcatcgacaaatttctctgccgttaattcgggacgattcaaatatcctcttgccacaccggcgccgctgatatagatttctcccggcactccgatcggtgcgggtttcatattctcatcaagaacgtaaatgctcgtgtttgccgcagcggttccgatcggtaccgattcccgtctgtcctttgcggcatcataacggtaaatcatgcagccgacaacggtttccgtcggtccgtactcattgcatatttcaacccggccttcgaactgttcatgaatgctgcgggctaaccgggtgcttaagttttccccgcccacaatcattcttcggacagccgtttgatcggcaatgttcatttctttcaaaacctgcaaatgggccggagtcaatttaatgatatccaccctcgggtccctcacaatcgattcaagcagagctgttttatcttctccgtcatagacgatgattgcatttcctgtgacaagcggcgtgaaaatagaagtcaccgtcagatcaaaagaaattgacgaatacaatgggaagttggctttctcgccttttacataaacctctttcgcccaccaaatataattggtcaagccttggtgctcgattagtacgccttttggccggcctgtggaacctgacgtataaatgacatatgccaaatggctcacatcatttatcggagcaaggtcagagccatcttggtgataagaactttcatcatcaagtaaaaccgtgacgccttcataggcgagctgtttcctgacgtcccgctgcattaaaacgattccggcttgggagtcatccagcatataccggatgcggtcttgcggatattccggatctatagggacataggctccgcctgattttaaaacggcaaggattccgaccaccgattcgatgctgtttcttgtgatgatggctacaggctgatccgtctggactcctttcgctcttaacgttcgcgccagtcggttggcccgcttattgagctctccgtacgtgagctgcctgtccttatcaatgacggctgcttgatcgggcgtacgctgcgattgctcttcaaataattgatgaaccggcgtctgcggaaacggcgcggccgtgtcgttaagcgtctgcagaagggttcttctttcgccttccgttaacaattccgcttgatccacccggatatccgcatctgtcacgccttgatgcaggatttgcatgaaatgttcccgaacccgctctatgcttgcacgatcatacacatttgcattgtattcaaaagagatgttcatctcgtcgcccggtataacggtcaaattaaaatcgtagttggtctgttcttccatttgcacgttggaaattttgatggatgttccgttttggcggcctatgctttccatatactgatcaaccggataattttcgaatatcattaaatgtgtaattaaatcttgcttttgcgttgtacgcgcttgaatatcgtacagcgggtgcgtctcaaattgttgagacgctacagccctttcctgcgcctctttcataagctcggcaaacgttgtcccggcttcacaccggaaccggacgggaatggtgttaatgaataagccgatcatggtttccacgtttggaattccagcaggtcttccggatacaacacttccaaacacaacgtcccggctgcggttatatttctgcagcaaaaccgcccatgccgtctgcagcagcgtgttcagcgtgacatgatgctcgcctgccgtccgcttcatttttgaagtgagatcggagcttatgtcacacgtcactttttcaggaacgtatcgtccgtcttccgctgcatggtgatccttaggaaggccggtttgctcctcatatccctctaagtattgatcccaataagccgtggcctttttcgcatcttgccggccgagccattcaatatattgactgtacggagtaattgatgattgttcaggctgcttttgctgaagcaaggcaaagtaattctcgaatatttcttttgtaatcagcggcaggcaccagccgtccatcaaaatatggtggaagctccagataaaacggtatgtcttttcatccgtacgaaggatgaatagccgcattaacgcgcctttttctaagtcgaacccccgcatcttatcttctctggcatactgctgaatcatcgcttctttttgtgattccttcatctctcgtatgtcattgaattgaaaaccgatttttttcgttttgaatataatttggagcggctgatccttccagcctctgtaaaaattcgtgcggaaaatatcatatttttgcgataagccgtccaagctttttgaaaatgaatcaatctccagatctccatgcagatcaaacatcgtttgctgaaaataagcacctgaattcggatcaaataagctgtgaaacagcatgcccttctgcatcggcgttaatggataaatattttccgcttcgcctaattcacgcgtctgctccaaaagctgttccagttcgtcgattgagatatcttttaacaggatgtcacttggtgtgagagaagtctgctgccggcttacgcaatgcgcaatgacttcttgcagactttctttcaacccttgggcaaattgcgccatagtagatctttcgtattgtttgctgctgtagctcagtgtcagtgataatgtcccttcggcaatcatgccgttcaaatcaagcacagccgttctctcttgattttcgttcatcgataaccctgtggaatatggcgatatgcgcaaagcctgatgcttcaggtcttggtcaaattgtcccaaatagttaaacgatatctccggattcagctgcaggctgtcggcttccgggtgcccggatatatatttgatgatgctgtaattcattcctttatcagggatgcggcgcagcccttcttttacgatcttgatccgctgcgacagatcttttccggcttccatcctcaggacgacagggtactggcttgtgaaccatcctatcgtgcgggaaatgtcagcatccggaataatcggttctctcccgtggccttccaaattcacgacaatgtcttccgtgcctgtccacttgtgaacggccagccctaacgaagtcagcagcagatcgttgatatccgtgttgtaggcgcggttcgcttgttttaataattgctccgtttcctcttttgtccattgaatcgtcacttcttcgctgtcacttaataacgatccttcgctgatagtgtccttaggcaatggctgaggctttatgcttgaaagctcagtccaataagcaatctcctctttcatgtcggtttccgccacatatttggacaattgatcggcccagaatggaaacgaatctgttttttgcgggagctggatcgtttgtccgcgttctgcctgctcataaccgcttgcaaaatcttcgagcaaaatacgccaggatactccgtcaatcagcaaatgatgaattgcaatcagcaaatgatctccgtccggacattggaacaaaccgagcttcatcaatggccctttgtctaataccatgctgctttgaatctcattcgctttatcggcaatcgcttgagccggatcggtttcccctttataattcatcacttccagatggtatagttcactttcatctgttcctgtaattcgcggagcgtatccatccggcgttttttcaaaaatcatcctcaaggcatcgtgatgcgacgcgatctgttccatcgtccggcgaagcggagcctctttaaagcattccgccgaatataacatgacggcctgattgtaatggtgtgcatgcggcatgttttgttcaaaaaaccaatgctgaatcggggtcagcttggttccgccattcacttctccttgatcagccaccctgctgaccggcgctacaaactgactaagttcagcaatcgaggggtgtttaaacaaatgcttcatatcaaccttgtatccggcttgatacaatctggatgacacctgaattgacttaatcgaatctccgccaaaatcaaagaaattatccagaattcctatacgttctgcccctaatacttcttgccagatagacgccagcagttcttctattgtgttccgcggggctatgtattcgtattccgcccgcgtattttcgtcagcagcaggcaaagctttcagatcaatcttcccattggaagtgagcggaatgcgttccaatgggataaagcgggagggaatcatataattcggcagttcccgggataattcttttctgaactgcgcagcggtcaaagaaggctcaccgacataataggcatacaattgtttggccccgtctgcgtcttcacgcgcgacgactgcggcttcacgaacgttttccagattgaacatggctgcctctacctcgccgatctcaatccggtagccgcgaattttcacttgatgatcaatccgccctaaatattcgattcttccatccggcagccatctggcgagatccccagttttatacatcttttgaccagggacatgcagatgctccacaaatttttcctccgtcaattcaggacgattgaggtagccgcgggccactcccgctcctccgacatacagctctcccggtacgccgatcggctggatttgatggtgcgctcctaaaatataagcttgatggttggccaccgggttgccgattgtgatctgttcatcagcggactgaacagggtgaaatgtagataccacgctgttttctgtcggtccgtattcattattgatccgaatgcgaggctgcagagaatggagcttctcaactgtatctgtttccagctgctcaccgcctacaacaacatgctgaacatggatgaagtcctctgtgttcatctgttcgatcatcgttttcagaagacggggagaagttgagaaatgagtaattctctcttgttttatggcattttgaatggcgaaagtttctttattctcttcattaggcaataggtgcaaagttgcccccgagatgagcgggccgaagaaatttaaaatgaacgcatcaaaaacatacgggtacaagacaagcacgcgatccgccggagaatgcttaaaaaacgccttcttccattggagcgaattcacaatgccgccgtgttcaaccatgactcctttcggctttcctgttgtacccgacgtataaatgacataggctaaatggctgtgtcccgctactggtgataacaatgagctatcggcatggtatgatgtttcatcattcaaatcaatctccgggccatcaaaggagagactgttttttaaatgacgctgaacaaggagaacgtctgcatccgcatcatgaagcaaatattgaagccgctcttttggatattcaggatccaggggcacataagcgccccctgccttccaaacggctataatggatacgatcatctctaatgaacgatcggcgagaatggcgactaacgtatcgggttgaaccccgcaattacgcaatgttcttgccaaacggttcgccttctcattcagttccctgtacgtcaaatggtcgtttttaaacttgacggccgcatgctcaggtgttctttctgtttgctcttcaaataattgatagactgttctgctcccggagaaatctctgacggtatcgttaaaatcaaacaatagcttctgtttttccgcttccggtaagatctctgccgtgtggatcgcggcttgaggctgaaacaggatcacagacagcagctgatccaaatgggatacaatttgattgatatagcgctcatcgtacaggttgccgttataaaaaagcttcaaatgaatcccgttgttctccaaatcaaagtgaaacagcgtatcggctgcagtatcttctttaaattgcaaggaatgaatttcgttaagcgaaacgacggtatgaatcaacggcagatgctcgtcattgtattgcacgctcagatgctgaaccatttttctaaacggcaggttttgatttttcagagaatcattaacggcttctttcagctgtccgaatacggttttaaatgtactctcgtttgaaagcgtattttttaagaggacaatgttgttaacggctgactggccggctttttgcttcgataccgtcggaatgccaagaatcaggctcgtttgatccgtatatttatataacaagcattcaatacccgccaataaaatcagataggccgccatatcggaatgattcgccattgtcatgattctttgagatacttccggagaaaaggaacggcagatgcatttttcctggtagccggtacgggccaacgacgctttatccgctgctttaaagtaagggaatgcgcttagtccgtcttcttcatcaaacaggttttcccagtacgtttcttggtttttaaataccgacattggagcacctcattttatataatttaaagaaataatgcttttccctaaaagttcaattgaatagaatcaagcgcgttctcttcttcctcattgctgccgctcaatccgatatgttcgattagaatgcttggctgttccaaaatcgccgataggatgtgtaagtagtcgtttgataaaacctcgattctgcttttcttaaacagttttttcgaatattcaaacagtccgtgatagttgtcgcggtccgcctgaatcgacaaggtcaaatcgaatttcgcaaccggatgatgaaatggatacggcttgagttgaagagaatcgaaagtcaattcagcatgatcgagattttgcagcacaaacatcgtatcgaataaaggattgcggcttgaatcttttggaagatgcagatgctgaattaattcttccaacggatagtcttgatttttataggcgttcagcatgttttcttttacttcgtttaagtaggcatcaaatgttttacggcccgccgggtgattgcgaatgactaacgtattgacgaacattcccacgaccagctctacatccaaatgagtccgcccggcagatggcgttcctacgataatatcttcttgtccgctgtatttggataaaagaatcgtataggctgccaataaaatcatatacagtgttgctcctgtgtcttctttcatttggcttaaacgctgtttcaagtgttctggtataagaaattcaaatgattcgccttcgtaatcgcgtatggcaggtctctcataatccgcaggcatatccagtacaggaatatcaccgtgaaactgatccagccaatacgcttcctggctcttgatgttccgtttctgaatgtccgattgctgccaaactgcaaagtctttatattgaatagagagcgggtccggtttgttcccctcgtagattcggcttaaatctttcatcagaatattgacggacacaccgtcagaaatgatatgatgcatatcaaccacaagcacgtgccgcgcaggttcaatttcaatcagtccggcccgcatcagcggcggtttggctaagtcaaacgctttgatgaaatcaagcacacggtcttccgcttcttcttcgcttgcttgaatccgttctatcgtaaagtcgacgttctgatgaatacgctgtgccggctcgccttcatataaatcaaagctggtcctcaacgattcatgacgcgcgattaattttcggaaagcggcgtttaaccgttcgggatcgatcgtcccttccacattcatggcacccgtcatattgtaagtcagctcgccgccttttgtgtgacttaacaaatacatccgcctctgagctgaagaaaccggataatatggcatttcctttgcagccggaatcggtacatatcgatttttgtccatgtgtaacgccttgtcagccaattgttcaatggtaggaaacttgaatatgtctttgagagacagattcacatccagctctttgtgaattctggcggctaaggcagccgctcggatggagttgcctccgagatcaaagaaattatgtttgatccccgcttggcttattccgagcacttccttccataaatctgtcagtttggactccgtctcattacccggcggaacatattcagctgtctgctgcagactcgcttctggtgcaggcagtgccttacggtttattttcccgttggacgttaacggcatatgctccagatggacaaaataggacggaaccatgtagtccggaagctccgatgacaattgttccctaagctgcgcagccgctataggcttgccgcttacgtaatacgcgcataattgttttaagccgtcttcttcttctttcaccgtaaccgcggctttttgcaccgcttccgcgttatgcattgctgcttcaatttcaccaagctcgattcggtatcccctgattttgacttgttcatcaacgcgcccgatatatacaagatttccgtccttcaaccgcttagccaaatcccctgatttgtacatcttcgctcccgggacatacgggttttcaacaaatttctctgccgttaaatccggacggttccaataccctctggcaacacccggtccgctgatatatatttcgccgattaccccgatcggaaccaggtttctgcttgcatcggccacataaatatccgtgttggcagccggagtgccgatcggtacaaattcccgcttgtcccgttctgcgtcgaagtgataaatcatacatccgacgacagcttccgtcggtccgtattcattgaaaatgtccagccggcctttaaactgctcgctgacacttttggccagacgggtgcttaaattttctccgccgacaatcattttccgtattgccgtgccgccagcgatattcatctccttgatgacgtgcagatgtgccggggtcaatttgatcatgtctattcttgagtcccgcataatctcagaaagcacagcgcttttatcttcgccgtcaaagacaatgatggtatttcccgtaaccagcggtgtaaatatcgaggtcacagtcagatcgaaagagatggaagagtataatgggaagttggttttctcacctcttacataaacctctttcgcccaccaaatataatcagccagtccctgatgctcaatgaggacaccttttggatttcccgtggaacctgacgtatagatcatgtaggccaaatcatgcgcatcgctgtccgattcaagattcgagtgattctcatggtatgagttttcctcatccaaaagcacaacgtcaccatcatacggtaattgatccagcaggctgcgctgtgtcaacacaacctccgcccttgaatctctcaggatatattggatccgatcttccggatattcaggatcaatgggcacgtatgcgccgccggctttcagaacagccaaaattccgacaatcagttcgatccgatgcgggcagatgatggcaacgaattgatccgcttgtacgccttttgtccgtaacgtccgcgccaatcggttcgcccgttcattgagctgtctgtacgtataccgctcattgccaaaaataacggcttcatgatcgggactctgttctgcttgcatttcaaaccatcgggttactgtttcgttatgcggacacggcgtctttgtgccattacactccgtcagcagttgatgccgttcggtttcagacagcataggaacggaagacaatgtcatctccggctgctcaacaagactgtttaaaatggcggtatagtgtttggtgatctgttcaatggtgtcttttgtgaatcgtcccggtttataatcaaaatgcatctctatctgttgaccggcatcttcgattgtgagcatcaaatcatacaaagagacccctggatttcgttctttcactttaaatgtacattcattgtgccggatttcatgaaattcaatgttttgaaacacaaacatcgtgttaaacatagactgtccggttgtttcccgctgcacatttaatttctccacaagccggtcgaatggatagtcttggttttcgaaagcgtcaagcgtctgccgctttacttcttccagataatccgtaaacgttctattggcgtgcggcttcgtccggattccaatggtttgtatgaaaataccgatgatcttttcgatatccggatgatttcttcctgaagcaggcgtgccaacgacaatgtcttcttgtcccgtatatttatgaagcagcacattataggcggccagaagcaccgtatagagagtggtttccgccttttgcgccaaatcttgaagcgaacggatgacatccggctgtaaggagcatgtcacacgctgtccctcagaagaccgttctgccgcttttgaaccgtctgtcggcaggttaaggatgggaatttcgtcttgaaattgttccagccaatatgtctcctgccgcttcatagcatcctcattcagccgttggttttgccattctgcgaaatctttatattcaaattcaatgtccggtaatggtttctgatgatataaagccagcaattcatttgtaaggatgttgacggaataaccgtccgaaatgatatgatgcatatcgatgagcagttcggcctgctcgttttcaatcttgatcagctctgcacgaactaacggagcttggtccaggcggaacggttttacaaaccggtctgaataggcatcaaattcgtcccggctcattgtccggacatgaacgttaaaatcaacttcgttttcaagtttctgaacgatatcgccatctataatgtcgaaatacgtgcgaaacgcttcgtgccgctgcatcacttgttgaagagatgagatcagggcttgctcatcgtacttccctgttattgatatttggccgaacatattttgcgccagctgatccggttccagttggtgcaggaaatatactctttgctgtgccggcgatgtcgggtaatacgcttttttctcggcagccttcatcgggaggtgcacgacttttgtttcgttctgaatgaaatgtgctaattccttaacagtctggtgattgaaaaattgtccgatggaaacattttgatgaaatgtcttctgaactttggaaagcataagcgtcgcctggagtgagtttcctcccagagccaggaagcgatctgatctgccgacccgttcaaggccgaaaagttcctcccaaatccgcgccagctgccgctccgtttcatttaccggcgcctcgtaggcttcagtgaaatttgctgtattgcttcctattgaagagacccgcttctggtgttcggcataaagtgcttgtaaatcatgctgttcttcatcggaaaacagcatcatggcgtcaagagggattgaatctccctcaaccattttttgcagcaattttgtaaaacccgctccccactttttcatgatttccggactgatgacgttcgtattaaagtcgaaatcaagaacatattcttgatgcgcgtctgttatgttaagaaataaatcatacagggtgcattttaccgggtatgcaacgggctccgcttccgcctttccgaaatgcagctttcgaaaaggcctgtctaaattaaagataatacgcatatccggcacttgatcgtgcggaagctctctggccaccagtgtcatcgggacggcttggtgccgcattgcaagattcacgctttctttcatactgccaagataaccggttaaagtgctttctgaagtagacgtgttcttcaccggaatcatattgacgcaatttccaatcagatcatgctgtttcatatgcgattgacctgcagcggggaccccgatcacaaggcctgactgtttggtaagccggtgcagaaaaagatgaaatgcacccagcatcgtcacaaatacgctatttttcatctgaatgcttaatgaccttaaagcctcgctcaatggccgtccaagcctgacggtacaccggtctccctcataccccttcggataacagacagaagctgcgctcggcagaattggctgctgtatcggttcagagaaatgacgccgccaataacggaccccttcttcataatggccgctgtcaatctgtgcctgctgccagtctaagtattggcgaaacgaaacatctgcctctttcggtgaaattggttttccttgtacaattgccgcgtagttgctctccagttcttgaacaaaaacggcgattgaccatccatcggcaatgatatgatggaacgtgagcacaatcagatgttcattgtgagccgcagtaagcacatggattctaaacaaaggcttttgttcatggaaatgcaacggccgcttggcatcttctgtcagccatttttgaatttccgactcccgatgttcatgcgggtgaccggtaaaatcaatgactggtatttctatattcatccgttcctgcacttgctgtacctcgtcatcgggatgaatcaccgtacgtaaagcttcatgacggtcaacgatatgccggacggcttgttttaatggcgtatgctgcagttcgccctccactttcagcataatggactggtttaaagcggcggaagcttcattcccgtaatgggatgccataaccaactgcttttgttcaggtgaaagctcgcgcgtcccggactttttacggcctccgccatcaggggaatccgggccttccggaataaatccgcctcggcgaagatcctccaccgtgtctttcaccgcttgaataatattttcgatatcatctgcggtatgcgcgacggacaagaagcagttgcgtccttcccacacatagacacctttatagttgagatggtaaaagaacaagtcattatcaagcgatgagacaaaccggaataaagaaccgaatcgaaccatgcggataggcacttgcgctagttcgaagcagcgattcagctcatcgaccaagtaggctgttttttgattcagctgctcatacagatgttctccctcggtttgtaaatgacgaaggacggctaatgacattctcatggtaagcggatgagtattgaaggtgccggccacaaacgtgcgtttcgcctcgtcttgcgggtaggaatcgtccccatactgccaggtacccccgtcgatcgcattcatgaactcagcttttccggcaactacccctaacggctgtccgccgccgatgatttttccgtaggtcactaaatcagcctgaatgccgaaccattcctgtgcgccgccgagaccgatccgaaatccggtaataatttcatccataatcagagctgttccggattgctgcgtgatcgcccgcaattctttcaaaaatgcccgcggctgcaaatccggtctgcggctttgtaccggttccaccagtacggctgccaattcatcaccaagactgcggatcacgtccagcgaatcgggattgttgtaatgtaaaataatcaaatcatccataaagctctgcagtatgcccggagccagcggattcgcagacgcagctccgccttttgtgccggcaacccctaatacgccgtcaaacgtgccgtgataagatcccgagaacgccacgactttctttcttcctgttgctgcccgcgccaaacgcagggcaaccatgacggcctctgttccggaattatagaaagcgaccctttccaccccggtacatgtgcggatccggtcggcaacttcaccggcgacatctgacatcgggccgagcggaggcaatgatgaacgggttgaatcatcgataacctgtgtaataaaggaaggatgatgcccgaaaaggttaactccgaaccccatggtgatatcgatatattcatttccgtcaatatcccacattttagaaccgtcagatcgttcggcgataatcgggtatacgatttccttccaatacgaacggaagctggacaagttgcggttgtttgcatgagcaaatcgggtgttgtctgtatattgtttggaacctttcgttttatctgcgtacttcttgatgaaatcttctaagtattgtttttgccgtgcggtatagtgtccctgatcatgcaggttctgaggctggaaaggaacatagggtttcgcttcttgagccgctttcttttctgcagtgacggccggaggcccctgcttgacagaaggaattgatttctcttgcgctttagcgtattctttctcatcggaatgatgtccgctgtttctcaacaaattaaagctatttaattgagcttgcaaggtatcctgaattaattgattctgagaagcgattattttttcgagcatatgctcttgatgaccttctctgcgatccgattcagactgtgcttctgaaatgacctgtatttcctgcgccggaacattctcttgaggcggagcggatgcaaaggacgatggaacggtctcagccaagtaatctatgacactttgaaggttgttcatcgtatcaaaaaaacgatccatcgggatgtctgccccaaattcgtccgcgatggcttttttgacctgtgacagcatgatggaatccatcccgagcccgataaaatgagcattcagatcgagttcctccgctctgatccccgaagcattgctgattacagttttcaagaaggattcaatgtgcgccttcgattgattgatattcaatgccgcttctcctctcttttcgtcctcgtttaagcgcaattggtcagcttcagcccagcatcggctccgttcaaacggatacaggggcaatggcgtcttttgtacagtttcaccggaataaagcgcgcgccaatcgataacggctccttgcacaaataattcggcggcgcgatgcagccatgtgatccgttcatcttgcgtacgtaaacgctgcttaatcagtgcggctgcttgtttattcagctcttctttatgagcgggcagcatttccttcatattcttgtagccgatgtatacaccgggaaggtttctgtctccctgaatcaggcgggtcagcttatccgatagttcttgtttaccggatacaatcatggcaatgccatgatccaaatgagccctgcccgtactggctgtatagcaaatggactttaatgaagcttggctgtcatccgatacatattgccggtactgctgtgcgagttcatagagtgatttttcagtatgagcggataaaacaaataggtgcggcccatgttcatcctcgggcgcatacttactttgagaaatatattcttccaataccacatgagcgttcgtcccgctaaagccaaatgagctgactccgcctcgcagcggctcttcaccggatgtgaacgctgcagcttcctggtttacgtaaaatggtgaagagtgaaaatgaatgagcggattaggttcattaaagtgcactaacggcggatttttcttgtgattcagcatgaggacagatttgatcagcccgacgatgcctgccgcttcaaacaaatgaccgatgttcgatttaacagaaccaatcgcacaaaattgtttttttgccgtatacttttcaaacgctttacaaagcccgttaaattcaaccggatcgccgagcttcgttccggtgccatgcgcttcgatgaaagacagtgtttcaggggcaatgcccgcgtctttccaagccgtctcaatgacctcagtctgagctgccggattcggtgctgtaatcccggcggttgttccgtcttgattcagcgcgcttcccttgattacgccgtaaatatggtctccgtcgcgaacagcatcctgcagaggttttagcaggactgcggccgcgccttcacctgtgccagtaccgtctgaatctttgctgaacgttttcgtgtacccgtccgaagattccatatcaagtccgatacagatcggcaagagcgatgtccggataccgccggcaagagccatttcacaatcgccggatattaaagatttacatgccatatgaaccgcggcaagcgatgaggagcatgccgtatccactgtgaccgccggcccttttaaatttaggaaataagcgattcggctggctaacacggaagggagattgcccacgatatattgatgaagctcctccggataattcgcagaaaggagacgttcataatcgtagcccaccttcgagtaccctgcatataccccgacacggctcccgttcatgctgccgccggcatagcccgcatcttcaatcgcatgccatacagactgcaaaaacagtctttggttagggtccataaactgagccgttttaggagctaaaccgaaaaacgagtaatcaaagcggtcgatttcatctaaatagccgcccttcacaaactgattctcattgatttcgctttggatggactttaaataatccgccgcatctttcagccgggatgcagggtattctcgaatgctgtgctcacctttttcaagcagattccaaaaatcacttttcgttgatgctcctgggacattgagcgacatcccgataatggcgatatctttcggcgtcacatggcttggtttcgctgccgcgtcctgcttgatttcagcccgtctttcagacagatatgccgctaaatcagtgatagaaggatacgtaaagagatctgaaacagcaagctcgcgtccgaatttctgttctatgcgctcggcaatctgcgataactgtaatgaatttgctcccatatcaaaataactgtcagcgaggtgaacctttttcccattgagcacatcggaaaagatagacagtaattccgtttcaatttcatgaatgggagtctgtccggatgtttccgggctgctctccaaacattcattgatagcggcagactctgttgcaaaattccctgcctcatactgtctggcaagttcgtagcgtttaacctttccgctggttgttttagggagttttcggatcggaaggacttcttttatgctccagccgccccgcttgagcaaatgcttttttatctctttgacaagcggtgcgaatttttcaggtgattttttgtaaacaacaaagagcacgatttctccgctttgtgtcttttgatcatatacaccgcaggcggcaactcttcctaagtcaacctcttccatttcaatcgcgacccgttcaatatcgtgcgggtagatattttttccgttcacgaaaataatgtccttttctcttccggttacgactaagttaccactttcactaatgaatccgaggtctcccgtttttacccagccgtcagaagtcagcgctttttccgtactctcggggttgttataatacccttgagtcacattgtctcctttgatctggatatggccgatgattccgtcttctactctttcatttacttcatcggagatccgaagctgacaatagtcaataggttgtcccacttcgacgaatgaagcgcaattttgatcctctttgcttacttttacagctctttcaccaagatttaaatagtcacgatgcaaataaacgggaacgaattctttacctaatttagagaatgctgcgccgaccgacgcttccgctaaaccgtaaacattcaaaatggcggatcttttcagattgaatactgcgcatcttttcaaaaattcgtcacagagctccggcaatatcggttctgcaccgtttgcgatgaccttgatgtgggataaatcccagtctggttcgtttttcagaaatttaaggaagtagttgtacccgaaatttggagaggatagaatactggctttatgttcatgagcttttttcatccaaagaataggtctgcgaataaataattctgtaggcattagattttgattgattccggttatgaagggaacaaggtggcaggcgatgagccccatatcatgcgttaaaggcatccatgataagaaagagtctttcgaatgaacggctagggcattcccaatggcgcacgtgttatgtattaagttgtgatgcgttaacatgactccttttggatctcctgtcgatcctgaagaaaattggataaaggcgagttcatccgcatcaggttcataaaacgaagcggggtaatcgtaggtttgatcttgaatgatgtcagatttttcgtttaattgatgatggaaatcctgtaaatcgtgttctgcagcatatttctttattttgtccaatactttttcagaggcaatcagaaacgggtgatttaatatgttccaaatgcgccagaccttcagcttatggtcatcatcttctccgatactgaccggcaccgggatcattcctcctaatatacaagcccaaaaagcaacgacaaatgatttgttttcttggatttgaaatacgatttcctgcttcggctgaatgccgatatgctgtaaatagccaagatacccttgcgcctcttcaaacaattggcgataagagacaaccgtctcgtttttatcggattcgataaaacggatcccgcggtcagagatattgcttctttcccgaatgacatctactaaggtttggaattgactggtatacataggtcccctcctgggcgctttattttaaaatccgcaattcttcccaatccggaagctgtttagcctcgcaaattaatttgcataaatggatcgaatgttcgagctcttgttctgagagctcattttcatgtctttccattctctctttcagctcttggatttgcgtaaataatgccgtcgtcatattggaataagccgctgaatccttgttgtaatttcgcgcaatgacggattgaatcatcaatttattcagttgttttttgcgtaaacggacaatatgtttctttctttctgctgaattggaaagcaagtgaacatcagatgtctgtcctaagggataaggtacaatgtgattcgttgtttttctcagcagaccggctaagacattgttcggacccatttcgatgacttccgtcactccgtgtaaaagcaagtaatgcatcgattccgtccatcttaccggcatcgtcatgtgctgctcgagatgttcgctgatcgaatttccgctgctgtaagggcgtgcagtgacatttgaaatgatcggccatgcggcatcccggaaggaataccggtgtaatacagtctggaattgttcagatgctgatcgtatcagcgaactgtgaaaaggcgcactgacattcaaataagtgtatgccgctcccttttcctccgccatcttgatgacacgttccacagcttgccggtgtccggaaatcacatgttgctgttctgaattcatgcaggctactcctgccggaaagtcttccgtcgacactttcgaacatatttcctgcaacgtttgaagagagaggtgagtcacggcggccatcgtcccctgctgctgagaatccgcattctgcataagaattccccgctgccttacaagtgtaacggcatcctgaaaagaaagggcgccggcacagacaagcgctgaatattcgcctaagctatgacctgccaggaagcggggcttcacccctatttcctgcatatacacttgaaaagcaataacactgaccgttaaaatagcgggctgcgcgttcattgtctttgtcaattcattcatatctccgttaaaacacagtttttttacatccaaggagatcgcatcgctcgcttcttcaaacaatctctttgcgagcacaaaatcattccaaaattgtttgcccattcctacaaattgagacccttgtccaggaaataaaaaggcaagattgttcatgagattcctccgatcatattgaacagaaatacaatatcctacaaattatccctttatctaacatcctagcatgattataacaaatgtgtatagaatactttcggaggagttattgttcgattttacaaacgaattagatatatttattcataaaataaaacatgagggtttcaccgaaaatcagtcttaaagagagatgatgaaaagccggagtggagcctgttaccggctcttcttcacttaggacgagctcttcatgtttcatatgttttagggctattggcattattgtgtcagaaattacatattttctgtttattgtaaaaattcatttgtatatctgtgaaggattgtaaactgatggcgtttgattataaatgcggtgcaagagatggatctggtgaggaaaatctgcaaggacaaaatacgccgcagaacaagtaaatgacccagcccggataccgattgacgcagtgaatcggcctattgagtgaacaaggttttcaggcataaaaaaacagccgttcagagcggctgttttttaaatagtacaagaactattgagcggtatacccgccgtccatgactacggcctgacctgtgaccccttttgctttgtcgctggccaaaaatacggcgtaatcagcgatttctttcactgacagcagccgtttttggggaacgagcggaaagatgacgtcctcaagcacccgctcgtacggtacattccttgttgcggaaatgtcctttaattgattgcggacaagctgagtgtccacatatcccggacaaagcgcattgacggtaatgccgtcagccgcgccttcaagtgcaccgactttcgttaaaccgatgacgccgtgcttggcgctgttatatgccgctttcccgtgaaaaccgatcagcccgttgacagacgccatattaatgattcgtccgaattgatgttttttcataatggggaatgcatgcttcattgcgataaatggcgcagtcagcatgacacgaatgagccgttcaaactgttcggtgggaaattcctcgatgggcgcgacatgctgaatgcccgcattattcacaaggatatcgagacgtccgaattgtttctcgaccgtctgcagcatgtcggccacttgcttttcatttgttacatcgcatgtgatgctgactgcctcacagccttcatctttaagtcctgccgccgcttctttccccgcttgttcgtttacatcagagatgatgacggctgctccttcacgggcgaattctcttgcaatttcaagcccgattcctccggctgctcctgttacaacggctgttttttcaataagcaatgaatccatggcggcacctcctcattttggtctgaccccgttttttaacgactggctgacagtaaaatgaccttctgttttctcaaagacctcctccattgttacaccttcctgcagttcggtgagcgtcatacggccatcatgaaaatcgaatacagccaaatctgtgatcagccgatcgaccacctgcctgccggttaaaggcagcgtacattccgttctcactttagattccccatatttattaacatgctccataatgacaataatccgttttgctccgtgcaccaggtccatggcgccgcccattcctttgatcatttttccggggatcatccagttcgccaaatctccccgttcggacacttccatcccgccgagaatcgctacatcaatgtggccgccgcgaatcatggcaaaggattcggcactgtcaaaatacgaggctccctttacctcggtaatggtttcttttcccgcattgatcagatcggggtcctccgttccttccgccggataaggcccgatcccgagcaagccgttttcagactgaagcaggacgttataatcattcggtatctcattggctacaagcgtcggcatccctatccccaagttcacattcattccgtcctttatttcctttacagcccgtttgatcattcgttttctgctatctctcattctgtcagcctcctttatcatgcttgccggacggtgcggcgttcaatccgtttttcatgaatcccgccaagcagcacgtgctgcacaaaaatacccggcgtatgaatttgatcgggatcaagctctccggcatcgacgatttcttcagcctctgcaatcgtcactttgcctgccattgcagcgagcggattgaaatttctcgccgtctttctgaacatcaggttgcccagaggatcggctttccaggcctttacgatggcggcgttccctgtaatccctttctccagaagataggtgcgcccgtcaaatgtcttatgttcttttccctcggctactgatgttccgacgcccgcaggtgtataaaacgccggaatgcccgcccctcccgcgcgaattctttctgcgagcgttccttggggcaccaattcgacttccagctctccgcttaaaaactgccgttcaaaggttttgttttctccgacataggatgcgaccatttttttgatctgccggtttgcaagcaagaggcctaacccccaatcatcaacaccgcagttattactgacaacggtcaagtttttcacgccgctgtccctgatcgcgagaattaattgttccggaatgccgcacaggccgaagcctcctgcgatgagggtgtctccgtccttgatcagtgcagcagcatctttataagagtccatcacttttccttttcccatattcgtttcccctttctgttttggctacacaaggcccgtcagactgtaaatggcgatgatgacaaacacagcggctgttttaatgacggtaatggcaaagatatccttgtaggattggcggtgggtcaacccggtgaccgcgagcagtgtaatgacggcgccattatgcggaagagtgtccatcccgccggaggccatcgaaatcacccggtgcatgacctccggtgggatgtggaatgtattgattgcttctgtatacgctgctgacatcgtgcttaaagcgatgcccattcctcctgatgccgatcctgtaatcccggcaagcgcagtggtcgtcaccgctccgttgacgagcggatcagtaaacgtctgcgatatgccgctgctgaccattttaaagccgggaagcgccgcaatgatgccgccaaatccgtattcggctcctgtattcatcgacgccagcaaggcacccccgatgccctcattcagtccttctttcaaattaaagagcacttttttccaatcgaacaaaatcgttgtcatgattccgatgaacagtgcgagttctactgaccagatcgcagtgacggaggaaaggtcaatcttcccgaacgcttctaaaccgagctgcgcaaaatcaaatccgtcagggtaccaatgcgggagccacatcgtgaagcatttgttcatgactcccacaaggataagcggaacaaaggcgagcacttgccgcgcggggctgggttctgcctcctgcggtaaaacaggcgtatgtttttcattagccagacctgagggttcctctgcagcggaaacttcagattgaaatccagcatagccttctccggcattggccgcttttttgcgccgggattctaaataaatcattccggccgtaagcacaaatgctgcaccaatcagtccgagccagggagcggcataaatgtttgttttaaaaaaagctgtcggaatgacattttgaatttgcggtgtgccgggaagcgcatccattgtaaaagtaaacgcgcccaatgcaatcgtaccgggtatcagacgcttgggaatatcagctttaataaataggtttttagcaaacggataaatggcaaacaccgctacgaagagactgacgccgctgtacgttaaaatcgcacccattaagacgatggcgagaatggctctttttgctcccacaagcctgacgattgtttttgcaatcgactcggcgagcccggatatttcaacaaccttgccaaaaacggcccctaaaagaaatacgggaaaatacagcttaataaatcctaccatcttctccataaatatattcgagaagaaaggaagtacgaagcttggatctgtaagaagcacggcaaacagcgcacaaatcggggcgaataaaataactgaaaagccccggtaagccgcaaacatcagcgtgcctaatgccaataaaataataacaatgtccacaaatccccctcttttctgctcaaaattagtaagcgcttacaaaaatcgagaaaataaagcaaaaaacatgccgattttgtacagtttctgaggctgaaaaaatgtgcatcatggtgaattttccgttttggcgagagaaaaggagacccttgctgcatgatattgattggctgagcagtgagttttttagggacagtgagatggatcagaaaggatttttgctttataaatatgtattcttttttctttcatttatttcctgcaagaggaaccgataaaatccggccctcctgcatggtcattcagccaaggacaaccggaagctctttgagcgacctaaaaccaatgagcttccggtattcaaggcggtgtgcggccagccgaagcttaggcatccgctcaaacagtgtgagaattgcaatttgtgcttcgatgcgcgctaatgaggagcctatgcaaaaatgggcgttctttccgaatgcaagatgcagattcggttttcttcggatatccattttatgaggctgatcgaatatgcttggatcgcgattggccgctcctaaaaggatatatacctgctctcctttttttatggtcttcccatttatttcacagtcttctgaagcggtgcgtgccgtcagctgcgcggggctgtcgtagcgcagacattcctcgacagcagtttcaataagcgaggggttttctctcagtgcgctaagctgttcagggtgtttcaacaaagtaaacacaccgttgctcatgaggtttaccgtcgtctcgtgtccggctatgacaagtaagatacatgtcgcgagtacttcgtcttttgaaagctgtttccccataataaacctgctgattaagtcttcctgaggatgtgctttccgctcgtgaatcaaatctctgaaatatgcagtcagcctgcctgcggtgtcgcttgctctgactaacgtctttcttgaccgggtaagatcaatggcctgaatgacgtctgccgtccattgtctgaattgatatctctcctctttcggcactccgagtatctccgcaatgatgaggcttgccaatggaaaggcaaactctgaaacaaggtctgcggtttttttgttttggatttgatccaacaagtcatgaaccgtttcttttatacaggggcgaagtgattccgccgtctttgcggtaaattctttacctatatgcatccgcatccgcttatggtctgattgatttttaaataacagcatatcgtgctggatatgcgatagattttgatatttcgttgaagcttccggaagaggaatgcggtttttaaatcgggtgtctttcaaaatcgctgccgcttctttatacccggtgacataccagcccggatgttttaatatggttcctttataaacaggatcaatggcacgcagtttttcataaaacgggtaagggtcattccaaaaatccgaatccgcatggagggacggatgtgcagtcgataggcccgccgtcatcttatacctccgtattgcaggcggattgcaggccggctttcatttcttcaacggattcgacttcaaaccctaaatcatggagcatttgatgatcctctgtttcatgctgccctgcagtcgttaagtaatctccgacgaaaatcgaatttgcggcgtaaagtcccagcggctgcagcgaacgaaggttgacttcccggcctcctgagatacggatttcttttgacggattgataaaacggaataaggcgagcacttttaggcaatacaccggatgtaattcgcttaccccttctaacggagttccgtcaatcgcatgcagaaaattaaccgggatgctgtcggcgtcaagcgcttttaagctgttcgccatatcaatgacgtcctgtttcgtttctttcatgccgacgatgacacccgaacaaggcgacatccccgattgtttcgccgtttccactgtattgaccctgtcgtcatacgtgtgggaggtcgtaatgtttgagtgattcctttgtgatgtattgatgttatgattgtaccggtctactcctgcctgtttcaggcgctctgcctgttccggcttcagcagaccgaggcatgcgcagatttttaaaccgtacgtttctttaatttctttgacagcatcaacaacttgatctacttctctgttcgacggtccccgcccgctggcgacgatgcagtatgtccctatattcaggtcgtgggcgcgttttgcccccttaagcaatatatgcttatccaccatccgataagactcgatcggcgcttttgatattgaagattgtgaacagtacccgcaattttccggacacaggcctgattttgcattcataatcatattcagctttactttttttccgtaaaatcgttttctgatatgaaaagcggcatgcatcagcaataaaagatcctcatcaggacaatttaaaatggccagcgcttcttgattcgttacttccgccccgtccagcactctctctgcaagatccatccattgattcatgtttatctccccatttgtgtcagattcatgaaagaggaaacatctatatgtttctcaatcatgtgttgaatgttttccggtgaaacgtgatccagcttcggtgtgattcccaaaatcggaactttgcataatgtttcaatcatgctcgggtttgtcttctcgtccagccccggcctgttccttacgccgttgatcataatgccgagaacctctattcccatgtttttcgcatattcaacggttaaatatgtgtggttgatggttccgagatcaggcctggcgacaatcactgccggtaattccaaggcttttatcagatcactgactaagtaattttcaccaagcggaacggaaatgccgcctgccccctcgacgatgaaacactcatgacgatttttgatcttactccagtgggccatgacttcatccatgctcacggattccccctcaagcaaggcggccgtgtacggcgcaagcggctctttccattcaaatggcgtgatttcttcatgagacagtgcggtttgtgacatgtttttcaacagcgaggtgtcactttccggatgagtccgcggcacgccgcttaaaaacggcttaaacactccgatatccgcctgtttctgcctgaatgccgcggcaagtccgcaagaaacgatggtttttccgacgccggtatcggttcctgtgacaaaaaaacttctcatttgtttatattcagctcttttctaatggaatcaaatgcttctgtcagctcgtctatgtcctgtaagctgcgatccgccgtaacggtcagcctgattctgctttcgccttccggaacggcgggcgggcggatggccggggcgcagattccctttttctccagcagcgcagcggctgaaaccgctgtttttgcatcaccgatgataacggggataatcggtgtatccccgcctcttacgataaagcccatatcggccagacgcgtttttatctttttgacagacgactgcagctcacggcgcgtatcgtgcatatctgatatgaggtcaaatgccgtatgcgaagccgcacaaattgacggcgggagggccgtctgaaaaataaacgtcctcgcctgattcagcaaaaaatcaatgaaaatgtttgatcccgcggcaaaaccgccttccgttccgactgctttgcttaatgtgccgatgacaacatcaggacaaacaccgaaatagtcactggttcccccgccgttttccccgagtacaccggttgcatgcgcgtcatctgctatcacaaatgcctggtactgctttgcaagcgccattattcggtcaagaggcgcgatggtgccgtccatgctgaaaacgccgtctgtgacgataaagcggcggttccgagtctggacggaggcaagttttttctcaagatcagccatatcaatatggcggtacacgatggtttccgcttttgataaacggcagccgtcaacaatgctcgcatggttcagttgatcgcttaaaatgacatcgcctttttgaggcagtgaggcaagcacgccgatattcgccaagtaaccgcttgaaaataataaagccgcttccgtctgtttaaagtccgcgattgtttgttcaagtttttcgtgccacacagtatttcctgtcgttaaccgtgagccgccgcttcccgctccgaaccggctcagcgctgtttgcgcggctgtgatcagccgttcatcttttgacaggcctaaatagtcattggacgcccaggtctgccgcttttgccccttggttttaagagcggtttcctgtgttcgcagcgtccgatacagcccgtctcttttcactgcatcgagccttccgaggagccatccgtcaaaatccacggccggtcacctcggctatcgcttctttcataatggagatcatggcttgtaactggtcggttgtgctggcgagcggcggaagaaaggcgatgacgtcaccgagcggccgtgtcagcatacccagctctctcattttcaaggacaccttgtaccccatccgcttttcaggcggataaggctgttttgtccccttatcctgcacaagctctatgccgcacatcaaaccgagctggcggacatcgccgacatgaggaagctgcttcagatcatgaagaaatttcgcagccgtttttgatttttcggcgactcgttcaacgatgcgctctgattcgaataaacgcagattttcaattgccgcggcacagccaagctgatttcctgtataggaatggccgtggaaaaatgttttcattttgtcgtagtcatcgtagaatgcttcataaatggcttctgtggcaaacgtcacagcgatcggcaaatagcctcccgtaatgcctttccctgccgccatcaagtccggctggacattttcatgctcacaggcaaacatttttccggtgcggccgaaccccgtcgccacttcgtcaacgatcattaacacatcatatgccgtacacagctttcgtacgcctgccagaaagccttcaggcatgacgatcatcccggatgcgccttgcaccatcgattcaatcgtaagtgcggcaatctcttcgtggtgctttgcaagcagctgttcgagcgcgtgaaggcattcatcccggcactgtacggggtcaccgctttcagatctgtatacataaggaatcgggactttgtagctttcaaacatcagcgggccgtacacatggtggaagagttcaatggagccgacgctgacggctccgatcgtatcgccgtgatagccgttctgcatcgaaataaacgtctgcttcttaggtctccctacgtttttccagtattgaaaggccattttcagagcgatttccattgcttccgctccgctgtcggagtaaaaaacgcgtgtcagcttttccggtgtgatgcccgtcagcatctccgcaagttctgttgcgggaacgttcgtcatacccagcaaagtcgaatgagcgattttttcaagctgtttttgaatcgcttcatccatttcttttttgcggtggccgtgtacattgagccatactgaagaaaagccgtcataatattctttgccgctgatgtctttcagcatgatcccgtttccgctttcaatgattaacggatcttcatcgtaatctttcatttgtgtgaaaggcagccaaagatgctgtttgcttttttcaatcattgattgtttcatatgttctcctcccgctgaatgaatacaggctgcttctctaaaaaatggatacagctctccgtatctatggagccatcagtaaagaaaacccggcatccgctttcatctccggcattcttcatcttggcaatccgctgatatcccagcttctttgcggcaacgtagcctgttatgtaatcagggtcatctgaccagcacaattcggcaataattcccggatgtgcgcaaacttttgccgcgatggcatgtgcttcttttattcgtgaattttccggcatgttgtgagtaaaagcccatttttgaaaatcatgtgacggccaatccactcgggatacccgcacacctctattccctctgcagtcaatgcgttttcctgcccggatatcaaacaggaccgctcctcttgcttctgcatattccgcaatgttttcgtacgctttctcgatcatgtgcggaggaatccccgccttttgcagaagcttgcgggcgattgcttgtcctttttccggcgtgtctgtttgatggaaggcaaccggcaaagggcggatcgtttcgatcggttcatgaacgctttcaagctgaatctgcataaaatcaggtatccctcttgagtgcgagaagcctttatgtaataagccatctaccgcttcctgtaaaccgctgtaagtgatgagccgttctccgccggaaatgtgttttccgccctgctcatggggggcgtttcgggaagctctcattctgacgctgtaataggtctcttcccgcatgaaatttccctcctttctttcactttgaaatttaatgttaaccaaaataataaaaggttaacacttatacagaatattagtgtttcacgcttaatatgtcaacctaaactacaaaactgttaacttaatgagttttacaaagcctcattacgttttcatgttttgttcatattttagtaattgtttattcaacactgtccgctaaagtaatccatatcaacaaataggacagcgatccgcatcttacttatgaagggaggtcaaaaccggatgccgttatgctgaaagaaaaagtaaagacagcaggccgtttttgcaccgtgggcgccggcaatacgctgatcgattttggtgtcttctttcttctcaccgcttgccttgtcccctatctgccggcgcagatctgctcctattcggcagggatcatcaacagctatgtgtggaaccggaagtggacgtttcgtgtaaagcgcaaggctggcgggaaagagatcgtgcgctttctcatcattaatcttgccgcgtcgggaatcacctttttgctgctgtacgagtttcaaaaaggcggctgttcgcttttggtgagtaagctcgccgccactatcggcggaatgatgatgaattttatcggaaaccgaatctgggtatttggagattcgctgaaaaacatacaggatcaggagtgaagatgaatgagaaaaaaagtgagaaaagcggtcatccccgcagcgggtttaggaacgagatttctgccggcgacaaaggcgcagccgaaagaaatgctgccgatcgtcgacaaaccggccatccagtacattgtcgaagaagcaagagagtcaggaattgaagatatactgattattacagggagaaacaaacgctcgattgaagatcattttgaccggtcggcggagttggaaatcaatcttgaggaaaaaggcaagtcagagacgctgaaggaaatgcagcggattgccgatttggccaatattcattacatccgtcagaaagaaccgctcggactaggccatgcggtgctgtgtgcggagcattttatcggagatgagccttttgccgttctattaggtgatgatattatggtatctgacactcccgctctttcacagctcatagacgtctataaccaacacggcacagaaacgatcggcgtacagcccgtcgatcctgctgatgtcagcaaatatggtattatacagacggggcggcagagcggtcatgtgtaccgggttgaggatctgattgagaaaccggccgttgaaaaggcgccctctcatattgccgtgttgggccgttacatattaacccctgccatttttaaagcgctgaagacgatcggaagaggcgcgggcaacgaaatccaattgacagacgcgctgcgcgaagtatgccgcacccgaagcatttacgcgcgggagcttgaaggaagccggtttgatataggagataagttcggctgttttaaggccggcacggagatcgggcttctgcgggaagaaatgagatcgaaacttttagcttatttagaagaggtgttaaaaagagaatctgaagaaatcgtgcgttaaaaaataatttgtaaccattttgcttgtcaatcagtcatataattgggtaaaaagataaagaggttgtgaacagtgtgggcaattttattagtgaaatattatcctggctgacaagtatgggctatttagggattgcgctcggattaatgattgaaatcattccgagtgaaatcgttctggcttacggaggctatatggtgtcagaaggcacgatcagctttatcggcgccattgtcgccggtgtgatcgggggaacgatcgcgcagtgctttatttactggatcgcccgttatgggggacggccgtttttggacaagtacggcaagtacttacttctgaaaaagcatcatgttgatgttgcggaaaactggtttcgccgttacggcgccggcgttgtgttctcggcgcggtttatcccggtcgtcagacatgcgatttccatcccggccggccttgcgaaaatgcctctttccaagtttgtcatattgacgacgcttgccattattccgtggtctgtcattttcgtttatctcgggtatcagctcgggggacagtggaaagacgtagacagctatgccggaatgtatacaactccgatcattatattggctctcgtatttattgttgtttattttgttgtgaagaaaatgagatcaagactgtgaaaaaagactgcataagaacggctgcgagccggatctatgcagtcttttttatttataccgggtatacggggtgtttccggtgtgtgaatgtcagttgtttggacatgtaagcagtgaggcgtttattgagttcttcccgcaaggaatcagcaggaacaatgccgtcaatcaccatttcagaggcaagccggtaaaggttaatatcttccttatattcatcacgcttttcttgaataaaagccggcctttcttcaggggccagctcgctgattttgtttgcgtagaccgcattcaccgctgcttcaggacccattacggcaatttgcgcagtcggaagcgctaaacagcagtccggttcaaaagcaggccccgccatcgcgtataatccggcaccgtaggcttttctgacgataacggaaagcttcggaacagtcgcttccgccattgcggagatcatttttgcgccatgcctgatgatgcccgcctgctcaaccttcgttccgatcatgaatccgggaatgtctgctaaaaacagaagcggaatatggaatgcgtcgcacaaagcgataaattttgcggctttatccgccgaatcgagaaataaaactccgcctttgacacgcggctgattggcgataatgccgaccggctgtccgtgaatccgcgcaagccccgttattaattcctgcgcaaataacggtttaatctcaaaaaatgagtcttcatcaatgacacgttcaattaaatccatcatgttgaacggtgcgttttgatgtgccgggatgacatctgagagcggtttttcaaaagctttcgggttcttagatttgttgacgggcgctttttcagtataatttgccggaaagtagctgagatatgtctgcgccatcatgattgcttcctgttccgtcggggcgaggagatcaccgcagcctgatacggaacaatgcatacgggcgccgcccatttcttcaagcgatactttctcgccgatcaccatttctgccatgcgcggggaacctaagtacatggatgcattgccttcgaccataatgacaatgtcgcaaaaggccggaatgtaagcgccgcccgcagcggaaggaccgaacaataaacagatttgcggaatgcggcccgacagctttacttgattataaaagatgcggccggctccccttctgcccgggaacatgtcaacctgatccgtaattctcgcacctgcggaatcgactaagtacaagagcggacactgaagcttctccgccgtctcctgaatgcggatgattttttccaccgttttcgcgccccacgagcccgcctttacggttgagtcgtttgccatcacacaaacggttctgccgccgatggttccgatcccggtaacgaccccgtcagccggcagtccgtctgacatgcactcggcgaaaaaagcgtcttcaacggatatgccgtcatcgaataaaagcttcagcctgtctcttacaaaaagttttcccttcttttcgttgcttgcatgatatttcgcggctcctcccttttcaatcgttttgctgcgtgtctgccgttctttttcgtaatccatccgagtccctccatgttttattttcctttgtattcagggggtcttttttctttaaaagcgcgcaggccctcttctctgtcaagtgtagggatgacttgttcatatgcttttcgttcgatttcgagccctgtattgagatctgtctccagacccttgtttatcgcggattttgcttgtctgacggcgatcggcccattagcggcgatgcggccggccagtgcttttgctttttccataagttcatcggcttcacaaacatgctcgatcagcttcatgtcttttccctcttcggcagaaagccttcggccggtatagatcaattcttttgccgcgccggggccgataagccggggcagtctctgcgttccgcccgccccgggaatgattgcaagccctgtttcaggaaggccgaggcccgcccggctgacggctgttctgatatcgcaggcgagagcgagttcaaggcctcctccgacagcggttccgttcagcgctgcaatgaccggctgcgggagagcttcaatggatgcagccgtttcaccgatacgcctgacgcttttcttaacttgttcatgattcatccccgctctctcttttaaatcagcgccggcgcaaaatgtgtttccggagccggtgagaatgacacagcgaatggatggcgagtttttgatgtcttcaatcacacgctgtaaatgatcaatcatttctgaagacagtgagttggccgcatgcgggcggttcagcgtgatcagaccgatcgtttcttgacagacggaatacaagacgcaatctcccatggcttctcctttctcatttcgttctgaatgcctgcaggtttctgcttggcagatctttgcctattttatccgcgatccagtcggcggcataaagaagtttattcatgtccgtcccggtatcaatccccatttgttcgagcatataaatgacgtcttctgtggcggcgtttcctgctgatcccggagcatacggacagccgccaagcccgcctgaggaagtatcgaaggatgtaatccccatatcaagagctggaatgatattcgctagagccgttcctcttgtatcatggaaatggagtgcgatttttgaggcgggaattctcggcaaaagggcttcaagcacggctatgacctgcaaggggtttgccgcgccgattgtgtcgccgagcgatatttcatcaacatccatttcgagcagggtgtctgacaggcggatgacttgttcgaccggcacgttctgttcgtacggacagccgaacacagtagacagataagctctcgtcgccattttttcagcttttgcttcagtaataacccgcctgagctcttgaacggtccggtcaatcggtttgtttacgtttttttggttatgggtttcgcttgcagataaaaatacacaggcctgatcgattccgccttctgcagcatgctccagtccgatgaggttcggaacgagagccgcgtagaccgtatgttcagatctggcaatgccttttgcgacgtccaggctgtcacgaagagccggaatccatctcggatgcacgaatgatgtcacttcgatatagggaaggcctgtttttgacagcatattgatccactcaatcttatcttctgtatccacccacgccgattcattctgcaagccgtcacgcggtcctacttcattgatgcggacatgtttcggacagttcatgctgcacctcccgttttattgaagttcaatcaggacctctccttcatcagtgaaatcaccttctgattttttcacttctttcaccgtacccgctgcatcagcgataatcggaatttccattttcatagattccaagatggccacttcctgcccttcttcaatgacatcacccggcttcacatgaattttccacaggtttcccgccatctgaatttttatgacgctcattttgacgccccctcgttcattgtttgtaaaaaaccggttgttgcctcacccttttcaaacacttctgaatgggcaatttttgtcagcagcggaatgttggttttaatcccttctacatgatattcgccaagggcggttttcagttgttcaatggcctgttttctcgtattcgccgtgacgatcattttggcaatcatcggatcgtaaaacggagaaatgacgcttcccttttcgacggcgcattcgtgtcgcactgacgggtgtcttaaaacggaaaaagacaagatggtaccgggtgacgggtaaaaggtgaccggatcttccgcatagatccgcacttctatcgcatgaccgcggtgattgatatctttctgcgagaaagtcagcgcctgcccggcggcgattttcagctgttcttccacaagatccagtcctgtaatttcttctgtcaccggatgctccacttgcagtcttgtgttcatctctaaaaaatagatttgtttcttttggtcgacgagaaattctattgtgcctgcattttggtagccgatcgatttagcggctttaacggcggtttcaccgagtctttgtcttaattcatcgtcaacaaacggcgacggcgcttcttctatcactttttggtggcgcctttgtactgaacagtcacgttcaaacagatgaacggtgtttccgaaagaatctgcgagaatctgaatttcaatatgacgggcattttcaatgaccttttccatatacattgcgccgtctccaaaaaaggacgcggcccgcttttgattgccttcgaacgctttggccagctcttcttctgaatgtacgatctgcatgccgattccgcctccccctgcagacgctttcagcatgaccggaaagccgatggcacgggcttcggctaaggcggagtgaacatcgggcaatggctctgaaacaccgggaacgatcgggacctttgctttttgcatcgtttttcgggcctctatcttgctgcccatcttggcgatgatatcaccgggcgggccgataaatgtgatttgttccttccggcagcgttcggcgaacaggctgttttctgacagcagcccgtagcccggatgaatggcgtccgctccggcggatttggcggcttctatgattctgtcgatatgtaaatagctttcatttactctcgatttaccgatcggataggcctcatcagcctcttttacatgcagcgcgtcccggtcggcttctgaatacacagctgccgaggggatgccgagacgtttgcaggtgcggataattcttaaggcgatttctcctctgttggcaatcaggacttttttaaacaaatgtgaagcactcctttttcattaagttaatttgagctcttcaatcgttttttcccgcagcttgaatttctgaatttttcctgaggctgtcattggatattcatctgtaaacaaaacatacctggggactttatagcgggcgatatgttctttgcaaaaggttctgatgtcttctgcggaagcggtttgtccgtctttgagcctgacccacgccgcggcctcttctccgtatttcggatcaggcacgccgacgacctgaacgtctgctactgcgggatgccgatataacatttcctcaatttcgcgcggatagatattttcgccgcccctgatcagcatgtctttcagacggcccgtgattttgcagtacccgtcctcgtccatgaccgccaaatcaccggtatgcagccagccgtctttgtctatcgcttcttcggtcgcttcttgatttttatagtaacctttcatgacatgatatccgcgggtgcagagctctccttgttcaccccggtcggcttctccggatgttccgggccgaacgattctgacttcgatatggggaagtgcgcgccccgctgtttccactcttctttcaaacgaatcatccgttcttgtctgcgtaatgacaggtgatgcttcggtctgtccgtaggcaatggtaatgtcggtcatccccattttgccgatcacttctctcatgacttccgccgggcatggcgagcctgccataatcccggttcggacgtgggaaagatcatattcagaaaaacggctgtcatttaggagggcgataaacatcgtcggtacaccgtgcagagccgtgcaggcttcttgctccaccgttttcagaacggccggcggagaaaactgttcgatcggaatcatcgccgcacccgcggaaacacacgccagcacgccgagcacacacccgaagcagtggaaaaacggcacgggaatacataaacggtcacttgaagtaagcttcatgcattctgcgatattggccgcgttatttacgatattaaaatgtgagagcataacgcctttcggaaatccggtcgtacctgatgtatattgcatatgaatgcaatcatcctttttcaggctgtccatccttccgtcaagcgctgcatccgttacagcttcgccatccttcagcaaagaatcccagcggtgcatcccgggcggacttttatcaccgatatataacaccgtccgtaaaaaggggtaacgtttcgaacgcagcctgccgtgctcacaagttttcagctccggaatcagcttattcaccatctcaacataagatgtctgccggtaggaatccatgattatcagggccgagacgtctgaatgcgccagcaggtaatcgagttctgcgatttgaaaatttgtattaatggtgaccagaacagcgccgattttcgccgttgcaaattgcgccgcgagccattccggtatgttggatgcccatatggccacatgatctcctttttcaactcccagcttcatcagcccttttgcggtttgccggcataaccggtcaaactcggcatacgtataacgaaggccgcgctcagggtaaacaaccgcttcatgatccggaaaaagctccgcggtccgctcaagcagctttccggctgttaaatggataagttcagccatatgacctgcccccttccatccctgtcttagtaaacgttttcatttcacttcaaaagctgtcttgcgatgaccattctttgaatttctgatgttccttctccaatctccatcagctttgcgtcacgaagcatacgttcgacaccgcattccttcatataaccggaaccgccatgaatttggatggcctgaaggcaggttctgacggccatttctgaagcataaagcttggcgaatgccgcttctttcgtaaatggcaggttttgatccttcagccatgccgctttaagcaccatttgtctggcaaggtcaatttccatcgccatatcggccagcttaaattgaatggcttgaaatgacgatatcggactgccgaactgcttgcgttccttcgcatatgacagcgacgcctccagtgcgccttgagcgataccgacagccagtgccgcaatcgagatccgcccgccgtctaatgtatataaaaattgtttaaagcctttttcaggatcaccgagcaggttatcggcaggcaccctgacatcctccagcacaagctcggccgtatccgatcctctcacacccatcttgtcgtacggatttgtgatcgtaaatcccggtgtgtctgtcgggacgatgagagctgaaatgatcggttttccggcggagttctttcccgtaacggcggtgacaatgaccgtgcgggcgtaatttgcgtttgtgatccagcatttttctccgtttatcacatagtcatcgccctttttctcggcttttgtctgggtgccgccggcatctgaaccggcattcggctctgtcagcccgaatgatccgagcgcttttcccgaagcaagcggaataagatgttcttgcttttgctgttcagtaccgaaatagtataatgggcttgcgccgagtgacacggctgccgcgtagctcagccccgtgctgccgcaggcttttccgatttcttcaaccgctgctgcatatgaaatggtgtcaccgcccgccccgccgtattcttccggaaacggaattccgagcagcccgagttcgcctatttttttaaatgtgtctatcgggaagacggctgattgatcaacctcatgggctttcggggcaatttcatttttggcgaaatctctgaccatttcgcgcaccatctgctgttcttttgtcagttgaaaattcattaaccttcctccttctgctgctttctacattttattaatgggggtctttattcattccatccaaataaagtctgaacattcggactcatccatcgcaaaaaaactgacagcgcggcaactgtcagttttattaataatggctatttaatcgtccgttttgcggagggacggctctcatggtgaagcctgtcaacggaagtaacgatataggtgcaggcttctttcccccgaatatcagtatctgaaaatgtctgcgtccgtgacgatgtttttctggctgtatccactaaataaggctgctttcccttttctgcgcggtaaatggcgtaataagccgtttttttaccgttggatttcgcatcttcgatatagagtgtatggcctgaagcgttcttctccgcccgtttgacagacggtttttttaaagccgactgtccgagccaaggcatctcgggaattaatgcgggccggctgtacatgtcattgatcaaacggtttttcacatcgagcggattacggtttaaatcctttaaactgaaatgcatgctgccttttatccatgctgatcctctgtttagagtaatctgtcttccgtattcccccgggtcggcccaggccggatcagtattgttgttgattttataagctgcctgcccgatatataaatgcaccggccgattgttcacttcttttccccaccaatccgctaagacgtcatatgccgccgctttaaatccgatactccagtaaatttgcggtgcgatgtaatcaatgtatcctttttggatccattctcttgtatcagcatataagtcatcgtagttccgcaccccggcggccgtttcggagcctgtcgggtcatctgcggcatttctccatacgccgaacgggctgattccgaatttgacataaggtttttctcgtttgatggtttggttgatttcttttacaagctggttgacgttatccctgcgccagtcatcaattgatgcaaagtgagcttttccgtaccgttcgtattccgcctgatcggggaattcctgtccggcaattttataaggataaaaataatcatccatatgaaccgcatcaatgtcataacggctgaccacctctttgattccatccgttataaattgtcttacttccggaattccaggattatagtacagctgttttccgtatgcagcgacccagtccggatgagaacgcgcgggatgatcgtctgaaagcgcattcaaatttgtgtgattcatcgtgatccggtaaggattgaaccaagcgtgaaattcaagattccgtttatgtgtctcttcaactaaaaaagcaagcgggtcgtagccgggatttttgccttgggttcctgtcagatactctgaccaaggcccgtaatctgatggataaaaagcatcagccgcaggcttaatttggacgataacggcgttcatccccatctcctgaacgtcatccagcagcttgctgtattctcttttttgctcttccggtgacagcccttttttagagggccagtcgatattagtgacagacgcgatccatacggctctcatttctctctccggctgagtgccgcttgcttgtgcggatgctgagaacgtaaagatgccggctgtcagtacaacggccaaaaaccatatcatgctaaaacggcagcttttcatgtttttccccctctctgctttacggtattccgaagcattccgggcggtgaatcagaaagcccgctttgctcctctcagcctaaaagggaaagaaaaaagtcctaaagcgaatcaaaacgcttcaggactttttatgttttatggcggcgagcacgtcaatgaccttcgttccgacgccgacgcatgtttcaagaatggcctgcgctccggcaatggacaaaatgaaaataaccggatgcgcatagcggggccagaccaaatagcagatgccgatcaatatggcgcaccagacgcccgcacaccaataacattgcagcatataaccgaatgcggaggaagggacttttttttggacggcgcgcccgttttgatcgacggttttttcttgctttataaagggttttcttatgaattccgtaatcttatcaaatacgatcaaatgggtcagccggtagctggcaagaataatcattacatacgtaagccaagataggttcgtcatctcaaagcctccaaaaaaaactgagtttgattcccctatcttgccctttgacttcttcagtcattctgccggatgttacagattccgcgccaagcgtcttccgctgtttgcgatgatgtccagtatgacctcggcatttttgtgtgcaaactcgggttcaaacatatctttatgggctccctcgccttgatattcctggtagagtcccgttgtggcgccttcccattttttcggctcaggctcagcattttgctcttcctttaagccggcctcgataaaatggaggtttgccgcgatttggccgtcatttatcagttccgcccagtacgtttgatatcgctctgtttttctgatgaccgcttccctgacggcttccgggacattttcggctgttgcgtttgttggctgcggcggcagtgcgtcaagctttctgtacgcgtctgcgataatgacgtcgctgatttctaagcctcgcttttccatcgcttttgcagcctcgaatgccgtattgccgcctgccgaatatccgaagaggatataagggccttccggctggatttctagcattttatcaatgtattgttccattctgctgtcttcttcaataaagttaaaaccgtacacagcagcccgtccatttaatgccgccgccagatctttaaagaaaatgccgaaacctgagataggcggaaaacagaaaagattgcggcctttcggctgattcagtctgctgatatgctgttcggcagcttctgacagtgtgtttgaatacagcttttcagccaattgttcaattgtcggatattcaaatatcatttcaatcgggacgtccatctgctgcctggtcttcagctgatgaatcacttgcaatgctttcaaagaatggccgcccagctcaaagaagtcatcctgtatgcccagctctccgcagccgaggatcggcgtccaaatgtcgatcagctcacgctctacccagtttcgtggcggaacggcttttgatgaagcttttttccgttccggcgcaggcagcccgcggcggtccactttgccgtttgcggtaagcggcatacggtcaagcttaatcacatactgcggaatcatatagtcgggaagcgacctggccaatagggatcgaatggctctttcttcagcatgtgcgcctgtataatacgcacaaagggttgcttcttgtccttcgtctgacacgatgactgcagcttccctgattccatcaatttcagtcagccgcgcttcaatttcggccggctcgatacgcttcccgcgaatcttgaattgacggtcgatacggctgatgtatccgatgcttccatccggcagccagtgtgccaaatcccctgttctgtaaatcttttcttcaggatgaaccggatggctgacaaacgcttcacttgttaagtcaggcctgtttaaatagcctttggcaaccccgtccccgccgacacaaagctcaccgggcacgccgatcggcgcaagtccgccatttttatcaatgatatacgcggttgaattgctgatcggttttccgattgggatcggctgagaaaaatcgtgcctgatttcgtaaaaggtagaaaatgtcgtattttccgtcggcccgtatatgttataaaggctgagattcggacagcggtgtctgaccttattgatgagcgccggggacaatgcttctccgccgacatataaggtgtgcaatccggaaaacatctccggatccgcctgggcaaactggttaaagagcgccgtcgtcaaaaacagaatcgtaatacgattggaacaaagataattgccgaacctctcaggggcaagcattgtcgtgcggtcaaccacatgaaggcacgctccgttcaatagcgctccgaagatttcaaacgtcactgcgtcaaaaccgatggaccctgtcagaatgagacggtccgtcgtgccggctgacgtgtaattgctgtttgacacgagcgatacgacgttgcggttggaaatcattacgcccttcggttttcctgttgaaccggatgtatacataatataggcaaggtcctcaggtgacgttacggtattcagttttcccgcctcagctgtttgtttttcagctgcagccgggatagagatgatgtgagaaaagtcaacgtcagtctcaatccctttttgtaccgttaacagctgtgctccgctctcagtgagcatatcggcgatcctgtcggatggcagttctgcatcgagcggaaggtacgtccctcccgctttcaatacagcgagaacagcgataataaattccggtgagcgttcggcaagaatcccggcaattccttttggcgccaaaccgttttccagcaggatgcgggcgaacgcagttgaccgttcatcgagctcccggtacgtcatcgtcagcccgccggcgtgaagcgcctgatgatccggggttttcttcacctgtcggctgaacaggctgatgatgctttcgtctctttcataaattgttttcgtgtcattaaattcgccgattattcttgatttttccttttgtccgagcatcggaagccgatcagcaggaacatcgggattgaaggcggcgccgcgcagcgcttcttccaagtgtccttttacgctctctatccatacttcgtcataaacgttcgcattgtagctgaatttgatgatcagctcatcgccgggcgctatgatgaggttaaaatcgtagcccgattgttccgaaacattgacattcccgatccggaacggtgcatccgattccttttccgcgtctctcatctgctgctgaatcggataattttcaaacacgatgatatggtcgattaaatcctgtttcagctcagtctgagattggatgtcagcaagcggatgataactgaacgcctctgaatcaagcatttctttctggctgcggcccagcagttctctaaagctttcatcacccgttttaatgcgtaccggcacggtattgataaacagcccgatcatgctttccacgccgtcaatgacggaaggccgccctgatacgacagcgccgaatacggcatcgtccgtccggttgtagcgctgcagcatcaggccccatacagtctgcataagaacagcgagcgtagcgccctcttctttggcgatggttttcagcctgtctgtcagattttgatctaaagaaaacaggagctctttcttacggtagcctttttcctggggacgggccgatattttcgggagtcctgagggtgtctcgcagcctgctaaatatcctttccaatactcagaagccgcgtctttgtcctgatcagtcagccatgtaatatacgtgctgtaaggctttgcgggcgccaatgtgacgggtgagtctgattcaatcgcccggtacatatgcatgaattcctgaaggacgataccgaggcaccagccgtccataaggatgtgatggtggctccagacgcatacatatttttcgtcagccgttttaaacaaagacacacgcatcagcatatccttttgcaagtcaaagccttttaagcggtcacgttccttaaatcgctgtaagtaggcgctctgttccgcttcatccaaatgtgtaagatcttcgcggtgcagccggaattcccgctcacgcagcacgacttggcgggggccgttcagctgagcgacatgaggtaaaaaaaccgttctgaaaatatcgtggcggctgatgacagactgtacgctttgctcaaacaattccggacgaagccggccttttatggtgaagacggattgctcgatatatgcagccccctccttttgcagaaaggaatgaaaaagcattccttcctgcattcggctgaggggataaatattttggatattttttgttttgtccatgtgttcctcccgctcggtttagtggaagctgagtaagtcggcaatatcctgcaaggcttcctcagtcagctcccgatcatcaaagtcactgacggtcttctccgtatcggttttgctgaggcagtgttccgacagtttcaggagataataccggcagctttcggacagccgttcgatcgtaccttgccggaagcgttccgtttcataggaaatgctgacggtcatccggcctttcgccgcaatcgcgctgatttcaagtgactgctcccgtttccatgtatctgtcacatcatctccgcctcccaaaggagaaaactgaaacgcgtcaggctgttccgtttctgccggattcccgccgggcgcatcgaattgtccgagataattaaagctgatctccggtgctttcccgaaagtcatcccggcaagcttcggcggtgttaaatatttgaggacgccgtatccgttccctttatccggaatgcgccgcaatgtgtctttaacggttttcaatgtgcgaatttcatattcttcaagaggttcataaactccgctccggacaagcaccgggtaaatggaagtgaaccaccccactgtcctgctgatgtccgcacctgcctgctccgattggcgtccgtgtccttcaagggcgattttcaaagcgtgccgcggcgaccacttttgaacggcaagcacagcggaagccaacagcatatcttgcgtatccgtattgtaggcgctgtgcacatctttcaacagggcgtccgtttcactttctgtcagagtgaaggataccgtgttccgtttttttgcaggagtttgagatagacctgcctgctcgtaaggaagactttctgtttcatagtgttcaatctcccgccaatactccgcctgctgaagaagctgtctgctttcggcataatcggccagctgctccgtatatgttttgaatgacatggttttcggagggagtgtgatttcctgaccagaggcggcctgctcataagcagaagccaagtcctccaataaaatccgccatgatatcccgtcgacagcgagatgatggacggtcagaaacaagtaatcttctgcttcagagcggaacagccccgcctgtaccagcggcccgttctccaaatccatgtttctctgaagctctgcgacgcggcgttttataacacgttccttctcatgctcatcgccttccgtttctaatatggtcatgttgtaaagctgctcatctgcgaggtcagccggtctgttgaagaggagaagacctttctcttcgtcttttttgcagacaaggcgcaaggcatcatgatgaacggtaatggcttttaacgttttcctcagagcctcttcatctattgaatttgttctcgtcagcatgacggactggttaaaatgatttgcttccttcatgtcttgtgtgaagaaccatttgtgaaccggcgaccacttcacttctccttctgcgggagcttggctgaccggctgccgctctgtacggacataaggagccagctctctaattgtcggccggctgaaaatatcttttacggcgatctgttttcctgcctgatgtaatcgggctgatacttgcagggctttgatggaatcgccgcccagttcaaaaaatgattgatccgcggcaatgttttcagttccgagcacttcgctccaaatcgcggaaagctctttttccaagtcgctttcaggctccgtaaatgcccgtccggtgtgcgcttttttccgcggctcaggaagcgcgcggcggtcaagcttcccgttcggtgtgacaggcagggcttcaagtgtttcaaagaatgccggcaccatataagcgggcatttcatttctgagtgcctgctgcacggtttcactttctgttccttcttctgtcacgatataagcgcatagttccgtttggcctgctgatgcggacagagcggtaacggctgcttccttgacaccttttatgcctgttaaggccgattcaatttctttcagttccacccggtagcctctgattttgacttgctcgtccattcggccgatatattgcagcgtgccgtccggcagccattttgccagatcgcccgtgcggtacatgcgccggttcttgtggaacgggtcttggacaaaggcttgggccgtttgcttaggaagattgcggtaccctcttgcaaggccggaacccgaaatgcaaagttctcccgttacaccgatcggctgcgggtgatccccgtttaaaatataaacgtgtgaatgctcaatcggacggccgatcgtaatgttctcactttgttctatatgtcttgccgctgtagtggcgacgctgttttccgtcgggccgtactcattggcaagctccgtgtgaggacaaactgataaactgcggctgataatgttttggtcgacagcttctccagctaatgtgacaattctgagagactctgcatcccccggctccagtacgtcaagcagtgtacggtacagtacgggaacaatgatcatgtgagtgatgcggtaagatgcaagatagtgtttaatggcaagaatatctcttgcttcatcttcagctggaacggccgccttcgcacctgaaatcagcggtgtgaacatacttgttacaaaaccgtcaaaggaaaatgaaaaaagctgaagaactgtatctttctcattcagatcataaaatccgctgcgccattgaagggttttgctgacggaacgatgttcgaccataacccctttcggcctgcctgtcgtcccggacgtgtaaatgatgtaagccaaatcttccggtgctgataatggctgaaccggtgatgcgtcttgttcttggatatcctccagtgcgagcacttcacctttaaaatgatcaggcacttgatctatcgcgccgtgtacggtaaggagaagcgctgtgccgctgtctgaaatgatatatcgcttgcgttcctccgggtattcaggatctatcgggacgtaggcgcccccggctttccaaaccccgaagactgcggcgacttgttccggtgatcttggtatcacaatgccgacggcggcattcggtccgatctgccgtttttgcagagctctggcgattttattcgaccattcatctaattctttatatgtgaccaacgtttccccgctgataagggctgccgcatccggtgtttttcgcgcctgagtgatgaacagttcatgaactgttttttcaggcagctgtttatccgtcatgccgttaaagtccgaaagaattcggtcccgttccgcagcagtcagcatgctgatcgcttgtatagaagtttccggttcacggacaatgtgttcaagcatcgtcataaagtgggaagcccagcgctgcatcgtttctttccggaataaagacgccgcatattcaaacagaaaatgaatctgtcccccgccttcagaagcctgcaaagtgacatcaaatttggaaaccggacgggacacgttcgcaggctgaatatgcaaaccgtccaacagcaattcctcatgttccatattctgaacgacaagcatggcatcaaacagcggattacggcttgtgtcccgctgcacgccgatccgctccacaagctcttcaaacgggtagtcctgatgttcatacgcctcaagcgccgcctggcggacttccgccaaataatcggtgaaccgtttgtctcctttcggctccgttctgatggcaagcgtgttgacgaacatcccgagaatcggttcaaggtctttgtgcggacgcccggcaatcggcgagccgacgatgatgtcttcctgcccgctcaatcgcgcgagtaacgtattgtacgcggcgagaagcaccatatacaaagtggagctgtgatcccgggcgatgcggtgaaggccggatgccgtttcagcgtcaagcgtgcacgatacgctgccgcccgcaaagcttctgaccgccggacggggcttgtcagccggaagctcaagcaccggaagctctccttcaagccgcttcagccaataggcttcctgcttctggtacccttctttctcctgaaacgaccgctgccagacggcatagtctttatattgaaggcgcatcggcgcaagcgaacggcctgcgtacagctcgctgaattctttaatcaatgtgttgacggacacaccgtcagaaataatatgatgcatatccgttaataaaaggtgacgttcatccgattctttcacgagggccgcacggaagagcggcgcttcctccagacaaaacggccggacgaatgcgtcagctgactcggcctcatcaagctgaaacggcacgctgtcatggatgcgctgcaccggttcgccgtcaggccccgtttcaaaggacgttctgagcgactcatgccgctcaacaagctgccggaacgtctcctccagccggccgcggtcaagcgggcccgtcagttccagcacagccggcatattgtagccgacaccgccgtcttcaagctgttggagcacatacatccgtttctgcgccgaagacaccgggtaggtgtcctgttttttcgcaggctgaatcgcttcatacgagctttcttccaagtcctgaataaccgaagcaagctcttccaccgtcggccgggcgaagatgtcctgtaacggcacctgaacaccgaactctttggcgatgcgggagacgagagccgtcgcttttaacgaatggcctccccgctcaaaaaagtgatcccggatgccgacggggccgtttttcagcacctcttcccaaagggcgcaaagcttcatttccgtgacgttccgcggggcggtgtacgcctgtctgtctgccgctccgccgggagccggcagcgcgcggcggtcaagctttccgctcggcgtgaccggccactcggtcatctctataaactgagccggcatcatgtaggccggaaggcgtgttgcaagctccgcccgcacgtcatcgctttttcgtccttcaatataggcgtaaagtgcggtttcgccgtgttcggtccgggcggtgactgccgcctcacgaatgccgtcaatgcgccggatcgccgcttcgatttctcccggttcaatccggtagccgcggactttcacttgtccgtctgaacgcccgagccattcaacaaggccgtcttctgtccagcgtgcgatatcgcccgtctgatacatgcgttctcccgggtaaaacggatcatcgagaaagcgctcctccgtcagctcaggccggttcagatagccgcgggccacccctgtccccgcgatatacagctctccgatacagcccggcggcagaagctgtctcttttgatttaaaatatacagccgcatgttatgtccggaaatgccgatcggaacattgtgaaattcctttccttgcggcaaatcaaagtacgccgcttctaccgtcgcttccgtcggaccgtaggaatttgtcaattccgttcccggcagaaggtcataaaaacgggaaaccaagtgagggcccaattgttcgccgccggcaaaaaccctttttaagcaggtctttttgatcggctgttttctggaatttatatattccaagaaagcatgaagcatggatggcacaaaatgagctgccgttatgcggtttttctccaatgcgttcagtatcatttcagggtctttctcgccgccttgcggaaggagaaaaacagaagctcccgcgatcggccaccaaaacagctcccaaatcgaagcatcgaaagagtatgatgttttatgcaaaatggtgtcggaatcctttaatccataacgcgtttgcagcgagtataaaaagtttacggctgactgatgttcaacctgcacgccttttgggcgtcccgtagaaccggatgtatagatgatataagccaatgaatcaggtttcaccggaacattggggttggccgcagcttccgggtttcctgtttgcccgcttttcagagagatcgtttctccctcaaaaagatctggtgcgaaaagttctggttctgccagtaagaatttcacgccgctgtctttcagtaaaaagcgaatccgctcttccggataatccggatcaatcggcagatatgcaccgcctgcttttaagacagcgtaaatgccgatcagcatgtcaggagaacgccggcccataatggcagttttatcctccagccttattccccgcttgatcagccggtgcgcaagctcattcgctctttcgttcagctcctgatacgtaatcgaaatgtcatcagttaaaatcgccggacggtccggcgttttttccgcctgttgttccagcagctcatgaagagactgatgaagcggaaacgctgttttctgcaaggggctgaaagcgtgaagcagagatacttcttctttttctgacaaaacagaaatatcgtctaattccaaacccggatcagctgcggctttttcggcaagtgtcgtgaaaaattccgcccattttcgaatcgtttttctctcaaacaaatcggtgctgtattcaaactggcagtacaattcaccggcgttttcggagatgtacagcgataagtcaaatttagaaatcggcaggctgacgtctgccggctgcagttcaagtccggctgcccttagcttctgctgttccatattttgcagcgcaaatgttgtgtcaaacagcggatttcgggacatgtcccgcggcacaccgagcttatcgacgagctcttctaacgggtaatcctgatgttcgtaagcctcaagcgctgtttggcgaatttcctttaaatattctttgaacgtcatgcttccgtcgggacgcgtcctgaaagcgagcgtattgacaaacatgcccagaacggcgtcaaggtcggcatgaggccttcctgcaatcggagacccgacaatcatatcttcctgtccgcttaaacgggctaacagaaccgtgtacacaccgagcagcgtcatataaagtgtgcatttgttttctttcgccagctttttcaactgtgctgtatgtttttcgctgatgacaaatgacacccggtcaccggaaaagctccgcaccgggggacgcggcttatcagccggcaattcaagcacgggaatctccccggcaagccggttcagccagtactcttcttgtttccgatatgcggcgcccgccataaatgattgctgccagacggcataatctttgtattgaatccgtaacggcggcagacttctctcagcatacagctcactgaattcacgtatcaaaagattgacggatacgccgtctgaaataatatgatgcatgtcagctaaaagcagatgccggtctttttctatttggacaaatcccgcccggaaaagaggcgctttgccgagatcgaacggccggataaacgcttcggctgattgttcttttgtaaatgcaaacggcacttcgtcatgaatcctctgcacaggccggccgtttatttcttcaaaggacgttctgagcggttcatgccgccggatcagctccttgaacacggcttccatcctgtctcggtcaaacggccccttcacctctaaaacggctggaatgttatagctgacaccgccattttcaagctggtgaaggacatacatccgtttttgagcggatgagacaggataggtttcttttgcttctgttttttctatggatgcgaacggattctcttctgcttcaccgatgattttggcgagttcttctacagtcggatagctgaagacatcactcagcgggatttgcacgctgcactctttagctatttttgcaacgagtgccgtcgcctttaatgaatggccgccaagctcgaaaaagtgatcgtgaacgccgatcgggccggtttgaagctcttcttcccatatgcgggtaagcttcagttcggtcacattccggggagctgtatatcgacggcccgctgcgtacgccgaagcttccggaagggcccgctgatcgactttgccgttcgcagtgagcggaatcgcgtcaacgaaagcccatttgaccggaatcatataatcaggcagctctttggccaaatcacttcgcagctgagaaggatcagtcgcttgtgagacggtgcagtaggcgcataattcattttcgcccgactcattcgtttgaatcagcacggcagcttctttcacggcatgatgatttgccagaacggtttcaatttctttcggttcaatccggtaccctctgatcttcacttgatcatctgtccggccgatgtattccatttggccgtccgcacgcagtcttgccaaatctccggtccggtacatgacggcgccctttctgaacggatccggcaaaaatttctcttccgtcagcgccggattgttcacatagcctcttcctgtattcgctccggaaatatacaattctcccgcaattccgagaggctgaagctgtctgtttttgctgagaatatacatcttattatgatggatcggtttcccgatcggcggatgttcaggtatgtcatctcccgcagaaatcgtatacgttgaaaccacatgggtttctgacgggccgtaatgattatgcaaatgcataccgtgtaaacggagcgtctgcctgaacaaacgtgagatagtcagctgctccccggccgtaatgacatgcttcacacagcggggaaaagactgtgcataaccttcttcattgaaaagcatcttgacaaacgcagtcgggaaaaacaccacttccgttttgtgctgatcgataaacgaatacagctgagaaacatcccgtttgattgattcgggcacgatacaaagggtgccgccgcttaagagtactgaaaataactcctgatagcagacgtcaaacgccaaagatgcgtactgcagcacatttgtgcaaaaatcaatgtctgtgttcgtcaattggtcagaaagaaggttggccatatttttatgttcgagcagcacgcccttcggtttccctgtcgtaccggatgtataaatcatataaaggaggtcgtccgccgtattaatggattgcacattgcttccgtccgcttccgtcccggcctcttctatatatgtaacctgcagcgtttgttccgcggggagtgactgatgccgctctgttacaacatggatgcagccgctgttttcaataacatatcggatacgctcctttggactgccgggatctatcgggacaaaggcgccgcctgcttttaaaataccgagaacggccgccgctaaagaaggggaacggccgagcatgatgcctaccggctcctcccgctttaatccgcgtttttgcagcagacgggccagcttattagccgattcattcagctctttgtacgtcactgacccgtcttcataccggatcgcgatttgatccggcgtttgtgcggcctgccgttcaaacatcgcatgaatcgtgtcatactcaggcttttcagtttcttcagaaatcggagcaagcagctgctctttttcctcaggagtgatgattacaagcttatccggcgtgatatcaggtttgtcgagaatctgggaaacgatatgtgtcaaatgacctttgatattttcgataaattggcggtcatacacgcttgaatcgtatctcattttcaaatgaatctcgtcacccggcgccaccataagataaaaactgtaattggtttcgtcttccatgctgaaatcatggatgtgaaaaaggtctttcgtttccccgttgctgttcagcacatcgagctcctgttcaaccggataattctcaaagacgagaatatggtcaattaagccttgttttacctgtgaattcgcctgtatatcataaagcggatgatagctgtatgcctgtcctttcaaagcgtccttttgcacgtttttgatcagcttttgaaacgggatgtccgccccgctgatccggacaggcacggtattaatgaacaggccgatcattcgctcgatgccttcgatttcagacggccttccggaaataacagaaccaaaaaccgcatcttctgtctggttatacgcctgaagcaaaatgccccagagcgtgtggaaaatggtgctcagcgtgacctcttctttcacggccagatctttcagcttagccgtgtcctcttttgaaaaggaaaacgtcacttcttcttgtctgctttcgccggcttttttctgcttcggcagaacagtctgctgctcaaagccttcaaggtatcgttcccagtacgaagcggctttttctttatcttgctccatcagccacttgatgtaggtcccgtacggcacagcgggctcaagcgttaacggtgtccggcgaagccgcgaggcatatatctggaagaactctttcagcacgatcccgagacaccagccatccataataatgtgatgaaaactccaaatgcacgtatattcacattctccggtttgaagcagcatcacccgcatcagcatgtctttttgcaggtgaaatcctttctttcggtctcttcgtttggcttcttcaatatgcttgatttgatcagccttgtttaaattggtgagattttcctcaatgatgctgacgttccgctcttttaatacgacctgctgcggcactgacacgttctggctgataaagatcgttctgaaaatatcatgtctttcgaaaagggcatgaacgctctcttcaaacacgcgggtgtcaaccttccctgttattgaaaaagaggcctgttcggcgtaagcctgtgattccttttgcaggagggaatgaaaaagcattccttcctgcatataagacagcggataaatatcctgaattgcattcttttttgtcatgttataatctccccgtcgcctttttctacagttcctcgacaaaactcgctatgctgtccaaatcatcagatgttaacgttttgctgctaaaatcactaacggttttttctgcttcctctttgccggtgcagtgcgccataatatcacgcaaatattgctgtaaagtttgcagcagctgttccatcgtttctttgcggaagcggctcggcggatagctcaaactgaagtgcagtttatgttgtgctgccatcgcgctcatttccaccgcttgttcccgctgccatgtcggcgtgatgtcgtgcccgctcgcaagaccggataaactgaatgtgtgctgatcttctgtatcattgaattgccctaaatagttaaagctgatttcaggcgcttgtctgaagcggattgttttttgttcagacggtgtcatgtattttaaaatgccgtagcctattcctttatccggtattcttccgagtgtgtctttgaccgtttttacagccgttccaagctcagcgcctgctgtgttcaagtcaatgagcaccgggtacatggaggtaaaccagcctacggtgcggctgatgtcgagctccggcatgatgtgctctctcccgtgcccttccatcgcgatgcgcagtctgccgccccctgtccagtcccgtaaagccaaagctgcggcagtcagaagaatatcttgcgtatcggtatggtaggcccggttgacctgctgaagcaaaacggacgtttcttcttctgtaagcgtaaagcttaccgtttgccgaacgctgtcggctcccgtctgatgctgcggtttttcataaggaagttcggcggctgtttcttcttcaataaaacgccaatattcttcttcacgcatcagcttgctgctttttgcgtattctgaaagccttacggcgtattgcttaaacgaatcggtctttggcggaagctggaccggctgaccttttacggcttgagtgtaagcggcagataaatcctccagcagaatacgccatgacactccgtcaaccgccaggtgatgtacggtgatgaataaataatcccctgaccgggttttgaaccatccggcttttaataacggccctttttcaatatccatccgctgttggagcgcagccacttcatcttctatttctctttcccaagtatctgtctcagacagatcccaaatgtccaagctgtacagttcttctttttgaataccgtgattgatttgtctgatactttcgttttctgcactgacggtgatccggagtgcatcatgatgaatgacaagatgctccaaagcttgtttgagcggctgtttatgcaatgcgtcagagctgaacatcatgacggactgattgaaatgatttctgttttccatccgctgtgataaaaaccagtgctgaacgggtgtccaaggtatgtctccttccaccggccgctgatcgatgactctttccgctttccggataagaggcgcgagttccttaatggacggatgccggaataagtcacttgccgtcattttccacccgtagcgtccgagccgtgcggcaacttgcagcgctttgattgaatcgccgcccaactcaaaaaatgagtcttcaatcccgacttgttttgtgccgagcacttcctgccagatcacggaaagctgttcttcaagctcattgcggggagctgtgtatgcggtttgaagcgcgagctccggttcgggcagatttttccgatccaatttaccgttcggcgtaagcggcagcttctcaagttccatcatataggccggaaccatgtaattcggcagttgcttagaaagtgaagaacgcactttttctgtatccatgtccgcctgcagactcatatatgcgatcagttctttattgccggactgcccggttctgactgacacggcagcttctttcacgccgtccaggctccttagtgcggcttcaatctctcccagctcgacccgataaccgcggattttcacttgatcatccatccgtccggcatattcaatcgttccgtccggcagccagcgggctaaatccccggtgcggtacatccgttctccgggaacaaaaggattagggacaaatttttcttccgtcagctcagggcggccgaaatatcctcttgccacaccgtctccgcctgtgcataattcaccgatgacgccgatcggctgcggtgttcccctgctgtttatgatatatgcggttgaatttccgacagggcggccgatcgggattgaatgatcgtatgattgttcaatcaaaaagcaagtcgagaacgtcgtgttttcagtcggcccgtatccattccataccgagagatacggcagcgcattccgaacccggtttacatgacttggggacagtgcttccccgccgataatcaatcgggataatccggaaaacacgtattcattttgttctgatagatgattgaacaaagacgatgtcagccacagtgtcgtaatgccgttttgctgtataaatgtttccagaacatcagagtcgagataggtttcctggtcacttacatataaagaagcgccgtttaaaagcggaccgaatatttcaaatgtcgttacatcaaatcctaatgatgaagtaaacaacagtctgtcttccggcgtaaaatcaatataattgctgtttttcacaaggcggatcacgcttcgctgttcaatcatgacgccttttggcgcacctgttgacccggacgtataaatcatgtaggccaacgattcaggtccgccgagcggttcgggattttccgaactcaagccggcctttgtttgaatatcctctatgaataaacgttttcctgaaagcggcagaccgtcaagtttatcagattggagaagaatatcagctttacagtctttaagcatccattcagcccgttcccgaggcacatcgtcaccgataggcaagtaggcgcctcccgcttttaatattccgaggattccggaagcaagctctattgtgcgtccggttaataaggcgacaacgctttccggaccgacgccatttgatcggagagccgccgctattctgttagcccgttcgttcagctcacggtatgtcaagatttgtccatcatatacaactgcccgggcatcgggggtttcttcagcctgccgctcaaataaacggctgatggtttcgtgtcttgggtaatcgcttttcgtctgattaaactgataaatgacgcgatttgtttcagcatcatccagtacgtgaatgtcaccaagcggtattgtttggtcttcaattacttttgtaagaattcgggtaaagtaagaaagccatttttcgattgtctgtttttgatagatatctgtattgaattcaaaatcaaagctgatggaaccgtcagacccttctgacgcgtaaagcgtggcatcaaactttgcggttttatgacttgtatccgcagcttgagtcaaatgcagctcatttaaattcagggattcacgctccatattttggagcacaaacatcacgtcaaacagcggattgcggcttgtgtcccgctgcacgccgagccgttccaccagctcttcaaacgggtagtcctgatgctcatacgcctcaagcgccgcctggcggacttccgccaagtaatcggtaaaccgtttgtctcctttcggctccgttctgatggcaagcgtgttgacgaacatgccgagaatcggttcaaggtctttgtgcggacgcccggcaatcggcgagccgacgatgatgtcttcctgcccgctcaatctcgcgagtaacgtattgtacgcggcgagaagcaccatatacaaagtggagccgtaatcccgggcgatgcggtgaaggccggatgccgtttcagcgtcaagcgtgcacgatacgctgccgcccgcaaagcttctgacagtcggacggggcttgtcagccggaagctcaagcaccggaagctctccttcgagccgcttcagccaatacgcttcctgcttctgatacccttctttctcctgaaacgaccgctgccagacggcatagtctttatattgaaggcgcatcggcgcaagcgaacggcctgcgtacagctcgccgaattctttaatcaaggtgttgacggacacaccgtcagaaataatatgatgcatatccgttaataaaagatggcgttcgtccgattctttcacgagggccgcacggaagagcggcgcttcctccagacaaaacggccggatgaatgcgtcagctgactcggcctcatcgagctgaaacggcacgctgtcatggatgcgctgcaccggttcgccgtcaggccccgtttcaaaggacgttctgagcgactcgtgccgctccacaagctgccggaacgtctcctccagccggacacggtcaagcgggcccgtcagttccagcacagccggcatattgtagccgacaccgccgtcttcaagctgctggagcacatacatccgtttctgcgccgaagacaccgggtaggtatcttgtgtttgcgcaggctgaatcgcttcatacgggctctcttccaattcctgaataaccgaagcgagctcttccaccgtcggccgggcgaagatgtcctgtaacggcacctgaacaccgaactccttggcgatgcgggatacgagagccgtcgcttttaacgaatggcctccccgctcaaaaaagtgatcccggatgccgacggggccgtttttcagcacctcttcccaaagggtgcaaagcttcatttccgtgacgttccgcggggcggtgtacgcctgtctgtctgccgctccgccgggagccggcagcgcgcggcggtcaagctttccgctcggcgtgaccggccattcgctcatctttatgaactgagccggcatcatgtaggccggaaggcgtgttgcaagctccgcccgcacgtcatcgctttttcgtccttcaatataggcgtaaagtgcggtttcgccgtgttcggtccgggcggtgaccgccgcctcacgaatgccgtcaattcgccggatcgccgcttcgatttctcccggttcaatccggtagccgcggactttcacttgtccgtctgaacgcccgagccattcaacaaggccgtcttctgtccagcgtgcgatatcgcccgtctgatacatgcgttctcccggataaaacggatcatcgagaaagcgctcctccgtcagctcagggcggttcagatagccccggccacgccggtccccgcgatgtacagctctcctgccacgcccgcaggctggacggttcccccgccgtctaacacataaagacgggcacccggaacgggttttccgatcggaagccgcgtccgtccgctgtcccgttttcgatcacagacgtaaaaggccgcatcgaccgtcgcttccgtcggcccgtagccgtgaataagcacggtctccggcagaagatcggcaaaccgggcagccgtaagcggggaaagagcttcccctccggcaaacacgcgtgtcagtgttctgccgaggcgtgttcttgtttctgcaggctcagtttccagcgcgtctaaaaagctgttgaccatcgccggaataaaatgtgcggtcgtcaccttttcagaagaaaaagcttcaatcatccgcactggatctttctcccagccggccggaagcagatacacggaggcgccggatatcgtccaccaaaacaattgccagatggaggcgtcgaatgaaaaggatgatttcagcacgataatatcctcttccgttaacggaaactgcccttgcatccctgataaaaaggcggcggcttgacggtgttcaacagccactcccttcggtgttcccgtcgaaccggacgtataaatgatataagcgagcgaatcagcatccgcttcgtcagagacagcccctgtctccgtctcacttgtcagagcagaaagagacacttctagcgtttcgccggaaaaaccggaaacggataaccccggctgtgcaagcaggagacaagcgccgcagtcatcgagcatatagcgcagcctgtcctcaggatagtcagggtcaagcggcacataggcgccgcccgcttttaacacggcaagcacagaaaccgccatctccggcgagcgttcggcgagtacgccgaccatgctttctttgcggacgcctttttgtcggagccggacggcgagcctgtccgtgtactgatcgagctcggcgtacgtcagcataccgtccggaaaacggagcgccggacgatgcggcgaaagcgcggcgcggcgggcaaacagcccgtgaagcgtcggagccggcggttcaaccgtttctgtatggttaaatgcatccatcatacttctggcttcacacgcatccagcaatgcgatctcggaagcgccgatttcagggtcggaaatgactgagttcaccatatgccgtaaaaatgtttcgatattcttcataaaaacatcgtcgtatataccggtatcaaattttaagcggatataaagagaattgcccggaatcacctttatgctgcatccgtagtttgtgacttcttccatcgtgaaatcctctaccgcaaaatcaaatgaaccggcctgactcacattttcaatttcacgctgggccggcacattttcaaacacgataatatggtcaaacagcgcttgcttcagagggctttgcgcctgaatgtcatacagcggataatagctgtaagcttctgcttgcagcgtctcctgctgcaaatgcctgacaagctccagaaaagaaaatgaaccgcttttcacccgtacgggaatcgtattaataaacagtcccaccattttttccacgcctgcgagatccgacggccggccggaaacgacagaaccgaaaacggcatcatcacagcggctgacacgctgcagcaaaatgccccacagtgcctggaacactgtattcagcgttgctccagcccttgccgcaatgttcttcagctcatttgtctgctcttcagaaatggtgaaaaccgcctgctcaagttcgccgtttggttccgcggattttttcggaagagacgccgattgctcaagatcggcaagtctcgttttccaaaaaatctcagcttctttacgatcctgcttcatgagccatttaatatacttcccatatggctgaacaggctcgagagacggaagccgtccgtctcccagagattgatagatcatcagaaattccttcatgacaattccgaagcaccagccatccatgacaatatgatgatggctccatatacaaacatagcgttcaggcgcttttttcaaaatggagactctcatgagaggatctgattgcaaatcaaagcctttatctttatcttcttttctgaaccggtcggcatatttgtcttgcgccttctcgtccaaatgagaaatatcatgaaactgaacgcggctcggcctgtttttcagcacgacttggcggggctttgccacattcttgtgaataaatgtcgtacggaaaatatcgtatcgttcaaaaacagcatctatacttttttggaatcgttcccggtcaagctgtccgctgatcgtaaacaccgcttgttcgaagtaggctcttgagtcatgatccaacagagaatgaaaaagcatgccctcctgcataaaagccaaaggatatatatcttgtatttccggttgctgccccattgcgccactccttttctatagtttgttgacggctcccataatgtcattcagatcttccagcgttaactcctcgtcactgaaatcagcggcgctccattcacgctcctcttttcctgtgcaatgcgtgatgatctgcttgagaaaggtatgaaaatatcccgtcaaaacttcaatcgtttctttttgatactgaaaacggttgtacacgacatgcatgctgagacattccgacgatacggagccgctgatatcaagtgtgtacgggcgttcccagtctgggctgacttcatttcccgcttttacgggagaaacaccgaagccgctggaacggatttcccggtcaaactgtcccagatagttaaaactgatttcaggagaatcagattcagtctctccccagagtttgcttatatatttcagcaccccgtatcccgctcctttatgcggtatgcggcgcatcatgtcttttgtccgcttaatgtgataaccgagacgctcaccgtcatcaggctgatcttgaaaacttgcgtcaaccaataccggataaattgacgtaaaccagccgatggttctgctgatatcaagatgctccaggtgctcttcccttccgtggccttccatgctgattttgaatgcctcgtttccggtccatctgttcagcgcaaggcttaacgcggcaagcaataattcgcccgtctctgttgtgtatgctctgttcgcttccgttaacagctgctcggtctcctgttttgtcaatgtaacggtcatcacatctgtatctttcagaagattggaagagatacgggcatctttcggaagcggtttgaccgccgctttttctctttcggaccagtagtctgcttcctgtaacagccggcggctttttgcataatcagagatttgctttgcgtaagtctgataggaatcggttttcgccggaagcgcggtttcttttccttcgagcgcctgcctgtagcacgcggtgagatcttcaaataaaatcctccatgacactccgtcaatgacaaggtgatgaatggaaagcagcagatgatcgccatcagcggcatgaaataagccgacagctacgagcggacccgtctccagccgaatggaagtttgaatacgggcggccgcctgttcaattgcggcgtgctcctcttgtaatgaacctttctctcttacgtcatgcgtttcaaacgtaaagagttcttcttcagaaaggttttccgctctgttatattgaatcaccgatccgttttgcgtgccgcataccatccgtaatgcgtcatgatgaaccgcgagctgtgccagcgcttttctcatagcagattcattgattctgtctgcactgcggagcataacggactgattaaaatgatcatgcggcaatgattgcgaaaagaaccagtgctggatcggcgtcagcggcacgtctcccgtgacgggagactgatcaatcacgcggcggactttccggagccgcatcgacacttctcccagtgtctgatgctcgaacagctcgcggacggtcgtttcatagccctgctgtttcagcctcgcacatacttgcagcgctttaatcgaatccccgccgagatggaagaaatgagcattggggccgagtccttcaacacctaagagttcttcccagatgtcagccatcatttcttcagtttcatttctcaggctgatatcatctccaaggctttcatttaattcaggctgcgggagtgccttctcgtccagcttcccattcgccgtcaaaggcagttcatcaagctctatcaagcgggcgggaatcatatattccggcagaaaagctctgagagaggcctgaatctctgcttcttttattttttcgttcccgtgtatgaccgcgtatgcgtaaatggagtgctgaccgtgctgatcagcacgtgtgatcacggcggcctctttcacgaaggaaagctcctgcagcgctgattttatttctcccagctcaattctgtggcctctgacttttacttgcgcatctatccgcccgacatattccagctcgccatttgagagtcttttggcaatatcgcccgttcggtagagccgcatgccggtattgtgcggattcgtgatgaaccgggaggcggttaaatcatccctgtttacatatcccctcgcgacgccttccccgccgatataaagctcacctggaattccgatcggctgcggattcatataggcgtccatgacaaaagcatgaagggtttccagcggtctgccgatattgcttttatttctctcaatatcatccatcttcagttttttgcatgtgacgtgaaccgtggtttccgtaatgccgtacatattaacaagctccgtctccgggtacttctctttccagcttttcagcatgccgggctgaagcgcttctccgccgaaaatgacatatcgaagcttcagcttgtccgcatgcccggcctcttcatgaatgagtccggaaaaagccgtcggcgtttgattcagcaccgttacgccttcactttgcagcagctgccggtacaaatgcggatcacgggctgtttctttcggcacgataactacctttccgccgtataagagcgcgccgaatatttcccagacagaaaaatcaaaacaataggagtggaacagcgtccagacgtctccagagccgaaatcaaacggcagtcctttatgtgtgataaggctgatgacattgcggtgttccgtcataacgcctttcggttttccggttgtgcccgatgtgtaaatcacgtaagccggctgttcaggcgttatcatttctttcgttctgtctgctgaaacggattcaggcttatcaatgtataataccggcagcccgtccattccggatatcccaagacccgattgcgtcaacagaacacgcgcgccgctgtcagtcagcataaatgaaatccgctcgtccggatagtcaggatcaatcggcagataagcccctcccgcttttaaaataccgagaatcccaatcagcatatccggggatcgttcggtcataattccgacaatctgtccggagcggatgccgttttccgacagcatatcagcgattcgatccgccttgtcattgagctcgcggtaggtgagacgctcatcggacataacggctgcaatttgatccggcattttttccgcctgtgcttcaaataaactgacgatcgtctcatgcttcggatactcagctgtttgattttccgcttgaagaagcatctgccgctcgtttgtgtccagcaaatgaatgtcagacagcttctgctcatcatccgatgcgatttgtcctaaaagctctttaaaatgaccggcccaccgttcgatcgtatctttttcaaacaacgcggtactgtattcaaaatgaaaatccagtgagccgtccggctgttcctcggcatgaagcgtcaagtcgaattttgaaatgtcatgtttcactgcatgtgaagaaacggataagcccggaaggttcactttgaaatcatcactgttttgcaaaacgagcatggcatcaaacagcggattgcgattgacttcccggtgtgtatcaagcttttgggcaagttcttcaaacgggaagtcctgatgttcggctgcgccgagggcaagcattttcacctcttctaaataagcgcggaatgtcttatcccctttcggcctgcttctcattgctacggtatttacaaacatgccgatgaccccatcaagctcagcgcggcttctgccggccgcaggtgaaccgacgataatgtcttcctgcccgctcaatttagaaaggaacaaggagtagcctgccaaaagaatcatatacagcgtcgaacccgtctcatccataagccggcgcaaattctccgccgtttctttttgaaggcgcgttcgtacaacggacccgctgaaatcaggaagctgcgggcgctttttatcgagcggcagatcaagaacgggaatgttttccccgatcgcatccagccaataccgctcatgtcttttgaattcttcagcggcgaaccgctcatgctgccagacggaaaaatctttgtactgaagttttaacggccgcagctcttttcctctgtacaaatccgtcaattcttgaatcagaacgctcattgacacaccgtctacgataagatgatgcatatcaagcagcagaaaatgacgttcttcagtggctttggctaaagtcactctcaaaagcggcgcttgttccacgtcaaacggcttgacgaaagtttccattgtcgcttgaagaagtgtcccggatggcatgtgaatctctgtgagatcgagatcgacatgtgaatgtatgtgctgcatcggctccccgtttcgcaaaacaaatgatgtgcgtaacgcttcatgcctttgtaacagcgctgaaaaggcttcgtgcagacgatcacggttgagtctgccgctcagctccagacaagcgggcatatgatagcccgtactgtccgccgcaagctgatgaagggcatagagccttttttgcgcaaaagatagcgggtacaagtcctttgcctccgcaggcatgatttctgcatattctcctcttttcctctgttctaggaagcgggccatgctctcgatagtcggatgttcaaaaacatggcggacggcaagttcaatttgcagccgtttatgtatctttgaaacaagcgacgcggctttcagcgactgtccgccgatttggaagaaatcatctctcatactgatgtgttcccgtttcagcacttcttgccaaatagacagcagctcagtctcaagcattgtgcgcggagcttgataatcaccggttctctcggcttctttcggctcaggaagtgcggcccggtcaagttttccgctcacagacagcggcatttccgtcaatttggtaaagcttcccgggatcatataagcaggtaatctcccggccaattcggcatgaggatcaaatgtcacaccgacgttttccagtacgacataagctgcaagctcctgttccccgtccgccgttttgcgcacggtgactgccgcctcttttaccccggacagacttctgagtgccgtttcgatttctcctaattcaattctgtaacctcttaccttcacctgatcgtcaaagcgtcccatgtattcaatcgttccgtccggtaaaaatcgggctgcatctcccgttctgtacaaccgttcacctttacgaaacggatgaggggtaaagactttgtccgtcagctctttttgctgaaaatatccgtccgccagaccttttccggaaatacacagttcaccgacggctccgaccggctgcagccgatctccgtgcatcatatagacagaagtgttggcaatcgggcgcccgatcgtaatccggctgcttttttgcaggttgcgcagaatcgtcgtggccacactgttttccgtcggtccgtattcattcagcagctcggcattcgggcatatgttgcggctcgcttccacgatatcaggggtggccgcttccccggcaaatgtcaccgcccgaagcgtctgcgcatcctttttcgtcagcgaatcaagcagaacgcgatacagagacggaacgatcagaagatggctcactccgtggcgggcgattttctgttttattgaaaggacgtctttcgcatcatcttcatcagttaacagtacacaggcgcccgacagaagcggagtgaaaagactcgttaatgacccgtcaaatacgtatgaaaaaagatgaagcgctatgtctccttctgtcatcccgtattcttcacgccgccattgcaatgtattgctgatcgctttgtgttgtacaagcacccctttcggccggcctgtcgttccggaagtgtaaatgacatacgcccaatttccgctgtcagacaccggcggaagcggtgcggtctgctgggaaaccgtttcctccatgatgacgacgctgcccttgaaatgcggcggaatgagggggagcaggtctttttcagtcaggagcagtgaggcttcactgtctctcagtaaaaatgaaatccgttcaggcggaaattccgcatcaatcggcatataggcgctgcccgacttccaaattccgagcagagcggcaaccgtactcattgatcggcgcagcataacagcggtgatctgatcggaacgggcgcctttttcccttaacgcatgggcaatctgattcgcccgctgatttaattttttgtagctccagcttactccgttatatctcaacgcctcttggtcaggcgttattgccgcctgttcttcaaacagcccatgaacggttgtctcagggtacggacggttcgtttcgttaaacgaatgaatcagggcttcttcctccggaggtacgagactgatgcttgataaaagcctgtccggatcttccgttacacaggagatgacctccagaatatgccctttgatccgtttcatgtcttcccgatcgtagatgcccgcattgtagctgaatttcacataaaactcttctcccggaacgatgacgacgttaagatcgtaattggtttcttccgccatcgaaaagttttcaagtgagagcgcactgctttccgtttgctgccagccgtttaccgcagcctgcatctgaaccggataattttcaaagaccaggatatggttcaagagatctttttgcagaccgctctcgttttggatgtcataaagcggataatagctgtgctcttccgcagcgagtgactctttttgcacctttttgagaagagaagaaaaagtcatatcaccagccgcgcgcacccttaccggcacggtattgataaacagtccggccatggattcaatgccgctgatagctgacggcctgccggaaacaactgaaccgaagacggcatcttcagtcccgttgtaacgatggagaagcagaccccaaatgcccgtaaatatagtattcagcgtgaccccgatgcctcgggcaatgtctgtcagtttttgcacggtttcaggctcaagggaaaattgaaaatgctcagatgcataacagtttttcgccggcttattcttcgtttgcggaacggaaacggtttctccgtaatcttccaagcagcgcgaccagaacgctgacgtctcttctttattccggcttcggagccatttgatataagtgctgtaaggagccggactgccgaggtttacagacctgttgtttcggatcgcataatacatgctgaagaaatctttcagtacaaggcccaagctccagccgtccatcataatgtgatgatgagtccaaacgcatgtatggcggttttctcccgtttgaaaaagagtcaagcgcattaaggggcctttttgcagatcaaaccccttatgccggtcgttttccttaaattcgtcaatgatgctttgctgccgttcttccgaatagtctgaaatgttctcagtctgtacggcagtgtcacggagtgaaaggacaacctgctgcggcccttcaaggtcaggcacttcttttatgaaaatcgttctgaaaatatcataacggctgacaagcatatccagacttttttggaatgtatcaatgcataaatccccgctgactgtaaacgaaatctgctcgacatatgcgtttgatccggaatccagaagcgaatgaaacagcatgccttcctgcatatatgataaagggtaaatatcttgaatttctgtcgcttgtgtcacgaatgccacacacctttttatgaaattaaagtccttttacgagatcttcaatgcttgatagtgcttgagcggtcaattctgtatggctgtaatccgttaatgttttttcccgctctttcttgccggaacaatgggcgatgatgtcctcgaggtgagtatggaaacgattcatgaagaactcgattgcccccggtgcaaatacatcggtataaacggcttttacctccagttgcccggccgccaccatcgcgttaatatccagatcaaactcgcggatgcgcccggatgctatatcatgctgcggcttgaacggtgacatcttcagcgtcccctcaagaccgtcaaacgcaccgagatagttaaagcttatttctgggtctttataaagaatgtttcgcgaatatctcagcagcccgtagccggttccgtgatgaggaacccgtctcatcatgtcttttaccgtctttatgcggtgcgcggttttttcgcctgagccgtccggcactctcatatccaaaagcaccgggtaaacagatgtaaaccagcctgccgttcttgacatatcaatgtcaggaatatgcccttggcgtccgtgtccttcagtgctgataagcatctgttcggaacccgtccactcatgaagcgccattccaagcgccgttaaaagcaattcatgaacatccgttccgtatgcctgctgtgtttccaacagcagctgcttcgtgacttcgctgcttaatatccacgatgcagtgtgcgcgttttcctgcaatcgtccggcgttttcatcagttattttcggcagcggcgctgttttaccagacatcacgctgtcccagtatgcggcttcctccagcaatgctttgctcttggaaatgtcaaaaagctcttcagcatactttatataagaatcgcttttcggcggcagttcgatttgtttgccgtccaatgcctgctgataagctgtctgcagatcttcaagcaatatcctccatgacacgccgtccgtgataaggtgatgaatcgtgataagcagatggtcggcttctttcagcctgaacactccgagatgaagaagagggccttgatcaaggcgcatagcctgctgtatttctttttcctcagcggctatccgtttttccggctgtgtttcttctgaaagatctatgacgttaagcgtaaagatttcttcatgctgctctgtgattccgcggttatattgaacaacttccccatgctcattttcagtgaaagtcattcgcagcgcatcatgatgttctgtcagcgcgcaaaccgcctgatacagcgcatctatttcgaggctgtctttactgcacagcatgactgattggttataatgaagctcaaacgcacccggctcctcaaaaaatctctgctggatcggtgtcagcggagcgcttccttctatcgggccctgatcagccgttgcaacagccggcgtgaggtgtttcgcgagttctgcaatcgtcgggaactgaaacaaatcgcggatcgacatgttccagccttctccggcgagtcgggctgacacttgaagcgccttaatggaatctcccccaagctcaaagaaagagtgatgaattcccgctttctgaatatgaagcacatcttcccaaatccggcataacatcgcctgtttttcatcgccgggcgcgacaaatgcctgtgatgaatgtatctcttctgccggcaatgccgatttatcaagtttgccgttcagtgtcaggggcatgctgtctaaaccgataatatgagacggcatcatataagccgggagctcctgcataagagactggcggagtgatgagatatcggcctctttaggaacgatgtatgccgctaaccgggcttgtccttcggcatctttcatcacggtaacagccgcttctttgacttgatcgtgtttcaaaagcacactttctatttctcccgtctcaattctgtatcccctgatcttcacctgcttatcaatccgcccttgaaaacgaagagttccatccggcagccagcaagcctgatctccggttctgtaaagcgtttctcccgtttgtaacgggtcactgaatgcgtcctctgtcagctcaggctgtccccaatatcctttggcgacgccggcgcccccgatatacagctctccgaaaacgccgatcggctggacctgtttgtctttgtttaagatgtacatttgcacattcggaagcggaacaccgatcggcacatcatcttcccgcggctcttcgctcattccggcttcataatacgaagagtcaattgtcgcttctgttacaccgtagctgttaatgatccgcatttctttcccaaagcgttcatgaagcgtataaaaatcttgcgacttgatcatatctgaaccaagtaccagtatttttacgctttgcagcgcgagtttccggcggtatatatattccataaacggaacaatcagcgcgggtgtcgactccataaacgtgatacggtgctgatcaatgagccgataaagctgctgcggctcaagccggacgtcatccggacaaatgacaagcgttcccccgtttagcagggcgcgtgcaagatcccctgaaaatacatcaaatgagaaactcgccatctgcagcactctgaccggtataagatcaagctcataaatcctgcgccatgcaagtgctgcatgcgtaaagctgcgatttctgacttcgactcccttcggcgttcccgttgttcccgaagtatatatgatatatgcggtatcatccggtgacgctgccggctgaatattctttgcagaaatatcgtattgatcttcataatcaagctgaatgagaaataaattgtgatccgtcagctgtgaagcaagttctttgtattctgactgcaccatcaagacggatgccgcgctgtcttttaataaatagcgaatccgttcctcaggataatgggagtcaaccggtatatacgcccctcccgatttcatgacggcaagaacactgacgatcgcttcaatcgaacggtttgctaatatggctgctctttttcccggaccgaatccatttttctgcagtgttcgggcaagacggtttgcccgctcattgagctgcaaatagctgatctgttgtgctccttcaataacagcggtctgatgaggcgtttcttctgctttctcttcaaacagctggtgaaacagtttgtgtttttccatgaattcggtttgtgtgttattaaactcaatcagtaacttttgtttttcttcttcatccaaaatgtcagctttcgatagtgtgacttccggttcggcggcaacatggcgcaagagattcagtaagtggcccatccagcgttcaatcgtttctttcataaaaagctcggtgctgaattccatctcaaagcggatgtttccgtcggattcagccgctgataaggtcaggtcaaaacttgatacatcatgttcggtatgctctgatcgtgacgccttcagaccggccagatttatctcctctcgctccatattctgaagaataaacatcgcgtcaaacagcggattgcggctcatgtcccgctgcacgccgagccgttccaccagctcttcaaacgggtagtcctgatgctcatacgcctcaagcgccgcctggcggacttccgccaaataatcggtaaaccgtttgtcccccttcggctccgttctgatggcgagcgtgttgacgaacatgccgagaatcggttcaaggtctttgtgcggacgcccggcaatcggcgagccgacaatgatgtcttcctgcccgctcaatctcgcgagtaacgtattgtacgcggcgagaagcaccatatacaaagtggagccgtgatcccgggcgatgcggtgaaggccgaatgccgtttcagcgtcaagcgtgcacgatacgctgccgcccgcaaagcttctgacagccggacggggcttgtcagccggaagctccagcaccggaagctctccttctagccgcttcagccaatacgcttcctgcttctgatacccttctttctcctgaaacgaccgctgccagacggcatagtctttatattgaaggcgcatcggcgcaagcgaacggcctgcgtacagctcgccgaattcttttatcaaggtgttgacggacacaccgtcagaaataatatgatgcatatccgttaataaaagatggcgttcgtccgattctttcacgagggccgcacggaagagcggcgcttcctccagacaaaacggccggacgaatgcgtcagctgactcggcctcatcgagctgaaacggtacactgtcatggatgcgctgcaccggttcgccgtcaggccccgtttcaaaggacgttctaagcgattcatgccgctccacaagctgccggaacgtctcctccagccggctgcggtcaagcgggcccgtcagttccagcacagccggcatattgtagccgacaccgccgtcttcaagctgctggagcacatacatccgtttctgcgccgaagacaccgggtaggtatcttgtgtttgcgcaggctgaatcgcttcatacgggctctcttccaagtcctgaataaccgaagcgagctcttccaccgtcggccgggcgaagatgtcctgtaacggcacctgaacaccgaactccttggcgatgcgggagacgagagccgtcgcttttaacgaatggccgccccgctcaaaaaagtgatcccggatgccgacgggtccgtttttcagcacctcttcccaaagggcgcaaagcttcatttccgtgacgttccgcggggcggtgtacgcctgtctgtctgccgatccgccgggagccggcagcgcgcggcggtcaagctttccgctcggcgtgaccggccattcgctcatctctataaactgagccggcatcatgtaggccggaaggcgtgttgcaagctccgcccgcacgtcatcgctttttcgtccttcaatataggcgtaaagtgcggtttcgccgtgttcggtccgggcggtgactgccgcctcacgaatgccgtcaattcgccggatcgccgcttcgatttctcccggttcaatccggtagccgcggactttcacttgtccgtctgaacgcccgagccattcaacaaggccgtcttctgtccagcgtgcgatatcgcccgtctgatacatgcgttctcccggataaaacggatcatcgagaaagcgctcctccgtcagctcagggcggttcagatagccccgggccacccctgtccccgcgatgtacagctctcctgccacgcccgcaggctggatggttcctccgctatctaatacatacagacgggcacccggaacgggttttccgatcggaagccttgtccgtccgctgtcccgttttcggtcacagacgtaaaacgccgcatcaaccgtcgcttccgtcggtccatagccgtgaatgagcacggtctccggcagaagatcggtaaaccgggcagccgtaagcggggaaagagcttcccctccggcaaacacgcgtgtcagtgttctgccgaggcgtgttcttgtttctgcaggctctgtttccagcgcgtctaaaaagctgttgaccatcgccggaataaaatgcgcggtcgtcaccttttctgaggcaaacacttcaatcatccgcacaggatctttctcccagccggcaggaagcagatacacggaggcgcctgacatcgtccaccaaaacaattgccagatggaggcatcgaatgaaaaggatgatttcagcacgataatgtcctcttccgttaacggaaactgcccttgcatccctgataaaaaggcggcggcctgacggtgttcaacagccactcccttcggtgttcccgtcgaacctgacgtataaatgatataagcgagcgaatcagcatccgcttcttcagagacagcccctgtctccgcctcacttgtcagagaagaaagagacgcttctagcgtttcaccggaaaaaccggaaacggataacccccgctgtgcaagcaggagacaagcgccgcagtcatcgagcatatagcgcagcctgtcctcaggatactccgggtcaagcggcacgtaggcgccgcccgcttttaacacggcaagcactgaaatcaccatctctggcgagcgttcagcgagcacaccgaccacgctttctttgcggacgcctttttggcggagccgaacagcgagtctgtctgtgtaccggtcaagctcggcgtacgtcagcataccgtcgggaaaacgaagcgccggacaatgcggcgaaagcgcggcgcggcgggtgaacagcccgtgaagcgtcggggccggcggttcagccgtttctgtacggttaaacgcagttaacacccgtttcttttctttttcatccgccatatcaatatgccgaatcagccggtttggatttctaacggcattttcaacgatcgtcagcaaatgagtttgaatccgtttaatcgatgtttcagtaaataaagcggattgataatcaaaattcagctcaatcaaccccgtatctgtccgctccttaattaaaatggacagctcatttgccgtatgcccgctgaaaaacatcgccgtttcataatcgaagccctccgcctgatgccacgcgagaggctggtattgcatcgaaatcccgatgatattttgcagatcgtgatgaacctgccttaattcattgacaaaaagattgtaaggatatttctggtgccgcataacagacagctgctcttttcctacgctgcggacaaaggacaggaactccgcatcaggatctgccgtcattctgatcggcagtgtgctgacgaacatgccgagcatatccttttcgagcctggagccccggtttccgtaataagtgccgatggcaatatcttttttagccgtcagacggctgatgcatatgtataacgaagccataaacagagagatgatgctgatattattttctttgcaaaaacgccggatagattgttctaaggagtgagaaagagtgattgtatctctggaagccgcagtgctttgtctaagatgagaggttcgttccgccagtgaaaggtgttccggaacggttcggtatgtttcagtccaaaatgaacggtccttttgaaaacgggaagactgtaagtattgctgttctttttccatgtagctgagataggaaggcctgtgatgttcagctaaatcctcgccccgcatgatcttttggtagatatcaatgagctggttgccgagcaggttgagcgagatgccgtccatgataatatggtgaaattttgaataaagccaaacttcttcgtctgacatgacaagcagagtaaattgatacagaggtgaatgaaacagcttgaacggaacacgggtctgcgtgtcaatccatgcgtcccgctctgagttatcagtatgagtaaaatcaacagtctctagagaaatcggccgatgcccggccagatacagctggggttctgatccgtccccttctgtcagttgaaacctgagcgaatcattttgcgagatagaaaaatctaaagcatggcgcagtacgtcaaaatcaatgtcccccctgaatttgacgcatgccgcgagattgcagatacttgtgcccggttcgagcagctcggtaaaccacactcttctttgtgcgtgagttaaagaataaacagtgttcttcaatggaatccctccgcttcaatttaagaggataagaaagtgaaataattacaattaaatttcgacagcatatgactaaatcatccatataagcattattttaaaacatattttagaaatcacaataaaaaattaaattttctctaacattttttagaatatagtatatattcctcacttcatttcttcatttctataatctttataccatgtaaaacggtatgtatgcacactgaaaactagttcttaaacactataataaggaataaaatgtataattaattgcgattttaaaaaggttttgcctcctgaaaagaagtttcatgttagaaaatgaaaaatcggtgaacaagtaagaaagtagtatgtaaaaaaaaggaagtatattacgatattactttttgaaaagattgattcgtaatcgcaatataatgttttacagacatcaaaaaaagccgaaccctctaaggatccggcccttcttattgatttgccagcacgactgcgattttgtcttcaatgtcttttccgtcatcttcgtcaagcagcccgttttgaagcacggaaaaaataagcgtatctcctgtttttgtgtctgcatagccggcaatcgaactgactgatgttagtgacccggttttcgctttaattttgccctctgccggagtattcttcagccggttccgaagagtgcctcccgtcattctgtcgcttgcaccggcgacagggagcgaacgaaggaaagccgggtaccacttttctttctgaaccgcatacaaaagctctccgatttggccggcggatacgccgttaatatgagaaacgccggatccgtctcttgcaatcaattcatccggattcagcccgaacgatttgagctccgatttcatcacgtccaagcccttttcccagctgccctccccttttttcacttttcccatttccttgatcagaatttcggcgtgcccgttgttgctcagtttcataaacgggatcaataattctgaaagaggcatggatgtccgtgatgtgacaagctgggtgcggtgcggcattcgccctgttctgattttcccttttacagttataccctgtttagtaagcgcttgtttccataaatctaaagcataggacgacgggtcccacactgccgcccattctcttgcctttgccgagccggcaggtatggttccctttatcgtaatcacattgccaccgtgctcccgttcaaccgtcaattctttcttttcatcagaagcgacggttttcacttcatttttcacacgaacgacgtccgtatggggagaaatcgaaatacgcggctttttaccgggctgtttcgccggggtgatttcagcaatcaccgttccggtatcataatcttcatttggggaagcagtaagagctgatacttgcgcgccataatattggccttcatcactccacggaagatcaactgaatacctggtatcgtcataccacgaatcatccccgaccagatctcctttaatgacatggatgcctctggctttgacctgtttagccatcttctcaaaatcagaagccattagggtcggatcgccttttcccctgagataaaggtttccgcgcagctgttttcctttcacggcgccgtctgcccgtacttctgtcttaaaggtgtaatcttctccgagaacggaaagcgccgcagatgccgtcagcagtttcatcaatgatgcaggcctcagccgcatatcttcccggctgccgaacagcacctcccctgtttttgctgaccggacactgacgcccgctgaagccccctttaaagcgggttcttcatccagaatgtgttccagctctttttgcaaagtatttttttgttcagccgccttagccgcatcatcaatataaggaacttcggcaatgatcaaaagcagaatcaccgcgcacaagcgtttcacatatgttttcaatgttatcccgcctctttcctattcttcgtcatgcaaaatggtgatcctggatgacgcagccgcttcttcgcccggtttcagaatctgaagccctgtcagtgatgcaggctgattcagattaaaagcatctgtaacggaagtataaggctcaagactgacaaacccctgctttccgtcgccgttatataccacccaatgcttgaaagacgtgtccgcttgatacaaaacggataatttctcattcggatgataaataacagcttcgttattgccgccattccgtccggaagaaagaaaaacatcgtcaaactgtttatttttcaaagacatcccgtgacggaacgcttctttatcaggcacatccaataaacggcctgtcggtacgaaacgttcatttaattcccacatgcggtcagccgtcaaaaatagacgggatcgctcttcattgaaaacaaatgtggaatgatagcctagcccccaaggaaaagcctccgttcccttattcataatcagcgcccgctgcgtaaacacattgtcttttaatgtataggtcatccggacaatgacatcgtgcggaaattgtttatgaacacggggaatctttgaaagatcaatttctgtttcgactgtcattccatcgccctcttctttcgctgccgccgctttccaatgctgattgtgaagaaagccgtgaatatgattatgtttatcctcttcgtttatctcgaattgatacgcgcgcccgtcaaaacgaaacgtcccgtccgtaatccggttcggcgggaataaaacgggaatgccgtacagcatcggttttttgaggaattcctccgcagtttccggttctctcagaagccgcataccggttcttttatcccgaagcgatatgacatttgatccccactccggcacaatgatgcattcagcctgatcagtctccgcctttatggctgaaactcctaaataagtcgtatgttcaatcgtcataagcacctgccctttccttgttttctagcatgtataggaattccattttctaaactcattttccttctctaaaaaaaacatcgcccgtatgaattgagcgatgtgcggtaaaaccttattgaatcagccgggtaatctgttttttcttccatacaaaccggtaatatccgtattgcagcagcaggctgacgacaaaagccgccggataaccgacccaaatgccgagaatgccgagattcgtataatgagaaagaataaaggccacaggcacttcaattccccaaatcgcaaaaatgctgataatcgtcggccataacaccgtaccgctcgcccgcattgttgctgaaacaatctgagcgtgaccgaaaatcaaatagctccaaagggtaatcataatcagattgcgggcaatgcggagtgtatcctgatctgttaaaaacaaagccagtatctgccgggagaaggtgtaaatcagcacaatcaaaaccccgccgatcaaataattcaggccgatcccgactttgatgacctgcttcagccggccgaattgattagctcctatggattgggcggcaaaaattgaaacggcgataccgaggcttaccgccggcatctgcacataactcgccacttggttgacaaccccgtaagcagccgtcgcgtttgatccgtaatgattgacaaatgaaatgaccgcaatttcagaaagtgacacgagaatcatattgatgctcgacggaatcccgagacggagtaaaagcgcgagcagctttttgtccattttaagagaacggagcgcagtccggtcaaatgccaatggatgtttccttttccgcaaataaaccatgagtacgataaatgtcacgatgtttgaaatcacggttgcatacgccgaaccgtaaatgccgaacttcggaagtccgaaaagcccgagaatcaataagggcaagagcccgatgtttatgactgtactgacgattaacgtataaaacggagtctttgaatctcccgttccgcgtaaaaatgtcgtatacgcaaaatataaaaacatcagcggcattgcgcaaaacaaaatgcgcgcatatcggacactgacatctattacgttttccggcgttcccatcagccgcagaatatcaagcgtaaacacactgccgacaactgccagaacaacaccgagcataaaggtaaaagtcagtgtagtgccgacaatcgccttcatcctctcttcgtttttcgcgccgtaagcctgcccgatcagaatggaacttcccgaaccgattccgatcgtaaaggagatcagcagaaaaaacagcggaaaaaaagacgatacggcggcaagcgcatcaactccgagccaccttccgacaaataccattccgaccaattggccgacagattgcaatacattgcttaaaagcagcggcactaaaaacagtgacatcgatcgccagacagactggccgcggccttccgctgtttctaaatgatcttgtacttccatatgtaggactccttttttgattttcttccattttattattcagcagacagcttgtaaaaaccttttgttcaatgaaactctttatctttttctcacgtcttacatggaaataaaccataaaaataaaaagtccggaaaatatttctgaaaaggtattgtaatcttaccgtaattattgtaacatttgtaacataagagaaagagattgattgaaggagagattatatcatgaaaaaatggctattattcctcactactattacattgattctgtcattgggcactgcggcgaccgccaaaaatgcatctaatgaccttacacaaaaacaagcacttcaactggccctgtcagcgagagaacatttctggaacacgatgagcggcggtgcgcttaaatcaaacgcaaactgcacatctgaaccgtttgaatatcaaaatcttcaatacgtctttatgtgcaaagacctcggaacaaaagcgaaagccgtaaaatatctgacacccgcttttacaaagcaagcgattgacaaagggctcaaagattaccacttcactgtaaaagacggcaaattggctgttccggtcggcgacggagataacctcctgaattggaaaaaagcaaaaatgactcttctttctaaaaaaggaagcgttcaagcataccgcttcactgtaccgactcttgacggttctccgtcagcaaaacgcgatgtaacattcgtaaaagaaaacaacgtttggaaagtcaatcaatttgatgctgtcatataagaaaaagcccgcttgcttacagcgggcttttttcacatcatttccaccaggttcttgcaaaatattaaactcaaaaaccccttgtataacaaggggttttctgttttgccgacattattaatatgcgcctatcttatacaaaaaacgctctaggagagattcgaactcccgacctgcagtttaggaaactgctgcactatccgctgtgctactagagcctgcttctattatagtaacgctggcggccgtttttttcaagcctacagccctccgaacactttataggcggctctcgtcgtatcttcatctattccgatataacgcattgtaatagacggagaagaatgattcaaaatcctctgcagttcagcaatgtcttttgtcctctgataaaaatgatacccgaacgtctttctaagcgtatgcgtcccgatttcctccaatccgcaagcggctgccgcttcctttaatattctgtatgcctgaatccgggaaataggcttattcgtccgtttcgatttaaacaaatagtcatcctctttcatgtcttttgtataagcgtatatgtcggcctttaaagactccagtatcagaatttttcttttctttctcgttttgctttcggttgcccacacatggtctttgttccttacatccctcacgcgaagcggcagaacatcagaaatccgcagtgcgctgttcatgccgaaaataaataaaaaataatcacgatcacttttcttcattaaatactgtttgacttcctggatcttctccaaacttcggatcggctgtacgatatgcatcaaaaaactccttataattggtaaagtaacatattgagcattatgttactattatagccgaaacctgttgaatgataaaggatgaagggccttatgtaacataatatacatagtgttacataaggggaataaggcacgcagtttcatcgaagtcttcaaaaacatcattttcgacccgatgacgggattttaaatcaatagagactcacggtattaaaaaagaaaaacaatgcccttaaaacaaaatctgagcattcgtttttttgtgagcaaccgaaaaaaaatgaaaaaaaagacacaatatgaaattgtgtcctagtcttcatcttttacatcaatgtcttcaggaagcggctcatttaaaaactcttgaatcatttccttatatttttccagctgttcgagatgggtttgaaattgttccttgttgattaaatattgctgtccgtcatgtacggcccttattttattcgtcaaaacaagattgtgcacatattcttcaggaagactggtaaactcagctgtctctttgatcgttaaatacatggctcacgttcctttcatatgtcatgtgagtgaattctgttttgtttattgtagcttattttttgtctttatgcttgttttacagctttttcagtccggtttcccatttagcctatttgagactgattacattcacacagaaaccccaactttttgcacaccggactattccgtttgtcacttgtgaaaacagcacattttacttactctataattgtaagcggaaaacaaaggaggcagactatgaaaaagaaaaagtttatgaatctctgttttatcgttctgctcagtactttgctcgcggccggaagcatcccttatcacgctcaggctaagaaacacccgttttcctatgacgactacaaacaggtagatgtcggcaaagacggcatggttgccaccgcccatcctctcgcttcacaaatcggtgccgacgtgctgaaaaaaggcggcaatgcagttgacgccgcggttgccattcaattcgcattaaacgtaactgaacctatgatgtcgggaatcggcggcggcggatttatgatggtttatgatgcgaagacgaaagacaccaccattatcgacagccgggaacgcgcaccggcaggcgcaacaccggatatgttccttgacgagaacggcaaagccatccctttctccgaacgcgttactaaagggactgcagtcggtgttccgggaacattaaaaggacttgaaaaagcgctcgacaaatggggcacacgctccatgaaacaactcatcaccccttccattaaacttgcctcaaaaggctttccgatcgattcggttttagctgatgccatctcagattataaagacaaattatcacacaccgctgcaaaagacgtgtttcttccggacggagaacctctgaaagaaggagacacactcatccaaaaagacttagccaaaacatttacagctattaagtacaaaggcacaaaagcattctatgacggtgcattctccaaaaagcttgcggaaacagtgcaggaattcggcggctcaatgacagaaaaagatattaaaaacttcaatgtgacgattgacgaaccgatctggggagattaccagggctatcatatcgcaactgctcctcctccaagctcgggcggtgttttcctgttgcaaatgctgaacctcctggatgattttaagctttctcaatatgatatccgttcttggcaaaaatatcagcttctcgcagaaacgatgcatttggcttatgctgaccgcgccgcatttgccggggatccagaattcgtcaacgtccctctcaaaggcctcttgaatccagattatatcaatgcccgcagacagctgatagatattgataaagtcaataaaaaaccgaaagccggcgacccttgggcctatcaggaaggttctgcaaactataaacaagtgaagcagccgactgacaaacaagaaggccaaacgactcacttcacggtaaccgaccgcttcggcaatgtcgtatcttatacgacaacgattgaacagctgttcggttccggcattatggttcccggatacggcgttgtgttgaataatgagttaacagacttcgatgcggtgcctggcggcgcaaatgaagtgcagccgaataaacgtccgctcagcagcatgactccgactattttattcaaaaataacgaacctgtcctgactgtcggctctcccggcggagcaacgattatttcttccgtcctgcaaacgatcctgaacaaagttgagtacggcatggatctgaaagcggcggtcgaagagccgagaatttacacaaacagcatgacatcctatcgatatgaaaaaggagtgccggaagaagcccgcacaaaactgaacgaaatggggcataaattcggcagcagccctgttgatatcggtaatgtgcaaagcatcctgatcgaccgtgaaaacggcaccttcaccggagttgccgactcaagccgaaacggagccgcaatcggcgtaaacttgaaacaatataaaaaataactagacaaaaagcctcgtttctcaagctgagaaatgaggcttttgtttattctgcactgtattcagatgaggatttttcagatgttaacgaggcaagtaaaagcacgccgcacatcgcgatgacaacacccgctgatccgatccatgtcactgacgcaagagacagatgagtgacaacaatgcccccgatgcccgccccggccgccatagccagctgcatcacggactggttgaggccaagtaatacacccgatgattcaggctccatcgttgccaaatgatactgctgagcaggtcctgatgaccaggcggcgaaggaccaaaaaataagcactgccgccgctccgaaagcagaatgtgtgacaaacggcaataacatgagcatgatagcatgaagcgccattccgccggttaatgtcatacgcgccccccatttgtctgcactgaaaccgcctgctttagaaccggcaagacttgcaacaccgaaaataagcagcaatgtactcagtattccgctgccgatatgagtgacgttcagtaaatacggagaaaggtacgtatacgcaaccgaatagcctccgagccaaaaaaacgtaatagccagcccgacagccacctttcgtttcttcaaaagagaaaattgctgaatgagcggcaccggtttatctccttttatctcaggcaacgcgaaacgtataataagcatagcaatgattccgattgccgcaattccggcgaaaaccaccttccagccgaaagcttcagacacggttcttccgatcggaacaccgataatgagcgccgccgtaaaccccataatgacggttgcgagagaacttgcctgttttcccgggggagcgatttttgctgcgatcgtaagcgcggtgaccaccacagttcctgctccaagcgccatgatcacccgggctgccgcaaataagccgtatccctgtacgagaaatgaaatgatatttccgattacaaacaatccaagagcatagatcataagcttccttctatccagttttgctgtaagggccatcatgacaggcgttccgattgcataaacaagtgaaaaaatcgtaatcagctgcccagctgctgccacagtaactcccaaggaacctgcaattttatcaagcatgccggatatcacatattcagacgtccccactaaaaagctgataattgccaaaatgtaaatcttccaggtattttgcacctgacacactccttcattgatgatttatataaagatatattgtgatatatcgatataaagagttgaacaaacagaaacaaatcgcaatatgtcgatgtgtaatcggaaaaagaaactgaatccctcttctaaaggattcagccctacatttcgcgctgaaaataatcggccatcgcctttatcgcatcttcatctcttttataataggtgtatttgccaatccgttttgtttggataaggcctgcccgctgaaggatggaaagatattgagacgccgttgactgtgtcatctgaagcttatcggtgatctggctgacacatactccgatctcattcatatcaatgccatcatgcggtgcgaagtgacggtccggctctttcagccactgtaaaatctcaagccgtgactcattagacaacgctttaaaaacatcaataggtttcatacgctttattatatcgtgattttacgatatgtcaatgttatatttcttgaatctctattttttgttttgtctctcttatgatccgggaaataaaatcactcacattctcttcaaatgtgttttcccgcccgtattgccttacatgtacagaatggtggcggcactcttgatctcccacaaccgcaatatacggtatttttttcatttgtgcttctctgattttatagccgagtttttcatcacgctgatcgagctcagcccggatacccgctttcttcatttgcaggtgcacctgttctgcgcagtcccggtgtgcggtgtttgagactgggatgatttttgcctgtaccggtgcaagccataaagggaacgctcctgcgaaatgttctgtaatgattccgagaaatctgtcgagagaaccgaatactgcccggtgaatgacaacaggacggactttttggtttttttcatcgatatatgttaaatcaaatttctccggcatttgaaaatccagctggacagtggcgcattgatggctccggttcagcgcatcttttatatgaatatcaattttcggtccgtaaaatgcgccatctccccgattaaaccgaaaacggtatccctgttcttttaatactttttctaatgcgctctcagccctgtcccacaagctttcgcttcccatgtaatcttcaggccttgttgacagctcaatatcataggaaaaaccaaatgcggtgtacacctcgtgaatcagctgcagcgccgaagcaatttcactctcgatttgatcctgcgttacaaaaatgtgtgcgtcatcctggcaaaaagatctgacgcggagcaggccattaagcgccccgctgaattcgtgacggtgcacctgaccgaactcagccatccgaatcggaagatcacgataagaacgaagcttttctttaaatatgagcatgtggccgggacagttcatcggctttaacgcgaagcgctgatgatcggcttctgagaaatacatattctctttataatgatcccagtggccggattgctcccaaagacgctggttcatcatcataggggtgcgcacttcctgataatgataggcatcctgctttgaacgcagaaatgattcaagcgtgtttcggataaactgaccgttcggcagataaaaaggcatacccggcgcctcttcagaaaacataaaaagttgtaattccgctcccaatttccgatgatttctcatctccgcctctttcaacagctgaaaatgtctgttcagctccttttctgaggaaaatgctttcccatagatgcgctggagcattttttgattgctgtcgccgcgccaataagcccccgatacatgagtgagcgaaaaagcttttatctgcccggcagacgccaagtgcggacccctgcataaatcaatgaattcgctctggcggtatatactgattgtatcagtctgcggaatacctgctaagagctcaagcttcagcggttcatgagcaaacagctgctctgcctcttctctggagatttcttctctgataatttccggattttccgaaatgattcggttcatctctttttcaatgacggccaattctttttctgtaatcgtttcatccatatcaaaatcataataaaagccattgtcaataaccggtccgatccctaaacaaaccttcggatacagacgttttaccgcttgcgccaatacgtgtgctgctgtgtgtctcatcacttccagtcctgcttcagactgaaaactgcacagttcaatcgccgcatccttatgaatgcttcttctaaggtcatataacgatccgtttatctttccggcggcagacgcctttttcagactcggactgattgattgggcgatctcttctaacgtaacgcctttccggtattttttttgttccccgtcaggaaaagtaatcacaatgtgtggcttcttcacggtctaatctctcctttatttttaataaaataaaaaaacacactcatcccaaagcaagggacgagtgtgtgtcagacccgcggttccacccaaattcccgccactttaagtgacggctcatttttgccgtaacgcggctatacggtatcggcttgctctcgttcaccgatacagctcaaaaagcggtaagctcattcttcgtgccgggaaggtctcagccgcgccccccctctctgtatggccggttaaaatgtctcatgtccttatcattgctatttttcttatataaatataaaaacacactcatcccaaagcaagggacgagtgtgtgtcagacccgcggttccacccaaattcccgtcactttaagtgacggctcatttttgccgtaacgcggctatacggtatcggctgctctcgttcaccgatacagctcaaaaggcggtaagctcattcttcgtgccgggaaggtctcagccgcgccccccctctctgtatggccggttaaaatgtctcatgtccttatcattgcagattcctttatacgaaaaactttcttttattatacataaatttcccgaaaaagaaagttttttaagaaaaaccggaacgaaaaaaattggcgtacacagctgttctgttttctcattttccgttcgataatgtttttaatccattcagcagtgcttcaaacgccgatgtcaaaaataaatcactccggtagatgaatgatatattcatattccgaaaatgttcaggaagctcatgaagaaaaagatttttcctgttttgaaaataacggacggctgatgcaggcagaaaggagacccccatccccgcctgcaccgccccaataatggcttccaacgtaccgaattcaatgattttatgtgcgggcactgcctcttctttcagtatgttttttattttgcggcggtgcgaacagcccgcggcaaaatacagaatcggctctcgcagcaagtcttgcaaactgccttcccgcttatttgaaaccaagaccaattcttcttgaaatacagcgtcttgctcaagatcttcatattcgaccggtccgtaaacaaaagcgccgtccagctcatagtgtagaacgcgctgcactaaggtatgtgtatcaccggttgacagcgacagctgtactttcgggtagcggctgcaatactccgtgaaaaattgagggagatggacggctgccgccgtttcaagagaaccgattcgaagcgggccgttcggatcgcctgcctcttgcgccgttttttgcgcctcatgcagcaattgaaggattctgtctgcgtcttttaataagttttcacctgctggcgtcagcgtcattccccgatttgtgcggtaaaaaagctgtgtttgcaattgccgttccagctgctgaatccggtttgtcacatttgattgaacataatgcaggctttctgccgcctttgaaatacttcctttgcgggcgacagcctgaaaaatctttaagtctccgctttccatgtaagggcaccttcttgctatgatttttattgatagccggctatcaattttcatttatttactgcagctgatacagcctgtaaaatttttctcatcaatcataaaggagagaagaatcatgaatgcccttatcatacacgaaaatggctttgatttcaggcaggcacctgacaaaaggccgggaaacggcgaagtaaaaataaagctgaaaacagccggattaaaccatcgtgatttgtttttaatgaaaaaacacgaaaccggaaaccatgaatttattctcggttcagacggcgcgggaatcgtaaccgaaataggacacggcgtccggtctcatttactgaatgcagaagtcatcatcaacccggtgctgaattggaagactgttgaggacgtaccagccgtccctgatattttaggcggtccgagcgacggaacattttcaccttatgtcatcgttcctgcggaaaatgccgttttaaaacccgaacacctgacttgggaggaagcgggcgtcctgccgttatcagcattaaccgcttatcgcgccttatttacaaaaggacaattaaaaaaaggcgaacaccttatccttccgggcatcggaagcggcgtggcaacatatgccttattaatggcaaaagctatcggagcgacagtcagcgtcacctcccgcagtgaaaacaaaaaacaaaccgcactgtcatacggtgcagaccgggcgattgacagctacggtgactggaatgaggcgctgaatggcgaaaaagcagatatcatacttgacggtgtaggccccgccttatttcaacactatcttgacattattaaaccgaatggccggatcgtaacattcggcgccagttcaggcgatcagctcggatttcccattcgctcgctgttttttccgcagattcatattctcggtacatcaatgggaagcaatgaggaattcgcggatatgctggaattgataaaccgctgcggcatccgtcccattatcgaccgcatataccctctcagtgaagcagctgccgcttttaacaggatgcaggaaggacggcagttcggcaatattggctttcgtgtagatgtctaaaaaaaggagcggacccgtccgtttccttatttgtttaatagcgtttccgcttgaaattcaaaatgttgttcttcatcgattaaaatctgcccgcaaatcgactgcagacacacagagcccgtcacgttttttaaggcgtcataataaacggcggcgatgacttccgccgtcagcagcaccgtgatcgacagctcaaggcttgcaaatcgtctcagtctccggaagaaaacaatctctccgctctgtaaaacaaaattccatatttatcttccatttccatatttcctttatatgaccaatacaagaagaaggaggttccatttcaatacgaaaaaccggctgttcccagccggttttataaataaacccctttatttacggtaaaacagtgctccccattaaataactgtcgacttcgcgcgctgcttcccggccttcattaatcgcccatacaatcaggctttggccccttctcgcatcccctgcggcgaaaacaccgtcaacattcgttttataatccccatatgccgcctgaattttatgatttgccgaatcgacaccgaactgtttcaataatggctgttctgttccttcaaaaccgatggcgatgaacaccagctgagcaggccagactttttctgtaccgggcagttcatgaaattcatactttccgaattcgtttctgactttttccatttggatggtgtggatctcttgtaagcggccctgcttatcggccaccatttttgtcgtctgaattgaatattctctcgggtctttgccgaactttgcctgcgcttcttcataggcgtattcaagggtaaagacgtgcggctgttcaggccacatattgtcgttcgtgcgcgtctgaggaagtttaggatgtttcccgaactggtgcacgctgcgcgctttttggcgcagcgcggttgccacgcagtcagctcctgtgtctcctccgccgatcacgatgacatctttccctttagcgtctataaattgtttgtctttgaagttggaatctaaatagcttttcgtcgccagtgttaaatagtccatcgcataatggacgccttttgcttcccggccttcaatcagcagattgcgctgcttttgggcgcctgtgcacaaaatgacggcatcaaattgttctttcagctcatctgccgttatgtcaacgccgatttcggtatttgtcacaaaatctataccttcctgcgtcaaaagcttaatacggcgttcgacgacatttttctcaagcttcatgctcggaatgccgtacatcagcaggccgccggctctgtcggcacgctcatagaccgttacggaatgaccggcttgattcagctgatcagcgcttgccagacctgccgggcctgaaccgacgacagcgacttttttacctgtgcgtttcacgggaattctcggctgaatccatccattttcaaaacctttgtcaatgatcgtccgctcgatgtttttaattgaaacagccggatctgaaatggccagcgtacaagatccttcacaaggagcgggacagacccgccctgtgaattcaggaaagttattcgttttcagaaggcgctccaaggcttctttccagcgcccccgatagacgaggtcattccactccggtatcagattataaatcgggcatccggaggtaaaaccgttgatatcagcgccgatttggcaaaacggtgtgccgcaatccatacaccgcgccccctgccgctttgacgcttcatctgaaaatggagccgaatactctttccaatcctttaagcgagtgagagggtcccgctcagccggtttttctcgtttttcttccatgaatccagttggtttccccatgttcctctcccctttcttactgtactaccgcttgtttttgatctttggcaggcgtttggaggacctttgtattggcttcaaaagcatacataattgcgtcttcttctgataaacccgccgctttttgttcttcgatgctgaggagcatttgtttatagtttttcggaatgattttgataaaggtttctgcggctttttcccaattgtccaggagatctgcggcttttttgctgtttgtcagcgccgcatgccgtttgaccatttcttgcacttctttgatctccgcctcatccgtcagcttttcaaatgaaatcatttccatgttgcatttgcgtttaaatgctttggcatcttcactcaggacgtatgcgataccgcctgacattcccgccccgaagtttttgccgacttcgccgagaacgacaacccggccgcctgtcatgtattcacagccgtggtctccgataccttctacaacgacattgactccgctgttacggactgcaaaacgttcaccggcgcgcccgttaatgtacgcttccccgcttgttgctccgtaaaatgcgacgttcccgataataacgttatcgtgtgtttcacaattgaaggcatcaggcgctttcacgatgatttttccgcctgaaagccctttgcctacgtagtcatttgaatccccgttcaaatgaagcgtcatccctttagggacaaatgctccgaaactctgtccggctgatccggtaaaatgaagtctgatcgtatcatccggcaggccttccgctccgtagcgtttagaaatttcacttcccgtcacggttccggctacgcgatttgtattattgatcttgatttcagcttccgcttcctgaccggcttcaattgcagcctgcaccgccggaagaataaccgtcatatcaagcgactcgtcgattttatggttttgcgccgtacggaaagtgcgtacgccttcaggctggtacagcagtgtggataaatcaagctgtcccgctttccaatgcgctttcgcacgttcactgacatgaagaacgtctgtccgtccgatcatttcatcaagcgtcttaaagcctaactgcgccatatattcacgcacttcttctgcgacaaacagcatgtaatttacgatatggtcaggatcgcccatgaattttttgcggagctccggattttgcgtcgcgacacctacaggacatgtatctaaatggcaggcgcgcatcatgacgcagccgagaacgacaagcggcgctgtagcaaagccgaattcctccgcaccgagcaaggcggccatcacgacatctcggcctgtcatcagcttaccgtccgtttccaatactacgcgatcccgtaagccgttcagcatcagcgtttggtgagcttctgcaagaccaagctcccacggaagacccgtatgtttaatactcgttttcggcgatgcgcccgttccgccatcgtagccgctgatgacgatgacatccgcagtgccttttgccacaccggccgcaatcgtgccgacaccggcttttgacacgagcttgacgctgattcgcgcgcttcgatttgcattttttaaatcatggatcagctgcgccaaatcttcaattgaataaatatcatggtgaggaggcggtgagatcagccctacacctggtgtagaaccgcggacatccgcgacccaaggatatactttgttccccggaagctgaccgccttctcccggcttcgccccttgcgccattttgatctgcaattcatccgcattgacgagataatggctctttacgccgaaacggccggaagcgatctgtttaatcgcacttcttctgtcgtcgccattttcatccggaacgaaacgtttcgggtcctcgccgccttctccgctgttgctttttccgccaagcctgttcatcgctatcgctaaagcctcatgggcttccttgcttaatgaaccgaatgacatcgctcctgttttaaaacgtttcacgatggacgcagctgattcaacttcctctaattttaaaggcttgcggtcttctttgaaggcgaacagattgcgtaaaaatccgattcgttcttcatccgctgcttgagaatactgcttaaacaggctgtaatcattttttcggcaggcccattgcagcgtatggatggttttcgggttgaaagcgtggtgctctcccccgttccgccattggaattcacttcccggatcaagagtttggctgtaatcatccttgtacgccgcttggtggcgctgtttcgcttcttgcgcaatcgtctcaatatcgattccgccaagctgagatgcagtaccggtaaagtatttggcgataacgtcttcaccgatgccgaccgcttcaaaaatttgggcgcccctgtaactttgcacagttgaaatccccatttttgacatcactttcacgacgccttctgttacgctctttccgtatttgctgacagcttcttcatacggaatatcaagccggccttcatcgatttcctgcttatacgtagcataagtcaaatacggattgacagcatcggcaccatacccgatgagagccgcaaagtgatgaacttcacgcgcttccccggattcaacgataatgcttgcttttgttcgcaggccttgacggatcaaatgctgatgcagcgcactgacggccaaaagcggcggaatcggcgtcaattccctactcattgccctgtcagataaaattaacagagatacgccttccttgatcgctttttccgcttgctgaaacaaatccttcaggcctttttccaggtcatcggaaaacagcgtgcggatgttctggctcttaatgtcagggtgcacaagtgttttcagcgcataaaactgttcgtttgataatacaggagtatacaattttatgcggcgtgcatttctttcactcggatgcagcagatcgccttcagctccaagccatgtcaccgtagaggtcacaagctgctcgcggatcgcgtcaatcggcgggtttgtgacttgcgcaaacagctgtttaaagtaatgaaacagtgattgggcgcgatcggataaaacggcgagcggcgaatcatttcccatagagccgagcgggtccttgccttctttaataacaggaattaaatacttctgaatatcttcatacgtatagccgaacgctttttgacggacgagaagatcatcgaattgttcctcttcccggatttccgggtcaggattcacttgaaccaattcttcttcaagccatttttgatacgggaattcattggcgatttctgtttttacttcttcatctgaaataatccggccttcctctaagtcaatgagcagcatttttccgggctccagacgttttttatgaagaatgttctcctgctccacttcaataacgccgacctcagatgagaaaataatatggtcatcttttgtcacatagtaacgtgccggacgcaggccgttacggtcaaggatggcgccgatctgttttccgtccgtaaacgaaatggcggtcggcccgtcccacggctccattaaagagctgtgatattcataaaaagcccgtttcgctttagacatgtgagtgttttctgtccatggttccggaatcagcatcattgccgtatgtgccggtttccgccccgccatcacgaaaaattcaaacgcattatcaagaatagatgagtcactgccctcagcatttaaaatcggcagcactttgtgaagatcgtctccgaagctttctgaaacgaactgctgctccctcgctctcatccaattgatgttgccccgaagcgtattgatttctccgttatgaatcagatagcggttcggatgggcacgttcccaagtaggaaaggtatttgtgctgaatcttgaatgcacgagtgaaaatgcagatacgaaggtttcatcctgcaaatccaaataaaaagcgtcaacctgctcaggcgttaacaaccctttataaacaatagtctggcttgacaagcttgcgaagtaaaaatcaagctgttcttgaacgccccaattttccgcctgcttccggatgacatacagtttgcgttcaaaagcaaggctgtctttcaaatcgtttgcggctccgataaatacttgacgcacatacgggcaagtgctttgtgccactgttccgatttttccgacatttacagggacggttctccagccgagaacaatctgtccttcctgctcaatgaatgcattcacctgtttttcgatcttttttctttcctcttcattttgcgagaaaaagaccattcctaccccgtaacggcctttttccggcagcttcatttctccgcactctttcttaaaaaaagcatcagggatctgaaccatcaggccggcgccgtcacccgtattcggatcactgccctgtcctcctctgtgatccagctggcaaagcatcttcagtccttttttgacaatgtcatgtgaaggtttcccttttaaatgggcatacaagccgattccgcatgcatcgtgctcaaattccggacggtagagaccttgtgctttcggcatttgattgtaagtcataattcctctcccccgatcagtttccgttaattatcggtcataaaatctgacaactttaaattaattgtaagttttcaaaacaatataaacaatatataatttagatcaaatacatctcaaaatgagatagatgggtgtgaacgcaatggaattacgccagcttcggtattttatggaggtagcagaacgggaacatgtgtcagaagcggctgatcatctgcatgtcgcacaatccgccatcagccggcagattgcaaatcttgaagaagagctgaaagtcactttatttgaacgggaaggcagaaatattaaattaacgccgatcggcaaacaatttttagaacatgttaaaaccgcgatgaaagcaattgattatgcgaaggaacaaattgatgaatatcttgatccgaatcgcggaaccgtcaaaataggatttccgacgagccttgcaagccagcttttgccgactgtgatttcggcatttaaagaggaatacccgaacgttgagtttttgctccgccagggttcttataagtttttaatcgaagcggtaagaaacagggatatagatgctgcgctgctcggccccgttcccacggaattccccgacataacaggcaatatcttattcacggaaaagatttacgcgcttgttccgctgcatcatccgcttgccaaacagaaaaatattcatttaattgatctgcgcggcgaccaattcgttttatttcccgaagggtttattctccgaaacatggcgattgacgcttgcagacaggccggctttgcgccgcttgtatcgacggaaggcgaggatttagatgccattaaaggattagtctccgcggggatgggagttactttattacctgaaagcacctttgcagaaaccacaccccggttcacggtcaaaattccgattgaatttcctcaagtgaagcgcaccgtaggcattattaaaccagaaggaagagaactggctccgtctgcaaatgatttctatcattttgtcattcaatttttctccaaacttgaacaatatcaataaaaaacaaacccgagcttcaaaacgaagcctcgggctttttcatatttttatagatctttctcagccgatcggaatggatagttcaacgtggcagacaaacgcttccggatcaatgactgattgatcggtctgtttgtgcggcgtttctttaaatgtcttcagctgggctgaggaatagttgacgatgccgagtccgagctcttctccctgctgatcaagcagcctgacaaccgctccgctgctgaatctgcccttaatctgttcgatatcctgcggtgacagtgccatatttccgttcgcgacatcgttgctgcttttcttttccatcacaatttcgccttcggggccggaattaaatgcaagccattgttctttgtggtttaacggcagggttccttccgcttcaaaataagttccttcagccgcctcatctaccgcttgaagcagaatgtccgggatgttagcctgcccgagaaagcctttaataccggaggccatcacaattttaaaagcatccagtttcgaacgcattccgccggttcccatttcactcccggcatctcccgcgcttgcttctatttccggagtgatgtcgcttacatgtctgattcttttcgctttcgggttgctgcgcggattatcatcatataaaccgtcaatgtctgataaaattacaagcatgtcggcatcaattaaacctgccaccttcgctgcgagtgtatcgttatctccgaatttcagccggttgactgtgaccgtgtcattttcattaataatcggaataatgcctcgttccaaaaggacgttcatcgtattgcgcacattatggtagcggtattcatcggaaaagtcgcttcttgtaattaatatttgtgatgcgacataaccgtgcgctaaaaacagctttgaataagcctccattaataatccctgcccgatggaagcagaagcctgtttttcagggaggccttctggtttctgaataaatccgagcttccgataacctgccgccactgcgccggaagatattaaaatcacttcatagccgctgtctttcagctgtgcgatttgatccaccaatgcttccagctttcttctgctgatttccccgtgcaggctcgtcagtgagctgcttccgattttcaccgcgactcttttgatcttcgtccgagacgtcactgtatcactcctgttttttaacgattatagtgctgccgttttttcaattgttttgctgatctcaatagaacgttcggtcgcatgtttaatggctttggcaatggcttctccgccgccttctgacctgagcgcatcgaggccggcttccgtcgtgccgtttggagaggtgatgttttcccgaagcacatccggtttttcacccgtttccatcagcattttagcagcgcccaataacgtttgcgcgccgattttgcgggacagccgtttgtctaagccggcttcttcacctgctttttcaataaactccattaaataatagaagtacgccggtccgctgcctgcgatgccggtgaaaatgtccatctgatcttccttgatcacgtacacttccccgaggcattccaaaagggataccgcggtttttgctgaaccgtaagagacatggtctccgaaagccgcagctgttgccgattcgccgatcatgctggatgtgttcggcatcactcttacaactggctgacggtcatgtaatgattgttgtataaatgaggttgttatgcctgccagaacagacaggatgatttgatgaggttgaatacgccgtttcagcgtagcaagagcgatttcagcatccttcggtttcatggctaaaataaagacatcaatgtcttcggttttcatgctgtcaaaagcaatgccttgaattccgtattgatgttccaattcagcgagtcgctctgtattgcggcggtttgtcacgcagatgttttggttgggaattttttttgcgcggaccatgcctgatatcattccttcagccattgatcctgctccgataaaagcaactttcttttgatctaagatcggtaacatctcccttgttcgtattttgttcgtatttttcacacgttttttatgttaccacttcaggagtcgatgtcaagtttgaaggttttattgatatgtattgttccgagcctgttattatgtataatgaatcacagaacaaacctttagagcccgggaggccgggtgcgttccggccggatttaaaaattatctgaaatggctttttctatcagctttttgcagcggtcaagctctgtcttcagctgttttttgtaaagcttcgctgcttcatagtctttaaattgatagagaacgacttcctggagtttggctccctcctttttcacttttacttgctttaaaatcccgtcatccaaaagttcgtgaagtgaacggtacacctcggtatgattcggcttaaaaccgatgggtttaaattccgaacgcagcacctcgagaagcttcagtccgtaaagccgttcctgctctgtcattgtaatcatgtaaagctttaaaaaggctctttgtttcactaaaaaaccggttgaacttcttttttcttctttcaatatgtgcacgcccttccttctaacaaattattccatgtactaaatattctctttatatcccgttttcccttttattgttcggacagtttggtttgtattgatttgttttttggatgcggggaaaaataatcttattgaacatttggtacatagtttatttagtttaattatagctgatatcggtttctttttcactcttttttctgcaaaaacggatctttatgcctatttaatcgggttgcggaaacaaaaaaagacccgtcacgaagacaggtccccttttgtttaaggattagttgaccacaaaccggccgttttgatgaaaatgcgcggatgtaatttcaattgagcaaccatatattctgcaagatcctcaggctgcatgactttttccggattgccgtctgtcagatttaattcaatagacatgtcgcttgcaaccgtgctcggagtcattgcgctgacacggatattgtgttttctgacttcctgcatgagagattcggtcagaccgagaacggcaaatttagaagcgctgtacgcacttgtcgccgcggcgcctctttggcccgccgtagaagaaatattaatgatatctcctgattttctctcaatcatttcaggaagaacggcgcgtgtcacgtggtatacacccattacattaacttgaatgatgtcttcccactcttcaggcgtaagatccaaaaatccgccgaatttgctgattccggcattgttaatcaggatgtcaacctcaccgagttcttctttaatagaggagacggcttgttcaacctctttttgatttttcacatcggcagcagcgaatgatgcctttacaccaagggctttcacttcttccgcaaccttttcgacatttgcttctgtacggccgattaaaccgatattgactccttcttttgctaaagcgatagcggcggcgcggccgattcctctgcccgcaccagtgataagagccgttttgttttgtaggctttccatgtctttcaccctttctgaatgtccttatgtacgatttcacattataagcagaaaaaaaacaattagcaaataaaatgattcagcacgatccgtaaagggtatcaactgaaaaaaaggagtgaaaagcagatgatcatcattttgtatatcagtgctgccgttgcggctgccgcattaatttatgcagccgtatccgccgtgcattttaaaagaaacacagcgcctgatataaagaagattaacgccgcgacagcgtctatgcagacgtccgttgaagaaatcaaaacagaaacccgtttgttatcacaaaagcagaaagaactgcaggaagactttcttactaaaaaaacagccgtgcaaacgacggcagccgaagttaaaggaacgcctcacgtcctgaaaatgctctggaacgccggtaaaagcgatttatgagcctgcatgtcatccgacgtttttgatgacactaagagaaactggcggattcaaggaggcataacatgatttgcgatcgtgagcggcttgcgcattttttgcagcagcttaaagcattatcatcttcgggagggtttacaaaatcggatttgctgactccggagttccatttagccaaggacggatatctggatatgtattattcgcctcataatgagtatatcaacccacatgctgcggttgtcatctccggaattacacccggtttttttcagatgcagcgggcttacaaagcagcggcacagcttttaaaaaacggcgaatctcttgaggtgatagcatatgagacaaaaaaagcggccggactttccggttccatgaggcagcacatcatcgaaatgcttaatgaatgcggtctgccggccgcgcttcacgttgaggattcatcccggttatttgattcaaaacgggagctgcttcatacgacatccgttattaaacaccctgttttttataaacagaaaaactatactggacatcggccggcaatcagcagatcagctcttctcagccgttatgcgctgacatgttttccggatgaaatagaaatgatgaaaaaggacattctgctcgtccctctcggtaaagcagcagaatcagcctgccgcatgctgaagaagaacggcagaatgggccatgcggtcattctggaaggcttcccgcatccgtccggagcaaacggacatcgtttcaaacaatttcacgaaaaccaacaatcgttacgtgaacaaattcagcggtttgccgggtttcttcagaagctgtaaaaaaacgccccgaattttcggggcgctgctgttaagaagcgtattcaggcaatgctttattgtgttttgccgttttctcttcaggtattttgatttgatttgtcaagattgcacttacgaaatagagcgctgcgaaaatccatacaacgccttgtgcgccgacaagcccgatgaacgcccaggcaagcgcggggccgacaaatgccgacaggcccgcagccagatttaacacagacatggcagcacctttattgctgccggccgccgtcggcacgatagccccgatcggaacgaacccggcgaggagccctccccatataaaaccgactatgctgacgaaaagcaagttcccatgtgatacaacaggagcataatataataaaagagtaaaaatgccgcagcccactcctccgaaccacatgacggtctttttccagccgaaggcatcgccgactgcgccgaatattaagttaaaaacgatatttccgagaaagatcgttccccaaatttgaagccatacatttgtagaaatgccgtgctgcgccatatgcatcgggaggaataccggaaatccgtatgttccgatgctgttaatgatccgaatgatccccccagagagcacgcgcggattttcagcaaggatggtgattcccttcattaattcctgcgccttttcccgcttatctgcctttttcttttcaaagcggtccctatttaaaatcaaagcaaaaaacgcgccgaggcatacccagaaaattgaactccacagcgtattcaaatagccgaaggatttgatggcccagcttgaataccaagcaccgaatacaaacatcccgcagcaatatgcaatccagaaccagccgaccgccgtactgagcctgtttttcggcgaccggtaaatcacccatgtcaaaaatgaataggcaaacagcgggtaacccagccctttaataaaatacgtgacatacatcaccggcaaattaagattctcaaatccgtatgcgataaacgcggctgttccgatgacgtaaaacaacagccccataaacatcgtccgctttgcgccgaaggcttcgaggcagacccctgaaaaccacgacgccacagcaagagaaataccgtaaaccgtaaacaaggatgctgattgctgtaccgtcaagccgttttcaactaaaaacgggctgagccagccttgttcaaggccgtcccccatcataaacagcacgacccctaaaaatccccaggcgagctgtttcggaattcctattttattaagcatttttgttcctcctcagcaatctttcatgttgtcatctcatccccaagtcaggctttcaccgccggctgaaaatgagtaaataatttttgcgcatgtttccattcttcatataggaagagatccgtctgatccgcttccggctcaattatctttgtgcgggtcgaaagctctgctttcacaccgagagcttcgttgcaaatcatcaccgctcccattgcggatgcctggctgaacccctctctcttatagattttcttttgaagaaggttagcaagaaactgcgtcaaagcatcactttggaaaccgccgccgcacaccttcacataatcttgtgaaaaggaagccgcctctgttaacgcctcatagttccatttgattgaaaaagcgatttccagcagtgcggctttaacaaaatgggctctgcttaagttttgggacagcggagcgtcaaatataaatccgccttttgccagtgcgtttttctcaggcgataaataggagcctaacgcagaaatacaggcatgatcatgtttcggcagacttgcgatttcccgttccatgacgctgtaggattcattcggataaaaaatggattttaatttttgataattgagtcctgttacacccggattcgtttcaagaagccattgaccttcttctgtatggcaattcagccatgcattctctaaactttcggttccggtctccgctgttatctttgtaatcggcgtcgttgtgccggatacgatgacgatatctcccggctttgcatctgcacttttgatggcaagctgtgtgtctcccccgcctgcaatcacaggcactctttcagaaagaccgagcaccgccgctttcttaaacgttaacattccgacaaccgtcccagatcggacgagtgaaggaagaatggcagaaggcacaccgaagatgttgcataatttctctgaccacgcctttttccttacgtcaaacagcagtgtttcagcagcctgtgacggttcatagcttaaaattccgctcagctcaaatgtcacccagtcactgacgcttgtgatgtacttcacttctttccataaagacggctgtctggcttttaatccgacaagtttcatggcggaaaataaagcgctcggaagacgtccggtttgctgatgcacttcttcttctgcttcaatcccgccttcccattcacgccctctgttatcaatgttgggcagaccgagaaatgcctttttatctttattgatcagaacgattccctgcctctggcttgttgaggtgattccgatcaatgtaatatgagggctcttggcaatagcctttcttgccatagcgctgatttgcgtccataacccttccggtgagaaatatcgtccgtccggataaagcggatccgtcacatattcaatgtcttccctttcaagcgcggtcacttcgccgccggcagtcacgaccgcaactcgcgcattccccgtcccgatgtcaaatacaaggtagcctttttgttcagccattacagcctcctccttccgtttcaagttctcttttgttataaagttcacgtattgagcaggtttgatcttgtttccatttgaaaagcgcttcatttaaaatcttcacatgatgatcttccacttcaaatgttgcgcccgctaaatggggagtcgcgaacacattcggcaaagagatcaaatcataatcagaagattcaggcggttcatgataaaacacgtcaaggatcgctcccttaatccgccgttctttcagcacccgcagcagctcttccctgtctgtaaccgccgctcttgacgtattgacaaaaacagcttcctgtttcatcaattgaaagtgccgggcgccgataaggccgatggtttcttctgtgcgcggcaagtgaacggaaacaatatcactttcagaaaatacccgttcaatcgtcgttttttcatactcccggttttcatgacggacaaatggatcatagtaaagcaccttgcaatcaaaagcggccaatagccgggcgattctctgtccgacagcaccgaaaccgataaggccgactgttttccccgtcagctcatttcctctgaatttgacgtaagcctgcaaataatcaccattccacttcccgtccttcagccactgatgggaagaatacgtatgacgcaaaaatgaaatcacatttccgataaacatttcagcaacggcctgggcattgcgggccggtgtaaagaaaacggggatttttcttttagtcgccgccgcaatatccacattagacggcatccctctgcagacaccgataaaagcggaatccggcaatatgtcaataacacgctcagacacctcatcaagttcggtaataagccccgacgcgtttgtctcttgaatcattcggattaattcatcttcccgataggcccggccgtgcttcttccacggccggtgcacagtccggccgaacagctcagtcagctccttcagcccctcgtcgtgatatggcgcggtaattaaaaccgtcatggtgcaaaacatccttttcacataaattttttcataaaaaaaatctctttcctcaaagaaggaaagagattcatataccgtctttatacgcttgaagcgcacaaatatgtatagaccattctttcctatctttcaagcatacgcttgctggaattggcacaataaatgttgccgaggtttcatagggccagtccctccacctctctggatagaaaataaaatgatgaaattgtcaggctgtttaaaagaataaactcatcatagaaaagtctttccgtgatgtcaacacttttttctgaattgacgttcgattttgaaatgttataatgcttacattataaacaaagaggagaaatgggctatgaattctgctgcaacacagccgaacggggtctttaagtcggtgtgctccctagactgtcccgatcaatgcggcttgcttgtgacaaaaaaagacggaaaaatcattaacattcagggagaccccgatcacccggtcacatcagggaatatttgcaacaaagtcagacacatggctgagcgtatttatgatgagaagcgcgtaaccattccgttaaaacggatcggtaaaaaaggtgaagccgcgtttgcgcctatttcctgggaggaagcaatcaatacgatcagttcgcgctggaaagagcttattgccgaagaaggagcggaaagcattcttccgtacagcttttacggcaatatgggaaaactggcggcagagggaatggaccgccgttttttccatcgtctcggagcgagtcatctcgaacggacgatttgcagcaaagccggatctgaaggttataactatacaatgggagaaggagcgggtactgatccggaggagaccatacatgcaaagctctttattttttgggggatcaatgccgtcagcacgaatatgcaccaaatcatgattgctcaaaaagcccggaaaaaaggggctaaaattgtcgttatcgatgtacataagaaccaaaccggccggcttgccgattggtttattcccattcgccccggcacagatgccgcactcgccctcggtatcatgcatgtcttattcgacgaaaaccttcacgatgaagcatttctcacagaatacaccgaaggcagtgaagaattaaaagcgcatgttaaacactatgatccggaaacagtttctgctattactggcgttaaagccgacgatatcagacgccttgcgagaatgtacggggaaacctccccttcccttatcaggattggaaacggcattcagcaccatgacaatggcggaatgatcgtccgcaccgtcgcctgccttccggctgttacaggacagtggctcaacaccggaggaggcgcaatcaagcacaacagcgcggtattaaactataacagacaagcgctccagcggcctgatctgctttacggccggaagccgcgatcatttaatatgaacaggctcggaagcgttcttttagaaacaaaaccgcccgtgcgctccctgtttatttacggtacgaatcccgcagtggttgcgccggaagcgaataaagtcagaaaaggcctgctgcgggaggatttatttacagtcgttcacgatttatttttaacggaaaccgccaaatatgcggatatcgtgctccctgcttcatccgcttttgaaaacacggatttttacacgtcttactggcatcattttattcagctgcaaaaaccggtgatcgaaccctacggggacagcaaatcgaatacggaagtgttccgtctgcttgccggagcaatgggatttaccgagcaggagcttcaggattccgatgaagaattaatcagacaggcgctggactttcccgacaatccgtatatcgaggatattgattacgaggcgctctcacgccattcctttatgaaagccaaacggaaaaaaccgctttttccgggaaagctcaagacaccgagcggaagaattgaattatattcggaaaagatgaaacaggacggttatccggcgctgccgacacacatccctcttgagagcgatgacgattttccgcttttatttgtcccgggaccgaatcataattttttaaattcgacattttcaaataacgaaaaacacgtaaaactggaaaaagcgccaaaactttttattcatacagaagatgctgtacgccggaacatagaagacggagaaaccgttagagtttggaatcaccgcggagagtgcgaattgactgtttcggtcggcgaacaggtgcttcccggcgttgcggtgagccaaggtctttgggccgatatggatgataaaaaacagctcgtcaattcactcacgcccgatcggctggcggatatgggcggaggtgctgttttcttctccggaaaggtgcaggtggaaaagctcagcaatcaaaaccgtccgcaataaacgcccggcggttttgctgaaggctgaatccttcggccggcttcaccgcataaaaaatgattacgtttattggaggttgctgtatggatatcattaccggcatcggaatcgctttagccggatatttcataggagacggattgaaaaactttaaatcatctgatcctcatgaacacactgaccacattctcattaaagaaaaagatttacactattatattggttattatttaggagtaaccaaggaagaagcgaaacaaatcgtgcctgacacctctgacattccgcatatcacgagaaacggaaagcggtatgtgcagaagacggcattaagagaatggctgacttccatgctggaaaaagaataacagctgctatgaaaagcgggaagagtttttctcttcccgttcattaagatttgccgccctgcctctcttcaaccccaaacatacgacagatatcgttcttacgtaacgaaacatccccttctttagatttcaaataaaaccctttcttatataaccgtatgacttcctcatatgtaagctcatgacgaaggagcgccattaaacgcccgtctttttcatcttgtttattgaaccattcataccagttcactttctgcatgtcaaacaccttctcactttgaattaatgccttttcgcatttattatacttatttccccttttgtaaacactccgactgcctgtgacatttttgaaaacagccgtacccgtccctattagtcaccatgttgacttatttccctttgtgatgtatattgtaattgtcaacatggtgacaatttagatgggagataatttatggatattaaattactaatgaaggaactgcattttatacaacaaagttacgcatcattattttcggttgtcaataaggtgcagactcggggggacgaatacttagaaatgttaacttcccgacagcatatggctcttattgctattgcccatttaccgacggaagatgccacacttatgaatatcgctaaaaagctgggcacaacaaaacaaaccgctaacaaattaatttcaagcctcgcgaaaaaaggatatgttcacacggtgccaagcaaactggataaacgtgcaatcaatattgagattacccctgaaggaaaaaaagcgttaatttcctgttcagaaagatccacctattttttagcggatatgtttcatgagttcacaactgaagaagttgaaacattctggaggctattgcaaaaactttatcgttttgatggtgaagaacaggatggttttgaagaaaaagcacatttgaaagttgaagaccaggcacgattcatctcagatgactatgaagaaaaaatcatggctgaattttcaaaacggagatatgggagtgcagacgatgaataatatgctttatcgaaaagtaaaagaaacagaggataagatgaaggaaaaatgctatgagctgaaagataaaattgatcaatttatttctcacactaaatataaaattcattgcaaccgtaaactggaccgagccggcaattatatatcaattgccattggactctttatcctaactgcctcatggctgaccggaacacaatggctgctttggataggcgcggcgagtattttgagtaatgcctgtttgctcattataaagcctgttaaaaattgaaaacctaaaaaaaagctctctaaaagagagctttcttttattaatcgtcccagtcttcatcttcttcccgattttctttcatctcatgaaatctttcataaaagaactttataaaatgcgcagaattaagttctttatagccaccgaattcactccaaataacaactggacattctccttcccgttactttaagaacatttattcacaaagtaatcttttttacaggtcatttagtggtagcccaggaaaatgcgaatttacaaccttaatcaaattcaaacataaaaagtcgaattccctgtcctttaaggaaaacgacttcttcaagtaaatccccattaaccttttttggggacgatttgtaatctctgcgcagtgaaattatacctgtgctagcccgccatctacgaacaattcaacacccgtcaagtaactgctttcgtctgaagcaaggaaagatacagcgtttgctacttcttcaggtgtcccaacttttccagctggaacagtatttctgctattttccattacttcttcaagtgcatcaccaaaaagctcatcgtaggcaggtgtaagaatagctcctggactaaccacatttacacggatttcagtatcttttaggtcaagaatccagttgcgaactagtgctcttaatgctgctttagatgctccatatacactaaacgctgggttgccaattgatccagcagtagagcccgttacaataatagaacctactttgtccgggaatagtgataacgctttttgaacagtaaagatggttcctttaacgttaatgccgaacgttctatcaacctgctcttcagtaatttcacctaatggaaggaagctgccggtgcccgcattagcaaaaagaatgtccaacttacctttttcctgctttatcatgtcatatagtttgtctaagtcttcaagcttagaaatatcaccttgaacaccggttacgttcttgccaatttggttaacagctttatcaagttcgttttgtctacgtcccgtgatataaacatatgcaccttcgtttacaaatttttgtgctgcagcaagaccaatcccacttgttccacccgttacaagcgctattttaccttcaaatttacccatacttaacactcctttagaattaattttattttatgtctagtacctttaagtacttgaagaacaacttacaagatatagtatccttcagtaagcacattatcggaagtacccacttttttgtgatatagtaactaaaaagtaataaatgtggaatggagagctttagacatgaaaaaatttagctgtgggtttgaagtgacaaaggaagttattggcggaaaatggaaaggtcttgtattatactttttaatgaatggaccaaagagaacgagtgaattaaaacgcattatcccaaatataactcagaaaatgctgattcaaacacttagagagcttgaagccagtggacttgtgagcagaaagatgtataatcaagtaccgccgaaggttgaatattcatccactgaacttggagaatctcttaaacctatcttgcaggagctctgtcaatggggaggccattatgcggagcaagagtatgcagaaggtgaatatgaaattgtacagccagaacaactaagttaggattgatgtagctgctgaagtaaatgctaaacaacttcaataccatcacctgacagatgaagaacagtcagaaataaatgagatattcaattttgaaagtgaagttctaataagaagtgtcatggactatattcaggagaactttgatgaaattcaaaaaagagctgtttcaaatgttaaagagaaggttcagaaacttagcaaaaagataaatgaagacatcagtaataacatttaatgcctatatggtctcttcgcatgcattttttacacaaaaagacccggattttaattccaggtcacacttcaggtcacaatttgctcaaattccctcttgcatttctcgaactgctttattcaagatcataaaatttcaaacgaaaccttacacgaaggaatcggggatcggcaaaacaaagccagatataacatatattaaaaaatctcttgcatttccacacccggcatgctatattcatatagcgatgagctgaattgtgtaagccgatgcacatgcccttgcggcacacacgaatgtggcgtgtggtgtatcgcctcaatacgcaaaagacgtttgcttctgcaaacgtctttttttattatccgattttcgttccgttcggtactgtctgctctggcgtaagcaggacaacgtctcctttttccgggatgccgccgagaacgagaacttctgacttaaatccggcgatccgccgcggcggaaagttgacaatagcggtaacctgcctgcccgtcagatcatccggttcgtaccgttttgtaatctgggcgcttgattgtttcatgccgatctcttcgccgaaatctattgtcatcttaatagccggcacctttgcttccgggaatacttccgcttttacgaccgttcctattctgagatcgagcttgataaaatcttcgatgactgccatatcaaaaactccttttttacaatcatgatatcaaaaaaagacgcagtttatttaaccgattttcaggattatttatcagattgaaaggtgtttcggaagacgcgcggcgttattcccttatgtctgacaaaccatctggtaaaggaagacaaattttgaaagccgacctcctgactgatgtctgtcagccggcattttgtttcaataagcatttgttccgctttcttcatacggagctcagcaatataagcttgcgggcttttccccgtctgctttttaaaccagtcggaataatacgccgggtggtaatgttccattgcggcaagctctttaattgaaaaagtctttgagagatttcggcggatatacgcaattgaatcattcgtacggttttcttgtatcttttcagcaatatattctgcaagcagactcaatgaatgagccgactgctgctttgtctcttctgtcagcagaaaccgaatcgatgtccaaaaaggatcaagcttattcagtacgccggggtcaaatgaacctttgaaaaaatatgccggtatgtcgagaacaagacattcatttcgctccaaagaacggaaccgatgttcatgcccgggcggaatatacagcatttgatcaggttttaatctgatttcacgtctttctgtctccaagtccagctgtccttcgagcggaaagagcatttggcagtatgtgtgtgcatgagaatcaaaaatatgcgaataggtgcgccgctcacagatgatatgttgtaatgaatccatttgtccctccttttacatgatgcgttttttatttagtttacataataatattattgtcccctcatctgtaaacctcttaggaaagcaacaactgcaaacttccggctttctttaattgattcggttaattcaaatgcactctgttttctcaacacggcaaatccgtgaagaagactcctcagtcctctcgcagcatgaatcgcagtgtcagactgtgcataaccgttagctgtcagctgcctgacaacaagctctacaagcaggcttgacagattctcaatccggccgtcttttatcttttgaaatgttgcgtcatataatccgggattggcttcggcgaaattgatataggcatcggcaagagcgagcaaagccgtttcacccgtcagtccttctgcagaggccgccattttttcatataacatagttaaaccggagacagccagctctgttttaattccttgaaggccattgacaaaattgtaaagggaaggcggttttacgtttaaggactttgcaacggccgcaagcgtcacttcgttcagccctttttcgtcagcgatacctgctgcggctctcaatatcatgtcaaggctcattccgactctcggtgacattatgatcggcctcccggcaggcttcgttcagcttcctcagcagcctcagccatcatttcaacgggattgcagagaacatttccatgtccggcggccagactgcttggttgatgagcgataagcgttcttgctgtttttacagcttcttctttattccacgtagcaaaagccggaaacggaaatttccatttcagcttccctgaaacagcaaggccgccccgtacttgaaaggcatctccgacgatcagcatatcatttctcatatctttaaaagcgaggcttcccggcgtatgaccgggagcgggaatgacaagtaaagatccgatccgctcgccgcctttcagcaggcgatcaggttcggtctgaacatttttcggcactccccctttatcggcgtttgtgcttcatgctcaaataaagaagtgtcacctttcagcaagaaagaatcccgctcagaaatacagacggaagcatccggaaattccgcagctaatgagtcaagcgaaccgatgtggtccccgtgcgcgtgggtgagtaatatgtcattcagcggcttcccaagctgccgcaatgcttgtttgattcctttatgactgttaggcagtccggcgtcaatcagggttactccttcttcttcttcaaccaaataacaattcaccgggaaaagcgctggaaaaaaagtcagctgccaaacccttccgtattgtaagattctcatcaacatccccctaaaactaataccattagttttattataactaatgctgttagtttatcaagcgtttctgtctaaatcctgaaaaaggcgcgggcgcttctctcatgccaaaaaaagaaacgcgcatactgtgataaaagatgctttcagcctgcgaataaatcagactactaaaaccagccggataagcatacactactcaacggagggggagttccacatcatgcatatcacacttcaaagcatctgccctgtcttaatgattgccttttttctgtataaaaaggtgaaacggtccgtcggctttcagcctttgaaaccccgctggctttacacaagaatgattttattttcattgctggccgccgctctggcgtttttcagcatcacacacccggctttatacgggtatcttatattcggcactttttgcggctggcttctggtcctgtttgccaaacggaacatttcttttgaagaacgccgcggaaaaatgtattttcgcactcacctgtggattgaacttattctattaacgttattcctatcgagatttatttatcgcgttattgaaatataccgggtcacagcggactttacccatccggaggcatacagccaaacggtcggggccgatccgctgaccatcagtatcttttatttcatcgcagtttattacagcggcttctctttttatgttttaaaaacgagcagagaccaaaccaataacagtcagtacggctgacatccctgtctaaaaagcagggatgttttttaatcgtgccgcgtatggtgaatcatttgctgaagcacatctaacacatgttcatcctcaggtgaataatagatggatgttccttctctgcgtgatttgacgaggcgcagatttttaagaaaacgcagctgatgagaaacggtagactgcagcaaattcagcttttctgcgatatcatttaccgcatgttcaccctgtgacagcaaatggagaattctgattctggtcggatcagacagcgccttaaaagtctgggcaaccaaaaataaagtttcctcatctaaatcgacagcggggtcattcgtgtttccggattcgtgaaattcagtcatatacctcacccttcttttctcaagtagcccaattataccaaatgtcatttgatgcagatacatcctgcgcctgacaaaagaaccgttattttaaatttatgtttcaaatacgggtttccgcttggtttcgcgcattcatctgtgtcataatgaaaaagtcataatgctcctgaaattgagggtgaaacacagtggagaaaaagaaaaaaggctgtttcgctgccgcgggtcttatgatgatatgtgtttttgtcatggtttccttcttcctcattctgttattttcaaataatgaatggctcaaaagtcttccgtttgatgtcaaaccgatcgtgcttgaacggctgacagattacaaaccgcttgttgaagacgagctggatgaaaaaggactcaccaaatatacatcgcttgtactcggcatgatatatcaggagtcaaaaggaagaggaaatgatcccatgcagtcttcagaatctctgggtttaaagcgaaatgagattaaaaaccctcaaaccagtatcaaacagggaatcaaacaattcactctcatgtaccaaacaggcaagaaaaaaggcgtagacttggatacgattatacaaagctacaacatgggagccggctatattgattttgtggctgaacatggaggatcgcatactgaggaactggcaaaacaatactccgagcagcaggtcaaaaagaatccgaaactttacacttgcggagggaacaaagacaatttccgttatccctactgctatggtgattacacgtacgcagaaaaagtaaaagcaaaaacaaaaaccgttgaacaatccttaaatgtaacaacacttgaaacgcttgaagagtaaaaggcgccctgatgaggcgcctttttcaatcaatagaaaaaagccgcgcagagcacggctttttttaataatacggtgagatcattaagtatacaatgacacccgtcagactgacatacagccagagcggcatcgtccatctcgcgatttttttgtggcgctccacttgcatgctgaatcctctgatcagcgtaaacagcgcaagcggcacgataacggcggaaagacagatgtgcgtaatcaaaataaagaaataaatcccccgaataatgccgtggccgccgaataaagtattctcagctatcgagtggtacacgacatagcagatcaaaaacagcagagtcgtcgtaaacgccgccaaaataaagcgtttatgcgcttgaatatttttttgcttaatcataaagagcgctgccagcaaaaagataaaagtaaagctgttaaaaatggcatttaacatcggcagaatatgaatattggcaatgctgacctgtcccgatttcggcataaaaaacagcaccgcaattaacccgttgatcaaaacggtcaatgtcagcacgataccggtataacttttaggtttgttttctgtctgattcatcttatgacctctctcaattttactgactatccaaatggtatgagaattcagctttgatgtcaacggtttcgtccgcttcgtcagaaattagacaaacttaagccctaaaaagaccgggtgtttgagacccggcctttcgtcatattatgcttccttcaacagttcttctatcaccttatgttcattttcattcaacagattttttggaatgatccgatctatcggtttattcatatgctgatcgagaatatcggctgtttctttgtcccctgcgattacgagacgctcccattggtgtgaagcagccttttgatctaggtttgaagccaatcgtttatacagcctgttttggttttcttcgacatgggctttggcggcgtcttcctccatcgatgcggagcttccgcttacatcctgcggtttccacgattcattgatgacgtcgtattgataatgctccaccccttcaatttttccgagtacggtttctatgatcttcacttcattctgctgggtgagaataaaagccgtgctcggaaattgttcacggagaagttctaattgatcaaggacagccgtttcttcccaataaaatcgtatttcgacaggcacctgcaattcaatcgtctcccagatgccgccttctcccgatgcaaaaaatacgagacttcgcggcatctctttaccaagcccatcgatatattgatagacgcgttccatgatgcggacgagagatttttcttcttccggatcacttacagacagatactcttttaatctccgaaaaccggttttcaaggcgattttccactctcccccctgctgatccggatttctcatatccgtatttacatataaggaaagcattttatcaggagattccgtcattacgtacttcaatttgccgatgagtgagtcaattgccattatagattcctcctttttccgctgctcactgttcctttccctatccgcaccgccttaaaaacgtcaatccacatataaacggcagacttttctaaaaaagtttttgcaaaacccatttacaaaccaagacatcatttactacaatggatacttgtgtttgactaagacttttacgctgtgaaaggagtatgattttgtttactgcagaagaaagagatcagaaagagctggaaaaagagcttcataaacttgaatttcagattttcagaatgcgggaaaatctgatagatgtatcaaaagacgcgcgagtgcttggtattgatcaatcgaacaatgacgattggatcattgtttcctcgattgatgatggccaaacatgtaagattatgctgactgattgtgaatcagcctaccggggaagaggctgtttttcactgatcgcctcttattatgataatgccattcatatcggggacattaaagggccgccgaaccacggctacggctcgatctgcatgaaatttttaaaacatatcgccagagagcagaatatcccgaaagtgacgggcgacatcgctaagcgtgattgggatcatgtcgaccggctcgttcatttttatgaaaaacatcaatttgatgtctggattgacaatgatacgcaatcaggcggcattaaatgggtcgacctgtaaaaaatgatagataaaccctcgttaatatggtgtaatagattaaaccatttaaggagggtttttttgtatccggaaaaattgaaaaaaggcgacggcattcgtattgtgtctccggccacaagcatgtccgctatgtcagatgaaaatataaatgccgcgaagacaaaattggaggagctgggcttttgtgtctctttttcagagaatgcaaaagaaataaatgaatttcattcatcatcgattgaatcgcgtgtacgggatctgcacgaagctttcgctgatcctgacatcaaagcgattttgacgacactcggcgggttccaatcaaatcagctgctccgctatcttgattatgaaaacatcaagcggcatccgaaaatcctttgcggctattcagatattaccgccctcggccatgccatatatcaaaaaaccggccttattacatattccggtccccatttttcttcatttgccatgaaaaaagggctggactatacgattgactctttcttggcctgctgtgcttctgacaacccgtatgaggtaaaaccttcatccgagtggagtgatgataaatggtatttgaaccaggaggacagacgtttttatcggaatccgggaccgctcgttattcaacccggatatgcggaaggaacactgatcggaggaaatctatgcacgctgaatcttctgcagggcacggaatactttccggagatggaacaagtgattctgtttatagaagatgatcatatgtcggacattcatatgtttgaccgggatttgcagtcactcatccatcttcccgctttttcagccgtgaagggaattgtcatcggacgtttccagcatgcttcaaatgtgtctgaggaggctctgcgtaccgtcatccgtacaaaagaagaactgtcatccatgcctgttatcgcaaatgctgatttcggccatacctcccctttgatgacattcccgatcggaggaacatgcaggatagaagccggctcagaaggcggacggatatggattgatcggcattaatacataaagacgggaaaaccgccccgtctttttattttgacgccttatgccgcggcgtgcgcggagcgatcataattcgtccgccagccgctgccgtcacccatacggaagctccttcataaaaacggctgatctcttcattatatacggcgtgtgtcagttcacgtttatcattcgttccgtcttggttttttacgtttaaaataagtacaagctcgtgcctgccattcttcatcacgccagtacttctcaccttttcaataacggctggccttcctctccctctgtcaagcgcctgaaacagcctgacagcaggcatagacagtccgataacgagcacaatgacgaaagcggtgcatatacctgcttgaaacactggtgattctgtgaaggcattccataaacatatacattccggctccatcagattcatcatcccttcagattccgttttcacatccattccttattatattagagaaacgctttttctttttccgcatataacgattatatacagtcaaaaaagggaagaaaaaaagaacacaaagcatttcgccttgtgttcttcatctctatatgaaactagtctaatactttaacatttacagttctgacgccccagttgttagcgtcacttttctttgcaacaaatacgtcaattttatttcctttaattgcgccgcctgtatctgctgctgttgccactccgtaaccttcaacataaaccttagagccaagcggaatgacactagggtctaccgcgatgacttttgcatcagggtttttgtttaagtcaacaccggttgccgttacaccggaaatgccgccgtcgttagcagagtaagcagttgcagtcattgtcagctgctttttaggctcttgttggtttgtatttgattgaacaggctgctgttttgcttcgacagccttcgcttcttgtttaggttgttgttgttcttgaacaggttcttgtttaggctgctcgtttttgacagcttcctgtttcggctgttctgtctcagcagctggtttttgttcagtttgcggctggctggcttcttgagccggctgtgcagcctgagcctgacctttcacatttaacgttgtgcctgcgtaaattatatctgattgcaagttattcaagcttttcagattgccgactgatgttccgaatttctgagcaattttccagaggctgtcgccctgcttcactgtgtactgcccagatgtggttgtttctactgaagaaatagtcagtttctctccttcaataattaaatcagaagataactgattccattcttttaagtcctttaggttcactccgtttttttgcgagatcccccagagcgtgtcacccttttgcaccgtgatttctttagcagaagcgtgagctccaaatgcagttgttgaaattgctgcaactgcgacaaaggacataatcgtcttcttcataagtaaatcctcccttgttagctttttattggcggctaacaggtgatatcgtaacatatgaaaatgtcagttcaataacaaaacgatttgaattagattacagttcctttacatgaaacatttctctcgcttggtaagtcttgctgaaaccttgatacagcaagggttttcaagcttctgatttttccggcgccaatgaaaaacacaatgtgcaaatttctaaaaaaactttttttcactctgtttctcttacataatttcggatttcttctaaaaaaaccgctccgtatttcaatcttttttgttccccgaccccttttacggaaagaagatcctgatctgttttcggaagtttcgccgacatttcttttaacgtctgatctgagaacacgacaaatggaggcacaccctgttcagctgcaatctctttgcggagacgccggagaagctcaaataattcgtcattttcggtaactgcggcggcctgtaaggcttcttttctcgcgactgcgctttttccaagcagaacgtccctgcctttttgggtgaccataagcgtcggaaatgtgccgtccgccattctgatatattcatctgaaataaggaattcgataaaatcactgatttccgctgcggattgatgcttcataatgccgtaagtggacagactgctgaagccgttttccagcacttttttatttttagacccgctaagcacctgcgccaccatcgtttttccgaagcgctcattcattctgatgatgcatgacaataccatctgcgcttcttttgtgacgtcatgggcggtccttgtatcagtgcaattgccgcatgcttcgcaagcttccgcctcattctcgccgaaatacttcagaataaaccgctgcaggcaatcttccgtatgacagtaatccaccatctgtctcagttttttgagatcctgcttttgtttttcttctccggcggccgattggtctattaaaaaacgctgcaccataatatcctgcggcgaaaacaagagcacacactcgctgttaaggccgtcgcgcccggcccgtccggcttcctggtaatagctctccatatctttcgggatctgcgcgtgtaaaacaaacctgatgttgctcttatcgattcccattccgaaagcggacgtagctaccatcacttgtatctgatcgttaagaaaccgctcctgctggtcttttctgtcatcatccgccaatccgccgtgataacggccggcattgatgccgctgcgttttaatttctcatataaacggtcggtttcttttcttgtcgctgtatatataatgccggcttcgtgtttatttttttcgaggtaccgctcgataaaccggtctttgttttcgccctttactactttaaacgttaaattctctctggcaaaaccggtatatacagtttgttctttcttaatatgaagctgcttacagatgtcatcatgaacctcaggcgtagccgtcgccgttaatgcgatgatgacgggcggttcttttaattcattaaaaaggatttcgatattccggtaactcggcctgaaatcatgtccccattgcgatatacagtgagcttcgtcaatggcgacaagaggaaccgtaatattctgcaggatgtgaatgaattcagaagaagtcaaacgctccggtgtgatgtaaaagagccggtaagccccttgtttcaaaccggtcagacgctcatgaatgtcacggcttgtctgggtgctgttaatataagctgccgcgatacccgcttcttcaagcgcgtccacttgatctttcattaaagaaataagaggggaaataacgattgtggttccttcaaacagcagtgcgggaatctgatagcagattgattttccgccccccgtcggcataatgcagaccgtgttttttctctcctctgcaactgattgtatcgcctgcttttggcccgcgcgaagactgtcgtagccaaaataatgcgccagaagggattgggctttatccagcatatgttgtaaaacctcactttgtctttgattctttcattttatcataatgataaagtacgctgctcaagggcaattcaaaataaaaagccatctccgcaagggaaatggctttcgctacgtatgccgtacgcaagtaagaaagttttaaaccaccactcctcaaagtgggtgtttgcagaagcgttcctgtcgtcctctgcaatggaggcatgacattccggcttcgatataaaactccctattacagcttaaaggttaaaacttaattaacaatacgaacaatgtagcttctcttatatcctacaccatcagtcgtattttggcaagagggttaattcttttacagaaaaccttttttctttgtaaaaaatgctttattctatataaaaattgttttttcgacaaaatatcaatatatcaatataagatcagatcgaaagcttccgccagtttcttctataatagaaaaaactctcacaccctgtaggggcgcaagagttatggcaattagaattttgcagccagatctttcgcttcttgcagtcctttttcaatgatcgcttgagcgttatccggtgcagcattatgaccttcaacgacaacagtgtgaagatcttggacaccccagaaaccgagaacggttttcatgaagtttaatgacatttcaagagatgccatcggtccttcagaatatacgccgccgcgcgcgtttaagagcgctacttttttatctcccatcagacctttagggccttcaggcgtgtatgtgaaagtaacccctgcgcgagacaggtaatcaacataagtatgaagcacagcaggcactgtgaagttccaaagcgggaatgcaaacacgactttgtcagctttgacgaattgatttaagtaaatgtcagcagttgacgcttgttttttctcttcgtctgtcatttcaattccttttgaagctttgaatgttccgttaatcatatctcttccgaggtaaggaaggttttctttatgaagatcaagttcgatcacttcatcattcggattgttttctttataagcagccagaaacgcttcgtataattttacggacacgccttcttcagccgtacggtcacttgattttacaaataatacttgagacattctaaattcctcccggtaatcttttaatatttacttacaaatagtatgttactttcttttttatataaagtcaatgattttatttcgattctgagattttttatggaataaaaaaacaggtacatatgaatgtacctgctgctattattgtgaatcctgctcgcgatccaggatttcgtaagtttgtgagcttttttgatcaacggtttctttatttgagaggtctttcacctgctcgtgaaattccctttcatatgacggagcgtctgttttcacatccccttctgtttctcgctgcgcttcgacggtcattctggcgtacggaacggcttcaagtctttcataaggaatttcttttcccgttttctcacaaatcccgtatgttcctttatccattcgttcaagcgcggcgttcacctcatctaaaagattctgatcgacaccgtccagcgtctgattcgtgaccctgtccaaataaatgcttccgtgatccgctaagtgattatctactccgttcgacaattctcctgtgtcttcgctcattgaatgattttcttttgattctccctgaagactttcctttaaatcgattaatttatgataaaggctgtcctgctgttcttttgataatgacatattcatcatctcctttttcgtctgtattcttcgctgcatctgttaatacataccctcgaaaaaggaggatgaaacaatgggggtcaatgctttctccccctgatggtgacattgggtgtctgctgctttgtctgtcttttttctttcgcagcatcattttgcgggttgtcccgactttcttcagcgcaggcttgtttgagcctgtgcgccggtgtatggtaagtggcgccgatattcagcataccgctcagctcttctatactcagctgttcaaaatcaatattgtattcaaccttgtccactttgacgtgctcaatatggacatatgctttttccccttcaaccgtttgcggctcaaaatgacacttatcctgaaggtcatcaagctgttgttccactttcttaagccggtctaattcttcttcacacacttttttgaaaatctctttcattatttttttcaaagaaaatcacttctttccccgtcactcttggaaagttctatgcgtcccgcattgcgaatatataaacatgatatacaaaaaggaggcgaatcatgatgttttttccatccgttatcaactttgagtatataaaaatgaacggaatcagcggcggagcggcttttaacaccggctcttccattatggtgagaaacacagccgccaataaaagaaatgaagggtacggtgaacaaaacggtgattgcaccgttgtcgtcatccctatcatgagtatcgatgattcagatctgatagatggcacagcgaacaagatcagccttcgataatgatctggcttgcatcccccagatgtttagcaatcgatatatataaaatcccgtctttgaataccgcctgcattcccttcgtaccttgagcggaatgcggaagatcgagttttttttcaaaatcgccgtattttccggtcttctgtttaaaatcctgttcattgaaaaaggattttctcgtgccttttacgacaatatattctccataggacaaaagctgaacatcttgtttccggtagccgggcagatacagcaaaaattggagctcatcatgggtttccacaatatctataagaggaaaagcatcctcatttcttctcatttgcccatctccctgttgaaagggaaaatgagaatggccgttttgaaatgatttcagttgttcatcatcaaaaacgtttttccaaaagtcgccgccggacatgttttgcgccatttccatccattgcttcatcttatcgaaatccatttttatcgccccctgtctaagcatacggtcataacagccggcatacacctgtattaaaggaggtttgcctgtggttcaaccaactccatatatcaatattaatattttcatgttgaaaattaattcctttgaaaatgcttcagcggtgaatgtcggacaaaatttactggcggaatggcagaattctgataaaaagaatcagggatacggacagaacttcggagatgcaagcggcttcatcggcacgaacggcaaagtggatgaccgggatcaaattgattctccatcaacctttgagtctgcatgcgacaaaatccctgccggaaaaggaggcccattatgatgttttcgccggttttggtaaatgtaggaggctttaaagtaaatgcggtcgaccgcggttcttccattacgatcggcccgtatcagcaaatcgattattttttatccaataagatcaactacggattcggtgaagaaaatggtgatttggcgccgatttatatccccatcagttctatcgctgacccggatctcattgattcgaactccggaaaaacaagcattatataataaaaaggccatccgcatgcattcggatggcttttatgtgatatttaactgcataagtattttgttaagatggcttgaacctcagtcaagtccgtttcttttgcaaattccaattcgaaagtttttccccttgtcattaatacaagcccggtatcgggatcaaacattcccgcttcttgaatggcgaagctttcaattgttttatatggaagaaatacgcgcactttctttttggagaacattttattatcaaagaaaatcactcgtttattcgtaaagcatatttggtcaacccgcagtttataaatcgtttcgatccgttctccctcaacgagcaaagcctccagcttttttgtgtcggttgatctgctgacagaaaaaattcccaatgaagaaccccactttctgcttctatactattgttttattacaatcataaaaaataagttctttatccctatataagaatacgacatagacggcatttaaaccattacgaacagattacatttttagaacgttcatcaaaaaagcccttcgcgaaaggtgccgctgttatgaagtaatacggttcagcggaagaaaaggtttcaagaaaacggtatttttttcgaaaagtcagttttttattttcgccataaaaaaccgcagcttctccaatgccgcggtttcaacaaaacatcaacgatccgtatcttcaattgttccttctttataggtatctgaaatttgttccatcgtcgtgtcggtgccttcttcaggttgcacttgctgaagctgatctgatgttttattttgtttgtcttgctctgtttttttcattttgcagccaccctttatatgtagtcttttttagtatggctcaggcaaaataaattcattcagctttaaacttcttcaaaatactctttgtagaagcctccgactttgtttgtattgtctgcaacaaaaatgaattcttctgtttcatttttgacttcatactctttacccggcgtcagcacatttttgacaatgtattttttcgcatctgtatgtacgcatttgacctttttgacgctttcttttgtctgccaattattatgaatcatttataaaactccttttcttaatcgataagcttattgtagccgttttttcttgtgaattgcaataacggttatcgattgattttactgggggtgttattatagaatgactgtatgcgcttactttgcgcggacatcaagatgctcaaaacagaccataaaaaatttcgggaggtttgttacgaatgagttctttaacgatgcagatcacaaaaaggctggaaacatttttacagggtacgaagaaactttatattgacggaaaatttgttccgagcgcttcaggatcaacatttgtcacaccgaatccggcaaccggagaaacgctgatgacgctttacgaggcacagacagaagacattgacagtgcagtgaaagcggcacgcaaagcctttgatcacggcgaatggcgcactatgccggccgcttccagaagcaggctgatgtataagcttgccgatttaatggaagagcacaaaacggaactcgcgcagcttgaaacacttgataacggaaaaccgattaatgaaacgacgaatggggatatcccgctcgcaattgagcatatgcgttattatgccgggtggtctacaaagataaccggacaaacaattccggtcgccggctcatattttaattacacccgccatgatcctgtcggcgtcgtggggcagatcatcccttggaactttccgctccttatggcgatgtggaaaatgggcgccgcccttgccacaggctgcacaatcgttttgaaaccggcggagcagacaccgctgaccgccctctatttagcggaattaatagatcaggcgggcttccctgacggcgtcatcaatattgtcccagggttcggcgagacggccggggaagcgctgaccaaccatgacgatgtcgataaactcgcttttaccggttctacagaaatcggcaaaaaaatcatggaaaaagccgcaaaaaaaattaaacgcgtgacactggagcttggcggaaagtcacctaacatcattttgcctgatgccaatttgaagaaagccattcccggcgctttaaacggggtcatgtttaatcagggacaggtatgctgcgcaggctcccgtgtcttcattcacaaagacaaatatgatgaggtcgtcagcgaaatggtttcatatgcgaaatcgcttcagcaaggcgccggccttcaccaagatacacaaatcggcccgctcgtcagccaggaacagcatgagcgcgtgctttcatatattgaaaaaggaaaagcggaaggagccaaagctgtcgcgggcggcagctgcccgtttgaagaagggtattttgtctccccgactgtatttgcggatgtggatgacagcatgaccatcgcaaaagaagaaattttcggcccggtcttagccgccattccgtatgatacggttgatgaagtcattgagcgggcgaaccgctcggaatacggccttgcagccggactttggactgaaaatgtgaaaaacgcccattacattgctgaccgtctccaagccggcaccgtttgggtcaactgctacaatgttttcgatgcggcatctcctttcggcggctataagcaatccggcctcgggcgggaaatgggctcttacgcgctgaataattatacagaagtgaaaagcgtctggatcaacctggaagattgatccaacaagaaactgctgcctgtcagcagtttctttcttttgtcatgccgtcttttacatatgaatatatatgcttctgaaggagttgagcgagtgtgagcacaattcatgaaaacgtcagaagccgccaaaagaaaaccatctccctattaagagaaacgcaaaatgcggacggctcatggtcattttgttttgaaggaccgattttgacaaacgcctttctgatcctccttctcacttctcttggagacaatgataaagaactgatcgctgagcttgcagaaggcattcgcgctaaacagcgcccggacggaacttttgccaactatcctgatgaccggaaaggaaatgtgaccgctactgtacagggctatgccggcttgctggcttccggtttatatagccgttctgaggcgcatatgattcaggccgaacgctttatcatctcaaatggcggcttgcgcaacgtacacttcatgacaaagtggatgcttgcggcaaacggcctatatccatggcccgcgctgcatctgccattatctttcttagtcattcccccatccttcccgctgcatttttaccagttcagtacatacgctcgtattcattttgtaccgatggccgtgacgcttaacaaaagattttcgctgaaaaatcccaacgttccgtctctcgcgcatttagatcggcatatgactaaaaatccgtttacatggcttcgttccgatcaggatgagaacagagatctctcttctcttttcgcgcactggaagcggcttttgcagattccagccgcttttcaccagctcggtctgcgtacggccaaaacgtatatgcttgaccggattgaagaagacggcacattatacagctatgcgagtgccactatttttatggtgtacggcctgctcgctctcggtgtatcgcgccactcccccgttatcagaaaagcgcttgccggcacgaaagctttgctcacgtcttgcggcgatataccgtacctggaaaactcaacgtcgaccgtttgggatacggcgcttctcagctatgcgcttatgaaaagcggcatctcagataacgatcaaatgataaccggcgccgcccggtttctgcgtgaacggcagcagacgaaagtcgctgattgggccgttcacaacccgcatgctgaaccgggaggatggggtttttcaaacattaatacaaataatcctgattgtgatgacacagccgcagtgctcaaagccattccgcgaaaacgttatcccgcctcatgggaacgcggactgagctggcttttgtccatgcaaaacagtgacggcggcttctctgcttttgagaaaaatgtcaatcatccgctggtccgcctgctgccgctggaatcggctgaggaagctgccatcgatccttcaacaagcgacttaaccggacgggtgctgcactgtttaggagaagcggggctttcttctgatcaccctcagattgaaaaggccgtccaatggctgatccgccatcaagaagaggacggatcgtggtacggcagatggggtgtctgctatatttacggcacatgggcagcgctgacagggatgaaggcttgcggcgtgagccaaaaccacccggccgtgaaaaaagcgatccgctggctgaagtccattcaaaacgaggacggaagctggggagaatcctgtaaaagcgcagaagtcaaaacctatgttccgctttcttacgggacgcttgtacagacggcttgggcggccgaagctttgctgcaatacgaaaaacctcatcatcaagccgtcacaaaaggcatatcctttcttattgaaaaccggcattacgaaggagacgctttcagctatccgaccggaatcggcctgccgaaacagttttacatcaagtatcacagctacccgtatgtgttttctttgcttgcgctcagcacttttatgaaagtgagtgaaaaggaggaagaaaaatgaaacggcacgcttatcaaaccgaaatgctgaattggtgtgaaaccttgaaggaacaagtcatacagcaaggtcggttcgatcgcttcgcggcacaaatcgaccggatttttcacacccttcaggatgatggattaacggaggcggaatggtacgaacaggcatcagcactttaccgggacattaccgaaccggatgagccggatgagcgcagagcctatgtgccgatcggcaagcatgtcctccctaaactgccatacagttattccgcactggaaccgtatatttcaagagagattatgaaactccatcatacaaaacaccatcagagctatgttgacggtctgaataaagcagaactggagctcaaaaaagcgagacaaacgaaacagtacgacttagtggcgcattgggagcggcaattggcgtttcacggggccggccattatttgcacagtattttctggttttccatgaatccaaacggaaaaagacggccgacgggtgcgctctttcaaatgattgatgtgtcattcggaagctattctgcttttaaagagcaattttctcaagcggcgaaaaaagtcgaaggagtcggctgggctatcctagtctgggcgccgcgcgccgggcggctggagattttggccgctgagaagcatcagctctacagccagtgggacgtcattcctttgcttccgctggatgtgtgggaacacgcttattatttacaatataaaaacgaccgtgcggcttacgtggatcaatggtggaatgtcgttgattggcgggaggcggagaaacggttcgaacaagcgcaccgcgtgatatggccgctttattaaaaaagcccccgtcttgaacggggggcctgcttcttttggtctaaaaaataccaagcacgtgcagaaaaacgataataatggctacaggagccacataacggattaataggagccagactgcaaaccattttcgttttataccggaaccgcttttcagttcgtcaaacagcatctgtttcgaaattttcagcggtacgaaaacggcaattaaaagcgcgcccagcggcattaagacattgctgaccagaaaatccgcagcgtcaaaaatactgcggtgaaaaatagaaacatcactcaaaattccgtacgacagcgccgaaggaaccccgacaataaatatagcaagtcccccgatccatgcataccgcttccgttttgccgaatcgccttttgacaaaacagcaactaaaatttcaagcattgaaaaagccgatgtcagcgtcgcaaataaaaacagcagcaaaaaggcgagtaaaaacacgatgcccaacggcatttggttaaagactgtcggcagcacgttaaataaaagctgcggaccttgatccggcttgaggccgaatgcaaataccgccggaaaaatcgccactcccgccatcacggcaacaaggacatttaataccgtcaccgatacggcggattgaacaatattttcttctttttctaaatatgcgctgtatgtaaccattacggacactccgacgcttaacgagaaaaatgattgtcccatcgcatataaaatggtattggcatccatcgcgccaaaatcaggcatgaagaagaattttaatcccttcgctgcatcatgcagcgtaacggaacggatcattaaaagaataaacagaataaacagagccggcatcagcacctggcttaccttttcgatgccgctgctcaccccttttgccacaactaaaatcgtcagcacgataaacagcagctgaccgaaaaccgctgcataagggttggaaatggtatcgataaataacgtatcaaatcccgaagaaagcgataaaccgcctgtaaagccttttataatgtagattaatatccatccccccactacgctgtagaaggacaatagaataaaacacgtaatgattccgagatatccgatccagtgccactttttccccggcgccagcgccttataggattcaacggcgtttttttgtgtttttctgccgataataaattcagcaagcaaaagcggcagtccgattaaaacagtaaataaaataaaaacaagcagaaaagcgccgcctccgctggttcccgctacgtaagggaacttccatattgcgccgagcccgattgcagagccggccgtagctaaaataaatcccagcttagatgaccattgattagcttctttcacttcagcactcccaattcatttcagtataaaaatcaattgtaagaatatatgtctgaatagtcaagaagatattagtttacataataattttatcgaaaacttatatttaatattgaattattcagaatattatttataatggagtacagaaaagtcagtcatattttctgactgattgattggatataaaaggagctgtgtttatggaatggctgaaaaaaataagcgggtttgcgggccaaacctttggcttgtgggttatcgtctttgccggtttgggattcgcctgccctgatttgtttacttggatcagttcttatatgacgattttccttggtattattatgtttgggatggggcttactcttcaagcagacgattttaaagaattaatcagaaagccttggcttgtcgtgatcggggtcgctgcccagtttacgattatgccgcttacggctttctgtttatcaatcgggctccgcctccccgcagaaatcgccgcgggcgtcattctggtcggatgctgtccgggcggtacggcatcaaatgtcatgacgtttttggcgaaaggcaatacggcactttctgttgcggtcaccacgatctcaacattgcttgctcctattgtaacgccggcacttattatgctgtttgcgaaagagtggcttcccgtttctttcggttcactgtttgtttccattatgcaagccgtgcttttgccgatcgtcctcggggtgattgtgaagctgttcttcaaaaaacaggtcggacaagccgtgcacgcgcttcctctcgtatcggtaatcggcatcgtagcgattgtatcctctgtcgtcagtgtaaatcgtgagcatctgcttcaatccggactgctgattgtgtctgtcgtcatcttacataacggaatcggatatttgttaggattcctgactgcaaagctgttcagaatggattatgcttcacaaaaagcgattgcgatagaagtcgggatgcaaaactccggactgggcgcagcgcttgcgacagcgcatttctcccctttgtcagccgtgccgagcgcaattttcagcatatggcacaatctgtcggggtctgttcttgccacctactggtctaagaaaaaagagaaaaacagcgccgaagaagaaacggcaaagattccgttttcataactgaacaaggataggctgctgcagctcctatccttgtttattctgcagatcacgaaacaggcgcaaaagcgctttttttacatccccctgaaataaacctccatgataacaaatcaattggcggatatcgtaatcgagcagccgctgcacagaacggaccgcatcatccatatgtaacgtatagccaggattagcaaggttcagctttccgtcttcaatgacgaccgcatcacctgtgatcattgttttttcggcaggcagataaagactgatatggccgggtgtatgacccggcgtggctacaacgcgaatgcctccgcaccaaggcagcagctcaccgtcagtaactgtccggtgaactggagccgattcgactgattgaagcgagcggatgaactgttttgcataaggctttgcatcctctggcaatgaactaaacgttgattcagcctgctcaagccgtaaagattttttagagccgtcaatatacggcgcttcacgctcatgtactgtcacgctgatatccgggtgcaaacggtgtaatgcagcgagtgagccgatatgatctatatcgtgatgcgttacaatgatttttgtcaatgaatgaagcgacattccatgccgggcagcagcatgttgaagatggtttgtaaaaccgggatatccgcagtctattaatatcgtgtcatgttcgtcttgcagaagaaccggagtgattgaatgcaattcttcattatattcaaattcgatctcaagcggataacagcttttcatataaattctccccttcgctcaataaaaaaagtacactgcttgtaagggcagtgtactttttgtctgtctcaaattatccttccagcagcagctgttccggatcttcaagcaggtttttaatggtgacaaggaacccgaccgcttctttaccatctacaattctgtgatcatatgataaagcgatgtacatcatcggacggttttcagagcgctccgcatcaattgctactgggcgcagctgaattttgtgcatacctaagatcccaacctgagggctgtttaggatcggtgttgacataagcgatccgaatgtacctccgtttgtgatcgtgaaggagcctccttgcagctcacctaatgttaatttattgtttcgcgctttcttcgcaagttcgccgatctctctttcaatgccggcaaacgtcaggcggtcagcgtcacgcacgactgggacgacaagcccttcttcagccgcgacagcgataccgatgtcatagaattttttcacgatcagctcatcgccttgaatttcagcgttaaggagcgggaattttttcaaagcagccacgacggcttttgtaaagaacgacatgaaaccgagttttacatcgttttgctcaaggaattggtctttacggcgttttcttagattcataacagccgtcatatcaacttcgttaaatgttgtcagcatcgcagaagtctgctgcacttcaaccaatcgtttcgcgatcgtctgtctgcggcgggacattttttgcacttcaacaggtttgtcaaagctttgctgtgttttttgagcctgctgtttcggctgtgccgcaggttttgaagccggtttttcataagcttccacatcttgtttgcgcacgcggccaagcgggtcccccgtcggaatttgtgatagatcaattcctttttcccttgccagcttgcgtgcagccggagacgctaccgttttggatttcgcttctgattgtgcttcctggctgacttcttgtgcagcaggttcagcttttgcttcctctttcgtttgttcattggctggagcactttctgaaggggcgggtgcagaactttcgccagcgccttctgtaatggtaccgataatttctcctacttggacggtatcacccgaatctttcaatacctcttttagaacacccgattcttctgctgtcaattcaacatttactttgtccgtctccagttcaagcaagtactcaccctgttctacataatcaccgggctgctttaaccattgggctatcgttccttctgagattgattctgctaattcaggtaccttaatttccgccatttttacatttcccccttagtttttgcgagtcaagctatcagatacaatgcgttcctgttcttttttgtggactgtcggatctccttctgcgggactggatcgtcttcttcggccgatgtattggacatttactccttttggcgcaatttccgtcagatacgggctgatataactccatgcccccatgttctgcggctcttcctgaacccaaacgatctcttgcaggttcggcagtttggcgaaaagctccttcgtatcttttgccgggaacggatacagctgttcgattctggcaatatgaagccaatccttatcgccttccattttgttgaagtgatcgctgatatcaattgacacttttccgcttgataatacgacgcgagtcactttttcgtaagcatgggaaagaccggactgctcatagacaggcttgaatcggctttcgctcagttcctgcacttcagataccgtattcgggttgcgcagcaggctcttcggcgtcatgatcacaagcgggcggatttcctcacgaagcagcattttcgcttgtcttcttaaaatgtggaaatactgagccgcacttgtcaggttggccactgtccagttgttttccgccgccagctgcaggaaccgctcgacgcggccgctggagtgttcagggccctgcccttcgtaaccgtgaggcagcagcatgaccagccctgatttttgtccccattttgcccgtcctgcagatatgaattgatcaaaatagacttgagccgcattggcaaagtctccgtactgcgcctcccacaacacaagcgtttcaggcgaatacacgttgtatccatattcaaagccgagaaccgatccttcagagagcgggctgttatgcaccgtaaatgaagaagcgcagtcgtctaagtgatggagagcaacaaattcttctcctgtttcgctgtcatgcagcacaaggtttctttgagcgaacgttccgcgctctgaatcctgcccggtcagccggatcggcgtgccgtctttcaaaatggaagcaaacgcaagcgattcagccaatgaccattcaactttacggtcatcatcaaacgcttttgcacgtctttccaggattcttttcagcttgccgaacacgttaaaggattccggccagttgataagttcgccgttcagcttgcggagaacatcaaaatcaatggctgtgtcaacgtctggaaaaccgttggacaccggttccggcaattcaatttcccgtacggcgtcttcttttttggcgggcacctttttataggcgtcttcaattcgttttgtcactgccatttcgatgttttgcgctttttcctcgctgatcagtccttcacttacgagtttttccgcaaagatccgcttgacagtcgggtgttttctgacggcatcatacagcatcggctgtgtcgttgacggctcatccatttcattgtggccgtatcgtctgtacccgatcaaatcgattaagaaatctttattgaaccgcttccggtattcaaccgcaaatttaacggctgacaggcatgcttccggatcatccgcgttgacgtgaacgatcggaatttcatagcccttcgccaaatcactggcatatttcgttgatcgtgattcatcgctttcagtggtaaagccgatcatattattggcgatgatatgaatggccccgccgacctgatagcctttcagagagcttaagttcagcgtctcggcgacaatgccttctcccgggaacgctgcgtcaccgtgaattaaaatggcgagcgattttgtttcatcttgaaccgggtaccccttttgcgttcttgtttcctgtgccgcccgcgtgcttccttcaacaatcggattgatgaattccaagtggctcgggttatttgcaagcgtaatccgcgcgcttttggtttcagcatcctgaagctgtctgtctgcaccgaggtgatattttacatcgcccgtccagccgtagctgatgccggtcgatccttcagatggcacaaggtctttattcggtgcgtgctggaattctgagaaaataatttcatacggtttgccgagcacatgcgcaagcacatttaaacggcctctgtgcgccatcccgatattgacattggttgtgcccgctttcacagactgggcgataatgtcgtcaagaaccggcacaagcgcgtctaatccctcaattgagaaacgcttctgaccgacgaatgtccggtgtaaaaattgttcaaatccttctacttccgtcagtctttctaaaacggctgacagtttttccggtgaatttttccggaacagttctccggattcgaccatttttgtaatccatgcgcgctcttcgaaatcatgcacatggtcaaactcgaaagagatggttcttttataggtattgcgtaaatgctggatggcttctaagccgtttgttatattggcaggtgcgtctttacagatgacagacgcgggtattgctttcatttcttcttctgtaagcccgtactcggataacggaaagagctcgctctttttcggatcctttctgagcggattgacggaagcgttcagatggccataggttcgaatatcttctgcaagtttaactgctgctgcgatcttttgaatcagatctgcggtgacgcgtccctgttcctttgtttccgatgcctcttttatttggcttggcggagcgccgagttcgtcaaacatgtctttcagatccggatcaatgctgtctggatcttcagcatattggtcgtacagctccagtgcgtagccgaggttcggtccgtaaaaatcttcccaattcattctttgtttcatattattttgaaacatttgaatattacccccaacctagataatcaagtgatcaattcactatcttgaaataacttttgaacactgtgcccaaaattatgtaataaaaacgcttccaaggatattttaccactgattgcgtttggattctaccttgattgttcacaaaatagtaaaaaaaacagatcaataccgaaaaaattaaatcattttaaaataaaaagcgaaaaagcataggaaaaagcctatcctatgcttttatgaagcagttttttcaagagcggatacagcacatcgggcagctgatcgacatcgggaacaaaaatactgtactttccgtacatatcctgaatggttttcatctgggattcttctatcgcagtattggacagaaaaacatttatgacttctatccctttttttctcgcttcgatgacagcctcgctcgtatcgacgatgccgttttgttcgtatccgaatgctgccggctctccgtctgaaaacacgattaaaaatttttgcgcctcactccgccgcatcagctgtttcgtcatttgtctgatggcgtatccgtctctgttatcttcttcaggcgcaagctgcatgattagcggacccgcagcctgcagcagcgactcttcaaacggaatgacggtattgaagaaattcggctggctcgtttcggttgcttcgtttgtatcctcccaaaatccgacgatttggtgagggacggacactgatttcaaggcttcatgaaaaagaacgatccctctttttgtttcatccattttgtcaaacatgctggccgaacaatcgacaagcaatgtaaaaacggcgtcaatgtctgaagacgggtcctgctttttatagaaaaggcgcgggttccgttccgtaaaatagcggatcagtttgcgattcagccggcctgcgtgaaggtcggtccgcgggagtgtttttttgtgctcaagtgttttttgtatcatctgcttcaggcgtttttgatatgattctatcgtttttgcctgttctttataagactgctcctcttcaggagacgctttatgaggcgtttgataaaccgggaaggcaaatttgttttcttttccgtcagccagcccggcgccctcatgttcatcctgaatggattcaagcgcttccagtttggagtaatcctctcttttcgtctgacgtgcggaaccttgaacggagccgagcgcctggtcaccgtcatcgccttctctggccgcgtctttcccaagatctgatttcgcgccgtgctcaatatcaaattgaaggaagctttttgacggcgcttcggtttcccggtgccacgtattcattttctcttcaaggatctcttcatctccgtcggaagactcagggagcgtgagatcgtcacttaatgaaggcgctttttttacgctttcgaataaaggctcttcagcagctttttcgtaatcaagttccggcagaaaaaagtatgtgttcagcatatctttctcaagcacttcatcaaggccttccatgaggtcttccgttattgttgcgatttgttcagtagaatccgcctcatacacccggatgagctgacgttcaatatacggtatcatcatatcaatattttcatgcatggaaggaatgccttcaagcggagactcagccgtcagcttgacaaacatcgcgcaatacaaagcgtcggtgaaaatgctccgttctaaattcagtgtcagctgcgtcgtgaaatatttcctgtacatctctctccgcttctgaaaaacacgtttcgttcccggccgttcttttttgatcagctcttcaattctgatatcctcaagcagcataaacagctgcttggcaaagctttggcgggtgaagtgccggtgaacgtcatttaaaaaccccgcaaatacccgaaatgagctgctgcgtgtcccgacagcgcgcaaatagacatcgcttttcaggccggcttccatatccccggctgatcggtcttgccaaaagtggctcatgtaaattttcttttcaaagggattgtagtaagactgcacgccgtattccacttcaacttcactgcttctggtcagtgttttggcaagatcagtcagcatcatgaacaaaaacgaatcaatcgtgctgtcgttaaatttgataaacttcattgtatatccctcattcgaacagcgtttctgcaatatttctgacagcggctttttccctgtcatcgtcaagtttttccacgatgcctctttcaatcgcccgtttcggcgggatgtacgcagccaagtcgcacgtatcaatgagagccctgatggatgccgcttcttctgacacttgtccgttatgcgcttgtgcgattaaatcagaagacagcgtcataaagcgctcaattaatttctcatcttttaagacagactgagaggtcagcacctgtttcaggaggcttcctttaatatacggaacatcaatgattacaaaacggtttttaagggcttcgttcagcggaacggtgccgacgtagccttcattaatcgcggcgataacaccgaatccttcgcttgccttaatcacttctcctgtaaagggatttgtcatcatttttctgtaatcaagcacgccgtttagaatcggaagggtttcaggctttgccatattgatttcgtcaatgtataaaaaatgtccctcgttcattgcggttgttacaggtccgggaacgaattcaattgtcgcctgcccctgttcattttcaatcgttttatagccgacaagcgcttctgcatcgaggtctacggagcagttgacgctgtgcatcggtttatgaaaatagttcgaaagcgtttccgccaattttgttttccccgaacccgtcggtccttttaataagatattttttcccattgtcaaagcgatgacggcatcgaatacaatcgctttatcttcggcctcatagcctgatgatccgattaaatcccggaattcttgggaaacgggatgattttgataagcctgcagtttgttttgtatatcttccggaagtgataggtgctgtaattctgaagtcataggtgatgtttcctttccatttgtattccataaccgagtatactaaaaaagcccttgtatactcaatacaaaagggctcattccctgcgggcgctttttgtcaggggagcgcaggcgattctggctccggaatttccgctcgggtttgttaaataatcgtccgtatgttcatgaatgacgaacgcgcttccgtcccggtcgagcaggctgagtctgctcccttcttttaatgaagtttgcggcgcgttcataatgacatccactttaccgtcagcccccacttcaagattggggagatccccggcgtgatgacccatcggattgttgaagccgtgttctttgttcaaagggttgaacggaccgccggctgattcgaaatcaggtgcctgacatgtccctttttcataaatatgaaatccgagagaagcgccgggcggcagatgtcccgctgatatatgaatgtctgacccttcatcatcagattccctcacttcgatatatccgatcgtttttccgttttgattgatgagtccggcatgctcacggtatgcagatgcttccaatgcgcggctttccccatgttttttgggcggaacaggagcgggtctccccccgcagccgcaaagcgtaattgatgcgagcatgagaaaaagcaagagacgattcatgcttcctcccccttatttttttacccatcagtcttgtcaaaacgtgaaaatggtaaacaaaaaaaagccccgaaaggctttttttaaaaataactgcgcgctcctaaataagcttttttccaatatggattgcttaagtttgaaatttcaaccccggaggagcttgcgtgaataaagtctcctccgcctaaatacattcccatatgagaagggcccgctttatatgtcgtaaagaagacaaagtcgcctgctgacggctggctgatatgtttcatcgtattccaatatccggccgtgctcagacgggaaacagagcttaccttatttaaaaggtaatagatgtaaccgctgcaatcgaagcccgcaggcgtattgcctccccagcggtaaggtacgccgacatgttttttcgcctcgcctatcattctgtcaatctttgaccctgtcaccggaggttcgggagtatttggcttgtttggcttttccggtttgttatccggctgacgcacaggatcttctgtttttcccgttccgttaatcaccagaacctgtccgatttgaagaacatcagttgtcagtttatttttgtctctgatgagctgagcggtgataccgaaccgattagcaattttccagagggaatcgcctgcttttactttgtaagtggatggcttctcagaaggatttgaatgagatggcggtgttgtgccgctgtttccgttatgtgaagaacctttgatctttaatacttgattcggatacagcatgtctgatgttaattgattcagctttttcagttcggcgatggtgatgccggtttgattggcgattttccacagcgagtcacccggcttcacagtgtaagtccctgatgcgcctttatcaggctttgtctgtctgccgcctccgtccgtgccgccggcagaccctttaattttcagtttttggcccggatagatgacatctgaactcaaacggttcaggcttctcagttcagaaacgctcattcggtatttttttgcgatcacccataatgagtctccgtatgtaactgtgtaggcacccgtgcttggttttcccttttgccccgttttatgtgtgccgctgccgtcgggaatgtgcagccgctgtcctgggtggagtatcgttgatttcagtttattttccgcctgcagagctgaaatacttgtatgatatttccgggaaagcttccaaagagagtcgccgctttttacttgaatggtttttgcttcagcgggatgcacggcgaaggttgaagtcattactgcagatacagccagtccggctgcgatttttttcttcatataacgaaaaacctcctatttatcattgctgaaagggacgtcccttttctttggacgccgcctgttatgcaggattcattcagaagtcgacattaattccgattcatttggtcttagatcatcaccaatgccacacattttacataaattgagaacatttcacaaaagactttggaatcattttcataacatggcttttttccgcgacattccacctttcttgtctgtttttcatacaattctctttacggcgtggaaaatcctcccgaaaaacaatcaaaaaaagcccgcttcctttaaaggaagcgggtgacggctgattacagaacccgggtctcggcagttttcacgtcttctgctatcaattccgctgcacgctgtgctccgccggccgctttcagggattctccgatttcagaagcttttgtctgatattcaggattttcgctcaattcttttattgcttcagtgagcagctccgctgttacatcttcttttttaaacatcttgcccgcgcccgtgttttccacttggcttccgacggcgaactgatctgcgcccatcggaatgacgatcatcggagttttgtagtaaagcccttcgctcgtactgttcattccgccgtgagtgataaataagtccgctctcttcaggatctcaagctgcggaacataaggctttacaatgacattctcaggaatttcatcaagctccgccggatcaagatgtttgccgattgacatgacggcttttccgttaaagtttctgaccgcttttaagcatttattaaacaattccttctgattgttaaaaatcgtgcccattgaaataaacaggactttttctccttcaagctggtcaaacgggaaatcctgagccgccggcctttcagttatggacggaccgacaaagagataagaatcgccaaactcttcttctttcggctgaaacgctcttgaagtaaatacgatggtttttctgccgtcatttgagaaaatatcatacggcgttttaatgtctgcgctgaattcttcattgagccggctgaccgcttcggtataagccggataatgagatgattcctctgatacaaggtttgtatttgaaaacacttctttaataaatgcttcattcattgcaaatgtcgtgcaaagtgaatatgccggcagtttcagcttatttctcacaagccttcctgccagaaaatgatgatcatacaggatgtagtcgtaggactcatcttttacttcctcaagaatacggagtgcggctttttcggaagtctcaatcattaatagcaaaaactcggtagcgtcccgctgttcatcaccagttgcgttttttccgaattcatcttttcggaaatcttcatattcacggaattccgctccgcttgacgcgattttgttctcatattccttcacgccgtaatatacgacatgttccccttttgccttcagttcttttacgacgcctaaagacggattgatatggccttctcccggaaagccgatcatcaatacatttgccatctttccactccctattcttttaaattttatgtatatttaaacgataacatcaatacagaaaaaggtaaagatgttcaccttattaatattaaatgggtacaatattcccattttcttattatttcgtatgaagcgcccgcggcgaaacaagcggatacagtccgccgtctttagcaaaggacattttccccgtttcttctgaaacaacgagcacgagtgcatcagtcacggccgaaagtcccatcgcggccctgtggcgcgtcccgtatttgagattgacatgttttgttgtgagcggaagcacattggctgctgatacaacccggttttctctgaccaatacggctccgtcatgaagcggattgccgggataaaaaatactctcaattaaagctgaactgatctcggcatgcaggctggtccctttttgtatcattccgtccagcggatctgcacgttcaatcacaatcagcgctccgtgcttttcttccgccagatgctgcacggccctcgccagctctgtataggaaggcgtaaaatgttcgatatatgactgcaggtaaaacgacgaagcgacagcctgcatttcctgaaacgtatgtcccagttcatctaattcgcaaagaaggcattggtctttttcatccaatgtccgcagtatcattccggcatcctccgtaatttgtttcaaatacgtttgaacggcagcggtaaacgcgctttccgtcatttgagtgtggcgcatgtcacatcatctcctttcccttattttctgcatcgcgcgcatggatatgcgccgctgtgtacaccataatcatgaaaggaggcgcacatcatatggaattcgcacggctgatgcaatatatctgcacctttttaggggtcatttcactttcattcatttatgccaagatgtttaaaaagccgaaaccggacaaaaaagagtaggccggctttcattgctttttatacataaaatgttataatttctctcgttaaaataaagaaacggggaacctaaattgagagaaacgaacacgatcggccaaaaggtcagacagctgttacatatcttcattccgattttaatcacgcaggcgggcctttccctgatcacctttttggatacggtgatgtcagggaaagtgagcgccgccgatttagccggtgttgcaatcggttcaagcctgtggacgccggtgtatacgggccttgcaggaatattaatggccgttacgcccgttgtttcgcagctgtttggagccggcagacgaaaggaagtgccgttttccgtcatccaggccgtttatgtagcggccattctcagtgcggcggttatcctgatcggctttttcaccgttgatatgatcttgggacatttgggcctggaacctcgtgtccggacgatcgccaaacactttttaggctttttatccctcggtatttttcctttgtttgtgtacgccgttttgcgctcgtttattgacgcactcggcaaaacgcgagtcacgatgcttattacgctttgctcattgcctattaattttgttttaaattatgtatttattttcgggaaattcaacatgccggcattgggcggagtcggtgcggggctcgcttccgccctgacttactggtgtatttgcgccatcagcttttttatcgtcttcagatttgagccgtttgccgggtactctgtttttcggaaactgtaccgtttttctccgtctgaatgcagaaaacttttgaaaatcggtttgcctatcggttttgcggtattttttgaaacgagcatttttgcggctgtcacacttctaatgagccatttccggacggtgacaattgcagcccaccaggcggcaatgaattttgcttccctcttgtatatgctgccgctcagcgtatctatggccatgacgattttagtcggctttgaagcaggggcaaagcgctacagggatgcccggtcatacagctatatcggcaatgtgatggccctttgtttttctttatgcacggcggctttcattttactgttcaggccgcaaatcgccggaatgtatacatcagatccggaggtgctcatgttgacgcagcactttttaatctatgcgctgtttttccagctttctgatgccgtagcagctccgatacaaggcgccctgagaggatataaggatgtcaactatacactcggtgcggcttttgtttcgtattggattatcgggcttccgctcggttacgcagtcggcacttacacgagcctcggggcatacggctactggatcgggttaattgcaggacttgccgcaggagctgtcggtttattcttcagactgatgaagctgcaaaagcgttatgtgaaaaaaatgatgattttataaaggaggagcagctatgccaaaacataaactgctgtacgattatttaaccgaacgggcggaggacatcagtcagacatggtttgatacccttcatgatacggatcctgattctgtttatgcttctactgacccggctgttctcacaaatttgaaaaaacaaaatctggcgtttaattatcaactcaatcggattttttctgaagagaaggaagtatatacagcggcattggaaaagtgggcgtttgaagccgcacgggataaagaacatttaaaaactcccatccattacatcattcgcgagtttatcagagttcgtgatttgtatgtcggccatgtaaagcagtttaccagacttcattcagacaccgtgacagaagaagatgccgaagatatattccatacgctgattaaatcgtttgatgtggtcattcatattttcatagaggaaatgtataaaaacacaaacattcagcttgaagcgcaaaaagaattgattaccgagctgagctcgccggtcattgtgctttttgacaatgtcggactgctgcctctgatcggggatattgacacggcaagagccaaaatgattttggagaatacgctgcaccagtgttcagagaagcgcatcacgcagctgtacattgatttatcaggcgtagccatggttgatacgatggttgcccaacagcttttcaccttaattgaatcactcggaatgctcggcgtgaaagcgacattatccggaatccgccctgaaatcgcccaaaccgcggtacagctcggactgagtttttcaaatttatcaatacggtcttcgcttgcggaagcgatcgcttccgatctgacacaaaaaaagggataaggcatttcagccttatccctttttttatcagtctttccacggatatgtccaatacacttcttcttcaaaccatgtctgaagaaccggctcgttatttttaattttttcttccagctctctcagcatgccttccgtttgggtgcggtgcgcttttaaggcattcattttaatatcggcaacctctttaatatcaagaatgacatcaggcttgccgacggcttcctccctgttgcgggtgattgccatgcaaagcgtgcgcgggcggtcctcttttttctttctgtaaagcgctctgatgaccgcttcgccgcatgcatcatgatccggatggacgccgtgctccggatagaatgtgacaatcagactcggttttacatcgtcgataatctcttccatcatatccgcgagccactcgtcatcttcaaattcaagtgttttatcacgaagcccgagcattctcaggtcagtaatgtccattgctttacatgcgtcaatcagctcttgctttcttaacagcggcagtgtttcacggttcgcgaaaaagggatctcccatgttccggcccatttcgccaagcgttgcgcatgcatacgtaacgggaatatttttttgtctgtgtaaagcaatcagtcctgccactccgtatgattcatcatcagggtgaggcaggatgacgagtacatgttctttcatgattttcacccttttctttaaactgtaaacggcttttcgctgatttgaagcgaaatcgccaattttccgcccggcagatgccccgccattaacaaacggtcttcttcatctactgtatactcagtcaaaccttctgcgtaaatccagccctcttctgttttcaaaccgacgcggtacgggccgtttcctttgattttcgcctgatggtacgtcacttttgcattgcgtatataggctacaaccgtcatgtttttctcattcagatgcgctgaataagaaccggtcgttgtttccaaatggatatatacaggacgatcggcatatcgctctaaagaagtttgcacatcttcttttatgatcgctttcatagctgctcccctctttcttcttttaaaaattgcaaacgcttcgtatgtagttcaaccaattcatatttctcaatcggccgcagccgggaatctacaattcgctgcaccgccagagcaaacttttcctcgggtgacttccggagcctcggatgtgttctttgatcaagcagttcaagatcaatcgccttctccgcttcttcaagggttgaagccgggagagtgcggttattccacagtgcctgataggcttttgctatgtctttatcagtgcccattgtacagctcctttacatactcgtaatgattatacataatttaagctatcgctggaaagcgaaaggcttagcggctttttatcggccgcttccattttatctgtgaaaaggtaaacaaaagcaatgctgcccatatacaaatgaaggtaaacgctttttgcccggaaaacggttcatgatacacaaacacgccgagcataagggtaatggtcggcgctatatattgcaaaatgccgacttgatacagcggcagacgctttgccccctctgcaaacaataacagcggcagggccgtaaatacgcctgcgaaaaataggagcgcccatgttcctgcccccaaggagccaaaagtgctcccgtcagctgtaaatcctaaataaataagtgcagccggggtaatcaaaagcgtctccagcgtcagcccgatcgtgctggacatgcgggttctttttttacataagccgtacaggccgaagctgaatgcaagcagcaatgcgatataaggaaccgcgccatattgaaacgcagatatgagcacggccgccccggcaatagaaacggctgctgtttgcatcttgttaagcttttcttttaagaataggatgcccaaaagaacggaaacgagcggattaatgtagtacccgagacttgcttcaagcaaaaagccgtgattgacggcccatatgtacacaaaccaattaacggaaattaaaacggaagcgaaaaaaagcgccagcaggcccccttccgatttcaaaagacgcagttcacgccatccggttttccacttcttaagcacagttaaaagcacacacatgaaaacaaatgaccataaaatccggtgagctaaaatgtccaatgcgggtatttgttcaagaagtttccaatagaccggaaacagcccccacatggcgaaagaacaagcggtataaatgattccttttcttacgttattcccttgcacggccttccccttcctttctgtaaacagattatattatatcacgggaagcttccggcgggcatatactatgttgtccgttaagaaagggtgagatgccgtgtttgattggaacagatattttcccttccaaaatcagttctctaaagaaacgtttaaaaatgctgatccgaaagatgtcgagacatatgtcaaccgagtgatggaaagcgtattcggcgccggttatgccggacagttcccttttcgcgacccgatgtccaaaaagaccgatccggtcgaagcggaaccgcccaagccggaaattgacctgtttgaaacatccgatcatgtttttgcgaaaattcccgccgaacaagaggaactcgaccgtatcaggattaagcatacgtcacacagcctcgttgtagagaacagcagcctgggagaaggaaaaaaagaaatcatacttccgagcctcgtcaaacggaaaggaacaaaagcagtctataaagacgggatgattgaagttatgttttcaaaacaggaagactacaatctatcggaagtggagattttaagataaaaaaacggcccgcgcgatgcaggccgttttttctttaataaaatggcggataaccgccggctcccggcccgaaaccgccgtatgggacgcctccgtatccgtaaccggcgaacccgtacggaaagcggggtcttgtaaaacctgtggcaatcacgcctccgagaagaccgcctaaaaatccgccgaataaaggagcgccgaacaaaaaaggacttctcgccggaaatccggcaggaccgaaattcccgcgatacaatgcatgacgagggtacatgtttttcctcctttatgtctgcctattcttaagcgtattcataaaatgaggaaattgattgggcggttgtaacaacttgtgcctctctctgatattgctgttatactttttttacaagttgcgacattataaaactgtcagggggaataaaatatgccattacttcgttttgacgttattgaaggccgggatgacgcagcattaaaaaaattactggataccgcccattacgccatggttaaagcttttgacgtcccagtaacggaccgttatcagatcgttcaccagcatcggcctcatgagcttatcattgaagataccgggctcggtttcaaaagaagcaaagatcttgtcatcatcagcattgtcagcaaagcgcgcaccgaacatcagaaagaaacgttatatcaactgatggctgatcagcttaaaacagaatgcggcatatcacccgaggacgtcatgatttccattacagaaaacgggaacgccgattggagcttcgggctcggtgaggctcagtttttaaccgggaaactgtaaaaggcctccccgcttgttctgaatgattgcaaactgaataaaagagggatgtatgttggttagtgagttgtatccttgtttgatatgcggatttaaaggattagagacaaatcccgtttataacggcgaatatcaaaaaacatttgatatctgcccttgctgcgggtttgaattcggctacagtgaggaccatgacgtaagcttagggtttattgtaacgcctgatcatttaattgaagcggcatttcagttataccggaaacagtggattgagggaggaatggaactattttctccaaacgatgttccggcggaatgtaaaaatgatcatttccttacattcgatgctttattaaagcaattaaaaggcttgaacctcaatctgaacaattttgatattaatggtttttatgacgattaaacattatcattaagaaaaggctgccttgggcagcctttattattcatcacatgtgtcgttcgcagatcccccgggctcgcaaaaactgtctgcccatttttgcatttcctgaaaaacggcttgcagggccatgcctttatcagtcagtttataaatgactttgacaggtgtttcaggcagcacctgacgctcgacgatttcattttgttccagctctttgagccgctccgcgagcattttttggctgattgtcggtatcgtttcggtcatatctttaaatcgtttcggcccgtccatcagtacatggataatgaggccgttccagcgctttcccaaaagagaaaaagcggattccattttaggacacattgtatatcccacgtgagttcatcccttcatctatgaattgacaagttttttgtgatccattaaaattagttttcgagttacatttagtaagcttctaacttttctattatgataacacgtttatccgaaggaggaaacatgatgacatccgtattagacgttttaaaggaacgcgcatctgttaaagaatacgataaagacgcggtcattacaaaagaggaattgacagaactccttgaaatcacaacgcaagcgccttccgcctggaaccttcagcattggcattttcaagtctttcacagtgatgaagcaaaagctgccctgcttccggttgcttttaatcaaaaacagattattgattcatcagcagttattgccgtattaggcgacttaaaagcaaatgaaaatggtgaagaagtttatgctgaactggctgagcaaggcaatatcacagaagagattaaacaaacgcttttaggccagattaacggtgcataccaaaatgatcagtttgcccgcgattcagcatttttaaacgcttctttagcagcgatgcagctgatgcttgccgctaaagcaaaaggctacgacacttgcgcgatcggcggattcaataaagagcaattcgttaaggaattcgacgtgagcgagcgtttcgtgcccgtcatgctgatttcaatcggtaaagccgttaagccggcgcataaaagcaaccggctgcctgtatctaaagtgtcaacttggctgtaagatgaaagaaacccttagtccgcttaagcggactaagggttttttataggaatcgctcactgtaccaggctcgtgcctgctcggcttcctgctgtgtgagctgatgaccgccctcctgccattcaagagcaacggatgcatgagcatctttcagatactgataaagctcctccgattcttcttttgtacataggggatcgcgttttcccgcaccgataaacacaggcagcccttccatatcaggcagcttcactccgcgtatcggcaccatcggatgatgcagaaccgctcctttcagtacatctttataatgaaacaaaagacttgctgcaatattggcgccgtttgaatagccggcagcaatcacgttttctctgctgaacccgtacatttgcgccgcttcatcaatgaaattctttaattcttccgtccgttcaattaaatctttctcgtcaaatacgccttctttcagccgcttaaaaaaacggggcatgccgttttctgacactgatcctctgacccctagcagacttgcgttcggatcgataaaacgtccgagcgacagaagatcatgttcatttcctcccgttccgtgcaaaagcagcagaacattttctgacgttccctgttcaaacacatgtttcatcatcattctcctttctccattttgggcagaacagctgtaatctgactgcgatgctcttccagccattccggaagcttcagctctgttccgagattttcaaaggattcatccgtcataaagcccggttcatcggttgccatttcaaataaaatgccgccgctttctctgaaatagattgaagtaaagtaagacctgtcaagaatgtcagatgaagcaagatgagaatcagcaagaatgtccttccactccgcctgctctttttcgctcgtgcggaaagcgacatgatgaactgtcccgtaaccgccggtacctgcttctttcggcgcaaggtcaacatctataatatgtccgatccgtgcctccgattgcagcctgacaatctgattttcttctcctgtctttgaataaccgaagcgttctatgagaaattgaatggttgcttcaggacggtacgagtacagaagaacacctctcatgcctgtgatcgcttctttttcagtaatgcccgaaggagtccattcactctgtccgcttctttcatcttccattatggcaagcggcaggtcttctgtatcattaaagagaaggacttgttcagacagcatgatctgttcttttacagacaagccgttttcttcaagccggcgcttccaaaacgcgagtgctcctttcggcacggaaaaataaattcttccggcctgcccttttcccacggttcccgggcggcttccctgaaaaggaaaaaatgtaatgatcgtgcccggctctccgttttggttgccgaaataaaagtgataagtggccgggtcgtcaaaattaacggtttttttaacaagccgcaaacccagcacttcagtataaaaccgaagattttcagcaggatcttttgcaaatgcggtaacatggtgcaatccttgtgtattcaatgtattcactcctaaatatcttgagttcgagatattaactattctaatttaatatgaatgaagatgcaactaaagtgtttcagttaaaaaagtaatagaattcttttttttctgaaaaatatcttgtgatcttatctgacacctgctatgataaggagcattatcaagtttcaggaggaaagtaaatggtcagaaaagcactaattttcgttctcatcttaatccctttcagccagctggccctgctgtcagtcgctaatcgggttcatccgatcattatcgggctgcctttttttcatttctggctgcttttatggatcgcagtcactccattatgttcgtttcttatttataggctgcagaagaaacaaggaggactggactgatgcccgcaaatataacagcattgatcattacagccgtcatcgttttaaccgttgtctgtatcggctttatagccggaagagacaaatcatcacgtacttctgttgaggaatggtctgtcggcggcagacggttcggagggctcctcgtctggtttttagtcggcgcggacctctatacggcttatacgtttttaggcttgacaagcaccgcctacacagggggaagcgtagctttttttgcaattccgtattctgttttggcgtattttattgcttatttctttctgccgaagctgtggaaagtggcaaaaatccataaattaacgacgcttgccgattacgcccgtgagcgttttgacagtaagcttttggccagtcttgtcgccattgtcggcgttcttatgctcattccttatatttgtctccagctgagcgggattcaagatacgcttcaggtggccggaacgggtgtcattaatgtcaatatggtcgtcatcatctcttttattcttgtagcgctgtatacttttttcagcgggattaaagggccgacgtttacggcgattattaaagacattctggtgtgggtgattatgctgtttatggtcgtctcacttccgctgatccattttcacggctggacgccgatgattcacactttggctgaaaaagcgccgcaaatgctgacgattccggactcggggccgaaaggaattccttggtttatcacagcttccatcgtatctgcgctggcgctctttatgtgggcgcatgcggcaaccggtgtatttacggcaaaaagcgcagatgccgtccgcaaaaacagcatgtttctgccgctttataatattgttttgattcttgttatctttctcggctttatcgcgtttcttgtcctgccggaagataccaatccgcggctcgctttattgaagctgattcaaacgtcttacggaggagtcgcgcagggctttgcttactccacgatcgcccttgcgtcattgattccctgctctatcatggccatcggagcatcaaacttatttgcgaataacttatatcgggatttgattcacccgaatgtgtcaccaagcaagctgacgttgatcacccgttcaatggtatttgtcgtcatcgggctcgcgcttttattcggtatgctgttcccgactgcgctcgttacccttcagcttctcggtgtttccggcatggttcagatctttccggctatcgccgtcagtctgttttggaagaatcaaacgaaagaagcgacaattatcggtcttctcgtcggtcttctcgtcggtcttctcgtgacatttacggtaaatatcacccaatccgcccacggtatatatgaagggttttggggtttgaccgctaacatggcagccgttattatccttaacccgttttttgtaaaaaaagcgtcttcaaacgccgtcaaagacggtttattcaataaagcgccctctgataaactgaaccaaaaaggcgcttaacagaaagaagccggcacgtaaatgtgccggttttttactttttgtgctgccatttgtaggtggcgacggtttttgccgggatgacggcttcaaactgccgattttctgaaacgacatggaatttttgttctgaagatgtctggttgattacgactgtcacaatggattgatcaggattaaggaacgatacattcgagactgtgtttttggagccgtaattactttctatccgctttgctccccggtcgataaattttgaaaagttgcctgtcatatgaaagatcgggatattccaatagcggtcagggtttttagcatcctgaataaacagcgtcgggtctggggtgcctatccaatgatgcgtcttaatttgactgtcgagcatcgtcacccacgcattgtagctcgacgcgccgttgcggaaatactgtgcgatccgatccgcccctgccgtcccccagacagaccgctccgttaagtgaatagattgatcaggatatctctttccgatttccgacatgacagaaaggtcaccgtcataatcgtgaaaagcgatgccgtctgccgcccggtttccttttttatcatctaaaatcggcggaatatagttccacgccccgctcgcattgtgatcataaatccaaattttcgtgtcaattatgtgttttttcaattcttttttcacggctatcgccagtttgcgctgctgagacggcggcatgtacatgctcggatagtcgatttccagcaatggttcattttgaagggtcatcgcataaatcggaattccctgcttttcgtacgcctcaataaatttgcggaagtaaacggccagtgcgccgatatatttatctttcagctttccccgcttgaggttttcattcgttttcatccaagccggcgggctccacggtgaggcgatgattttcagttccggatttatcgccagcgcttccttgatggttgctgtaatgtgtaaatcaatatccttttggatcgagaaatgacggagcttaggatctgtttggccttcaggcatatcgtcatacgtataaaattcctgtgccgtaaaatcagatgtcccgatcgttatgcgcataacgtccatgccgataccatctttgggatcaaccaattttttcagcacttcttttctttttgcgggtgtcatttttgataaattatggattgtggattcttccagggacgatcctacgcccaacacactttgatagcggcgcgacggatcaatatacacggcggcggagtcagaagccttcttttttgtccatgtaagcggtgtttgttcgtctaaggcgtatttcacttccagcggcccgtcataccacgtacgggaagccggatctttttcagaactgaaccacacccttactttgtttttgtctgaagccttccgatcagctgcatacacttcggtttgcatgctgcttgatatgaaaaagaaaaacataagaaaaaccagggtcatgtgcagacttttttcaaaaaacatgaaccaccatccctttccttatttttataagcgattctaaatgaaaagccggacagtcacctccttcccgcttaaatgaatgcgctttcaaaaccactgataaaaagccggcttcacacaacggtgaagccttccctttttacacctttaggatacatatgcgccgtttgattcaatcacttttttataccattcaaatgagtctttcttaagccgcttcattgaaccgttgccttcattatcccgatcaacataaatcatgccgtagcgttttttcatttctccggttgtaaatgacacgatatcaataattccccatggggtatagcccattacatccacgccatcatatgtgactgctttttccaaagcttttatatgtgacgataaatattcaattcttgaagcgtcatgaattgaaccgtcctcttctaatgtgtcaatggcgccgaatccgttttccacgataaataatggaatctggtagcggtcgtataagcggtttaatgtgtaccgtaaaccggtcgggtcaatcgcccagccccaatcactcgctgtaatataaggattttccacgccgtttggcaatcctccgtttacgacatccccggtattatcgtttgatacgtcactttttacggtagtggacatgtaatagctgaatccgaggtagtccactcggccgtttttcaaaatctcttcatcaccgtcttcaaagtgtatctgatagccttctctttcaaactcttttaacgcatagcttggataatatccgcgaacctgcacgtccgggaagaaaaaacgctgtctcatcgtttcttcagccagcatcacatcatcggggtgagatgagtacgggtaaatcgggacatgtgataccatcgcgccgatcctgaactcgggattgatctctcttcccttcgaaacagccaatgcgcttgccagcagttcgtgatggccggcctgatacatgacttcttttgcgttttcgttttctttaacggcgacgcccgagttcgtccataaaaagatcggattattcacatccatcttattgttgatttcgttaaacgtcatccaatatttcaccttatgtttataacgttcaaaacacacttcagcgaatttcacaaaaaacccgactgtttttctgtttctgaaaccgccgtattccctcgccaaatgcagcggcatctcaaaatgtgacaaggtgattaccggttcaatcccatgtttcagcaattcatcaaacacccggtcgtaaaaagccaatccttcctcattgggctcggcttcatcacctttaggaaaaattctgctccagccgatggacgttcttaaacatttcaggcccaactcgctgaataatgcgatgtcctctttataacgatgataaaaatcgatcgcttcatgattcggataaaattcccgctcttcaattgtatctgttattttccggggcacaccatgcgcgcctgccgtcatgacgtccactacactcggccccttgccgcctttattccatcccccttcaaattggtgggcggccagagcgcctccccataaaaaatcttttggcaatgtccccatcgtgtatatcctcctttatttgactgccgcttgcatgccgaataaatgcactgcagcagcttcaaccatccgcttcacaagtgtagaagaattcctgccttcattttcatattatacgtttacattataattgtaccggtataatttatcaatacataaacaattatagttaatttacgaaatggcttttaaaaacgattatgctataattctgaaagaagcgggacaataaatgaatgaggaatgtatatgttaaaataccagcaaatcgcgttagatattgaaaaatacatagaagaacatcagctgcagcaaggggataaactgcctgttctgcaaaccttaatgacccggtttaacgtgagcaaaagcacaatcaccaagtccttagatttattagaaaaaaaggggattgtgtttcaagtgaggggaagcggcatttttgtcagacggaataaaagacaagggtatatcagcctgctttctaatcagggatttaaagaatcacttgaagattttaatgtcacttccaaattattagcgctggaagtgagaaaacccacgcctgaggctgcccaaaatctgaatatgccgcctgacggcgacgtgtattatgtcaagcgaatccgatatattgacgggctgacattgtgtatcgaagagtcattttacaacaaatcgattattacgtatttgaataaagagatcgtggcagaatcaatatttgattatattagagaaggtctcgggttaaagcgcggtttttcagatttatatctgtacgcggggatgttaaatgaggaagaagcggagtacttaggtctgtttacaggagcgcctaagctttgcgttgaaacgatttttcatttaacaaacggccagccgtttgacttctcaaaagtcacctatcactatgagcaatcacagtttttcattcaggcgaacagccacctttttgaacaggaaacgacataaggcgggcttttcgcaaacaaaaaacaccccatgcgcgagcggcgcatcgggtgttttttactatttcatattcttatttaatgtttcaacggcttttttcatttgtgtatcgttgtccgcaagctgtttttgcagatccgtcatcaattttaccgttgtgtctcctgttaaaatgcctgtttgtttcagtttctcttttgcttggaattgtttgactgcttgttcaaatgctttatcatacgtgccgtttacattcacgctgtaccccagcgctttcagcattttttgcgcattggtgacggtcgttccggaatccccgtatttgtatgtttttttcgcatctaaatacggcaggttcgcatattcaggaagcttaacctgatattgcggtttgattccttttttatgaatccactctccgtccgctgtcagccattttgcgattgtcagtttaacggtagaaccgtcgctgtaatcttttgccgtctgcacggttccttttccgaacgttttctcgccgatcagcggaattccggatgattcatgcagcgcagccgacatgatttccgcggcgctcgcggtgccgtcattgacgaggacgactgtcggttttgtcactttgcgctctttcgtcgctttcatgacctctttcgtgccgtctttgtattcgacctgcatgatatttttccctttatcgataaacatgttgctcattttgatagcttcatccatcaggccgcccgggttgccccttaaatcgagaatgtatcctttcgctccttgtttttcgaggctgtcaatggctgaattcagctcttttgccgtcgattcggagaaggatgtgatttggatttcgccgatgtctccttttttcatttcagagtacaccgtttcaaccgggatggtgtcacgtttgatcgacaggttcagatcgccgacacccgctctgtgcagcacaagcttgacgtttgttccctttttgccgcggattaatgcgacggcttcgtttacattaaggcctttaacgcttttgccgttgaccttcaagatctggtcattcggtttaacccccgctttttccgcgggtgaccctttaatcggcgatacgatcaggatgctgccgtccttttcttccacttgtgcgccgatgccttcaaacgaagcggaaattgtttcttcaaacgactttccttcctgaggatccatataagaagaatacggatcatccagggaactgatcatgccttttatcgctccgtccactaatttgctgtcatctgttttttgatagtaatcacttttaatctgctcataggctttattgaatttctcaaatttgctgttcgtcaaagcagccgagccttgcccgaaaatggtcgtattgcccgtgataaacagcgtaagcgccgaggctgcgaccgcagtgatcaatataataaaaaacagtttaaattgccgcttcaagaaaacaccacctttttattcttacattattatcatagacgaacgctcattcgtcaacttcaaacgtgaggcgcccttctttcccgtttacccaaacctatgcttttctctcaacatatgctgaggaaaaaaggaggattcggcctttgagcaaatatttagaaatgctgtccttattcggagtcggaggggctcacccgggcgggctcgctttttccaaagccgttctcacaaaagcggctcctcctcctggcgaaccgattcttgacgccggctgcggaacgggacagacggccgcttatctcggccacctgctgtatcccgtcacctgtgtggataaggatccccttatgcttgaaaaagcagcaaaacgatttgccgctgaaggcttaaccattccgggctatttggcggagcttgagcggcttccgtttgctgaaaatcaattttccgccgttctttccgaatcagttctcaccttttcaaatcttgattcatcgctgtctgaaatcctgcgggtccttaaacccgggggcatgctgatcggcattgaagctgctttacaaaagcccatgccggaaaacgccatcacacagataaaagacttctacggttttaccgtattgcaggatgaaacggcatggaaacagagattgcttcagcaaggatttcagaaagcggatttcattcccgctgtctatgaaaacaatgcgcaggagccgactacagaaatggatttatcgcctgttattcagccggttcactacgatacgctgacggctcattacgagcttatgcagacgtaccgtgaatatatgggacactgcgcttttgtcgcttacaagtaaaacggcaattgtcctcctgttttcgtccaacctttttaccgcactctatcataagctgacatagaaagataggttggataggaggagaaaagatgcaaaactattatcatctttgccggcagcaccaaggaaaagtagcaagaattacagaacgaaacggcagagtccacgtcggaagaatcgtacgggtgactaacagcaaagtgtatatcacccctgtcggcggccgtcacagagggtacggattcggttattggggaggaggctggggaggctggggagcagcctacggtatcggccttggtttcattaccggatttgcgcttggaggtctgctcttctggtaataaaaaaagcccgctttctatttttcaagcgggcttcttctcattacactttctttacttcattaaaatattcttcaagcgttaattgatggtcatggatggcttttgccgcttttttgcctacatagcgtaaatgccatggttcatactcatactttgtaacattttctttgcctttaggatagcggatgataaagccgtattcatacgcatggtctttcacccatttgccgtccgccgtgtttccgaacgcttcattcagctcatatccgttgcttttgctggagatgtccatggcaagccccgtctggtgttcgctttgccccggatatgcgacggcttctttcgcctttttttcacctttcagactgacttcattatcgaaaataactttctgtctgtcataagagcggtatcctgaaacggcaaccaggtcataaccttcttttttcccggcgctgaatagttccgccaaagcatcggcggcaggtttgcggatatatcgtttctcgatcttctcagtaaaagaaaattcgactttcgggatcacgagatcattcggtttataatctcccggcagcgtatatgtcttattcacgagcgcaagtgtatttgtcgggttttgaatggtctcaagcccgttcacttctttaatatcattaaaatatttgctctccaatacaaaatcgctgttttctgtcttcgttgtttttttgcttgatgtgtcatctgattgttttgtttcagctgctgtttttgtgtccttatggctgttgccgcctgaaatgctgcagccggtgcccacgattgcggttacgctgagagcggcagcgagcgagaaccatttagtggatttcttcattttacccttacctttctttttttgaatcagggcgatgcataaagaagagggctgctttaatcagcataaccctcatctcaagtttacgatacagtatgcagcgccagtttaatcatatcatgaaaagtcgtttgacgctcttctgccgttgtttcttctcccgttaatacgtgatcgcttacagtcaggatagacagcgcttttttgccgtatttagcggcaagcgtatataaagcagtcgtttccatctctacgccgaggacgccgtatctggcaagcttttcgatttgggagtcttcattgtaaaactgatcggcggtgaatacgcttccgaccgctacgggaagattgtttttttgcgcttcctggtacgctttatgaagcagttcgaagtctgcgcaaggagcataatctacactgccgaaggcgacacggttcatctgtgaatccgttgaagacgtcatcgccaaaatcacgtcacgcaccttcacgtcattacggatggctccgcatgagccgactctgattaagttttgaacatcatagctttgaatcagttcattcacataaatagagatagacggaacacccatgccggtgccttggactgatacttttttgccgttatatgtacccgtaaatccgtacattcctctgacttcattatagcattccacattttcaagatacgtttccgcaataaatttcgctcggagcggatctcccggcaaaagcactgtatccgcaatttggcctttttctgcgtttatatgtacactcatttccttttcctcctgcctattcaaactcccacccattgtacactgaataacggtaagagacaatcatcagcatgatcagggcgatcttgggcagaatatgcgggatgacagcctaaagaaaaaggagtgaacataatgggcaaaaaacagcgcaaccgggtgaccggccagaaaaagaacaatcacgtgcccgtttcagacgtcattgcagctgatgaagcgcatggaaaagagcattccgccgctaaacggaagccttaacactgtctttcccagacaatacggaagccggctgaagattcagccggccccgtcttacctcggctggacgagcagccggttaattttgctccatcccgcagggttaagcctgtaataggtctttccttttcttccttcgtctatgagtatgacgtctccggtcgctatgaatctggcttgatagtcgtttgggaccgtatcaggcacattaaaaacagaaaatgccctttccagtgcgtcttgatgattgtcagcggccagctctgtccgatagacgaccctgtatccctttttctcgccgtagcggggtgtttgaaaaatcgtcacatcataggcacaagtcttttttttaaacacgggcagcgataacagcatcaagatccctccttcttatttcttaatagtattagcgttttttctcaattttcctgtctctatttttgtcgaaacggatgatacttttcgtcaaagagcgcaaaaagcgaaacgaggcaaagtccgagactgaatccggcaaggacatccgtcggaaaatgcgcgcccaaataaattctgctgaatccgatcagaatgacgagaactccggtaaagacggtgacggccctctttcttttcgtgaaaaacggaacatgcttgatcaaaaagtaagcgatgacgggatacatcactgccgaattcatggagtggccgctcggaaaactgtatgaggtttcatggacgagcggttcaaaagcgggtctggctctttcaatcaattcttttatttttatgtttacaatccgttcaatgagaaaaagaagcggcaaaaaaacaacatccggcgtttttttgtacatatacagagctgcgcctgtcaaaagaagaagcggcaaaagcaccgcggtcgtgccgagctccgttatccataacatcaattcattcagccagacagacctgatcctgacagccgcttctatcacacgctcatcaaaagcccggaccgcttctatccggatcgctgctgcgagcaaaataaacaatgtgaaaagacttgctggcttgtacaacgttttcccccatgtttcattctcccgagctgattgaaaaaaccgaagctttttcacttcggttccgcagtttcagtcttcatcaagctcttcgtctatcatacatttttctaataaataatcaaaggtgatgtcggctatttcgaagatttcctcttcactcggtatgtacccgcgcatagcaagctgactgtaaaaataatcagctatttcttctgtgtcaatcacaagatctatttctttcatgcaaacaccgcctccttttttatgttttatgaaaaaaccgttcaaattatacccgaaagttctaaacgttttgtccgctcatatacttttaaaaaacaagccccggagggagaaaagatgatgacgaaaatgatggctttattggacggagatggatttgatatcgtattggaaaaagtgctgaaaggaatgtcgtttgtcatctttgccggctgtctgccctggtttttatatgtcaccgtccgtttttttgccggctagctgaaatgctcccgcaggctttccagcacaaaattcatcatatctttatattcttcgtcaccgaacaaatgataaagaatcttataatcgttataaatatcaagcagctcatctacaatcgataccgccagcacatgcagggcatcgggatcatcagcatcgccttcaaactgaagaagagcagacgcgacggtatcctcgccgatctcatgagatgcttccccaacatagtggacaaacagcagctgatgcacaaactgatccatttcatattttctcagaaccagcgtgagatcctcttcctccgtttcaagccactctccgtctttcagccgagtcagctcataaataatatcctcccagccatcctctaaatatctccaaatttcagttctgtgaccgataactcggaataattcctttccgtagtcctttacatatacgacatcgccgatcaaaaattcatattcaatatctaatttttccatatcgacgatcacgccctcataatctttataaagctggatggacgattcaaaataaagcacttcattatgattgacttcataaagataatgtttatcaatttgatgaaccttcgtaatggtgccgacggttccgtacatcacgacgaccacgatgtctcccacttgaaatttcggtttatctggcttcatgctgtctcccccttgccgcggactgtcatacgctatcgtatgccggccgccatcatttcgcatgggcatgaaaaccacaggaaatatctatttctgcacctgttcaaaatgtcaaaaaccgcaacatgcttgtgcgttttttcacttaccgtaacagaagcgtctgatggcattgcgctctcgatcgaatgagcagtaacaaaaagcgcctgttttgaatgagtttttgtttatttctccatgacgcaaagataaatacccggcccgaaggcatgttgacaatatcaccgccgtgatgttcaaaatttgccgtgaaacacttcatcgaaggtgtatggtgatccaattccggctgcatattcgtaatggcttgtttatcatgaagaaccaaactcgtttcggctttcaatgaagccacaacttcaatccgcttcaaccttgtcacataaaatcaccttttccgtccaaacgtcagtgcttcaccatagatcatttgattcctctcacttcatttaaatgtttgatgatttctccgtgaaaagagctccttacacggaaccccgcctgcagcaggcctgatccggtgaactctgcagctatacattctattgccttatgatccgtgccgtcaggaagatttgtttacgtgctgatcaaaacggacggcattgcgggatttgatcatacggcacctcataagcgagtgatttcaacagaaaaaaaccgcacaatgtgcggtttttcgtcaggcgtgatgcacctcggtctcatatttttcccaagcttcatcaaatgtcgacatcgtttctaaatagtcggcgctcagttctaaataagaactgagctcgtgataatcgcttgacgttttcggaaagccgtgatcttcgtatgcctgattcgcaaaccggctgattgcgtcctgcggtttgggatgcctgtatttcatcaaatagtgataaaaggatttcatgggtttcccctcctgatgactgtcttttgttgtactattatacaattcaagtgtgaaattacaacaaaagaagactaggagaagtcaaaataattccgtttcaagatccgttctgtcctcatcagctcttgatatgtgagtgtttccggtaatttttttgcattgactaaaaaaagctgattttcgatttccgctatgaccgcttcctcctgatacgtcatgccgcaggaggaacaggcgaatgcgggtgtttctgtaatttctatggctcccgtaccgtcaggaagctcccagtacacagccgcctgacaagctgacgccttctgattgccgcaccactcgcatggcttcacggcgactcacctccgacttccgatcctgctttttgctctttcttttgctgtgcaataaatttcttttctttcaattcatctctcttttccctgcggtctttcagcgtttcatgatcagggtttgatgtaaacgttttccttctgtcgattctcgatacattttccggtgtgaacgaaacctctttgtccgcgaaaatggcgctcagtccgaccggctcgcgtttggccattgttcccggaaaaacagattcaaaatagtcgtcggcttgattcgggatatagttttccggctcgggataagatgtaatcaccccttcgaagtttctgatcactactttctccggactttgggagagcaagtagttcggctgcagggcgattttaccgcctccgcccggggcgtcgacgacaaaggtcggcacggcaaagcctgttgtgtggcctctcagcccttcaatgatttccaatccttttgaaacaggcgctctgaaatggccgattccctctgacaaatcacattgataaatatagtacggacgcacgcggattttcactaaatcatgcatgagttttttcataatcggcaccgaatcgttaatgcctgctaaaataacggcctggttaccgaccggaacacctgcgttaacgagcttttcacacgccgcaaccgattcttccgtcagttcgatgctcgtattaaaatgagtgttcagccagaccggatgatattttttcaaaatctgacaaaggttatccgttatccgctgcggaaatacgacgggcgctctcgttccgatcctgataatttcaaggtggggaatgtcacgcagttttttcaaaatatattccagaatctgatcgttgattaaaagcccgtctccgccggaaatcaggcagtcacggatttccggcgtttcctggatgtaagcgattgccgcatcgagctgttttttcggcacccccattccgatctgtccggaaaaacgccttctggtgcagtatcggcaatacatcgagcattgatttgtcaccagaaaaagaacgcggtcgggatagcggtgcgtaagaccgggaaccggtgaatcttcatcttcaaacagcggatcttcaaggtcatatttcgttttgtgcatttcttctgacagcggcacggactgcatgcggatcggacatctcgggttatcgggatccattaaagaagcataataaggcgtaatgttcaggggaatggtttttacagacatcctgacgccttcttcttcctcttcggtcaaatgaatgacttttttcaggtcatcgacggttcttacagtatgggtgagctgccacagccaatcattccacttgtcttccggcacatctttccacaattcaatctccttccaatgacgcttcggctgaaaccatttgtttgtcaaacgaattcctccttatgaatggccaaacgtaaagtcttgcaccatatattcatattttcgagcccttctgaaatgcggcagttgttcacaagcctgcctctgtagccgtatcccgcatgatacaaaacggcgttcatcccgtaagacgctgcacgggccaaggaaaaaagatgaatgattccccggccagcgagttcctgctccaacgctttaaacaagtgtgccgttacggagttccccctgtaatctgacagaaccgcgcaatcggtcatttcagcgtgccccaataccggattgatatctgcgcttgccgccccaatgagacgatcctgatcgaatgcggcataatagatggtgttttctttcattgtttttttaatataaagggaattaaagacaggagtcggataggtaagaaaaacatgtttatataagtgcgataagcagtctgcatcatcttcgtccgcttttctgaacatcagcgtgctttctgtttgagtcagtccccgccgcggtgtctcatataaacagtcaacagtcgaatcttctgatacatatgaatctgaccgtctccgttcctctgataaatagcgcaccatcacaacagcctcatgcccgttgtaatacccgtctatgacaccctcaacaataaaaagatgcttgacaaattccggctcatcgccgcgcttggcaaagaaaatcaccttttgggctccttcttgctttgcttctgccaaaacggccggtataagcgccgtgatctgtccgtcataacgaatgaccctgatccgctcattgaaacggtctgcatcaatctcggccgctccgctttcagccctcagttcctttatcagctccgtcacccccatctgccaccccgcaccattccatgataaaaagagaaatgattttgacggcatcgattaacgcccggacttcaatgtattcattcgcctgatgcgccgccttgacttctcccggaccgaagacgatgaccggtgtctgtcccgcgtgctgcaaaagccctccgtccgttccccacggggacgcttcacgaactggttttgcccctttcattttctcaaaagaagattccagagcggaaatcagcggatgctcatccgggagatcattcggaagccactgagctccaaaccattctatttccgcggggtggtgtttaaaccattcatcccggtactccaaatctttcagccagcttgccagctcttcttttactgcttcgggcgtttcatccggcgctattccgcacctgccttctatcaccacacggtcagctaccgatgatggccacgttccccttggacggtgccgatattaatgggaaccggaatcggaacgtcccgataaagcgggtctgtgatacgggcgttgcggacgtgttcaagctctttaagggctgtgatgacatgcaggcttttttcaatggcgctcaccccttcatagcgggtgccgccgtgtgcggacaatcctcttaccgtaatgcggaaccacatagacccttgctgcttaacaaacagctttaaattagtcggttcgggaataagcgccccgtcagccttgtagcccctcataacagccgccagtgttcccgcgccgccgcactcttcatctacgacactttgaaacagaacatctccttttaacgtaatcccgcaggcttcaagcgcttctaacgcaaacaagagggctgtattgccgcccttcatatccgttgaaccgcgtccgtaaactttgccgtccttttcaacagcggtaaacggttcatacgtccatgcggcgggatttccttccgggacaacatcaatatgtccgttcagtatcagtgatcttccgcccccggcccctttctttacggctgtgatattcgggctttcatggaagtcttcgcgttccgatacaaaataaggatgctctttcaactgtttgacactcggctcccagacatcaatatccatgtcaaactgtctcagtttttctaaaacgactgcctgtgcgttaaattcatggccgaacgtgcttttttccccgatcagccgtttcagcaggctcaccgcttttgctgtgttttcttccgcccactcagtgactttcttttctaattgatccatggacagacccccttttaagaaaacattctcccaatctgatttcggcatccgttgtttgaatgacatcgtctatggtcgtgccattcagcagttcctcaagaacaaaagctccctcatctatgctgatgacggctttctctgtaatgatgagatctgcacagcccgctgctgtaagcggcaatgaacagctttcgaccagcttcggccggcctttctgatcggtgtggctcatgacgacaaccacttttttcgcgccttgggcaagctccatcgccccgcccattccgggcacttttttccccggcacgagccaattggcgagatcacctgtcctgctgacttggagcgcgcctaaaatggtaatatctatcagcccttttctgatcatggcaaaagacagagctgaatcaaaataggaagcacccttaactgtactgacaggaaatccggccgcattgcataaaagctcatcctcctctccgcgctccggactaccgccgatcccgaggacgccgttttccgcctgcagcattacctccatgccggccggcagaaagtccggcactaaagaaggaatgccgatccccaggttgacaatcatacctgaggtaatttcactggcggcccgcctcgcgatactctctctttccgctattcccaagcccatctccacttcactccttcactttgcacgacaccctctacgaaaacgcccggcgttacaatatgctcgctgtcaagttcgccggcaggcacaatctctgccgcctcagcaaatgttctttcggccgcagcagccatcagtgggttcatgttgcgcgccgttttgtcaaacgtcagatttccgaattcatctgcaatatgcgcggacacaaaagcgaaatcagccgtcagcgctttttcaactaaataggactttccgtcaatcgttacggtttctttgttttcacaaacggttgcgttatcaatgccgatatcagttaaaataccgcctagccccgctccgcctgcgcgaatccgttcagcaagcgtcccttgcggcgaaaattccacctcaagcgctccgtcagtcatttgtctgcctgcgacaggatttgaaccgatatgggaagcgatcagcctttttacccgcttatgaacgataagcgggccgataccgatttccggaaatccggcatcattgcagatgacggtcaattctttaacgccgctttccaaaatcgcttcgattaatgacggaggtgaacccactcctccaaaaccgccgaacatgatgacagattcgtccttgacatcggcaattgcttcatgaatatcgatttttttatgaaaaatagacatatcagctcaatccttcttcatcattttttcagcttcttctgcggactgggaaaatagatctgacagctcatccagctccgcatatgaaatcgtgaatggcggggcgatgatgacggcgtctccttctccgctgtcaataccgggctttgcagggtaaataagcaggccccgtttttttgccgctttaatgattttttcggtgaaggcctgttttttcgaaaaaacgtccttcgtcgttttatccttaacgaattcaaccccgatcaggaggcctttaccgcggacatccccgatcaccccgctgcggtctttgatttcttctaatttccgcttcagcattacgcctttttcctctgactgccgaagcagctcgtgtttcttgacatagcgaagcacttcaagcgccgctcttgcacagtatgggttggcactgtacgtatgtccgctcataatgaccccggagccccgcttgatcgtttcaatgatgtcatcagacgcaacagctgccgcaatcggagcgtaaccggcgcctaacccttttccgagcaccgcgatatcaggggcgatcccccaatgctcagaagcaagcatccgccctgttctcccgagccccgtcatgacttcatccgcaataaacaaaataccgtgcctgcggcagacaacctcaagcgcttcataataacctgccggcggagtgatggccgccccggctgctccgacaatcggctctgcgacaaaacccgcgataaatgaggaaccgatccgctgaacagccgtttccagttcagccgccgcagctttcacaaattcctctcccttcagctctgaacgatacatattaggcgctgaaacggccggaaaccgttcaagcagctgggtgaagcggtatctccgttcgtagaaccccgataatgaaagcgctcccaaagtaatgccgtggtaactgccccatcttgatagaaagacggatttttggtattgccctttttcctgccaatattgaacggctattttcatcgctgtttcgactgcctctgagccgctgtttacaaaaaatgaccaattcagcccgcccggcagatgatcggccagaaataaagccagttcttctgccggagtactggtgaattgcgagcgatacacaaacgaaacggagtcaagctgctcttttaaagcttgtataatatcctccgtgccgtgaccgatattgcaagtgaccgcccccgatgctccgtcaagatacttgttcccctcctgatcatacacatatgatccctttccatgactgactgacggataatttgcgtcaagctccggtttgattaaatagctccccatatctttccacctcgaaaacccatttgcttcattgtatgaacagatgaataaccgcattctttccttcaaaaagttttttgcagaaaatacctttctgtaaaacaggctgccggagatgtcccgacagcctgaagagcgttctggaaattctattactactgttgattttattctttcttcggttctgctatttatctgctcagcttatcatcacatcatttttgatctgaatcagtataagcagaaggcggaaaattcccgtcttctttactgtatgggaatcaatatttcacacaaatgatgattcaccttttgtaaagtatacctttcgataatgggctgttctctgattgataaattatttttttcgatctcagaaaaaacagtgttccaaaatccgctgactgcctcttttgtatgatcaagcaagaaaacagcgtacttccctccggaaaatgtaccgatccgggctggttcaggcacatggtcttgattgataacaagacaaacatcatagcggcatttctctttaggagtacgattcggatgatcttgcggaattcacaaaatgacagaatgatcaagcaggccattcaattgcgcccagttttcaaatgactccatcagttctttgttttgctttccgccatactctccgacgtttcggaaataagcaattctggattcgggtaattcttcaatcgttatgttcacattttctcccccttctccagaaaggcaatatgtattaaaatgtttttcaagctgatttttcagcatggaaataacaaaaagcctgcagaaagtgatgttctctgcaggctgattttcattataggatttttttcagtctaacaaataaaagccgcaccgacgatgattaataaaataaacaatacaacgatcagcacaaaagtgctggttccgcctccgcagccgccgtgcccgtaaccatagccaaaactgccgcaaccgtagccatatccgtatccgtacatacgcaaatcatcctttcttcttacgatatacggcattgtatgcgggccaactcccaattggtttatgcgaatgcccaactatgtaagaaaataatgaaaaattgtatgcacgcgccgaaatcttttgaaaccgagtttttcataaaagcggtttacaccgtccatcccggacgtcacaaggtatacggtttccatgccgttcagctttgccgccgccatcagctcattcatcaatatcgatccgtagccttttcgttggaattgatccagaattgcgacttcttctatttttgcggttttatctgctttgttgatgaaaagctctccgcagccgatcggaatcgtttgcgaggcgtcgctgtagcacacgacaagcataaccgttccgtccttatacaaaggatatttccgctcaagcttttgttcggccgccgcctcgccaatgtaaagggcatcatagatgttcataatagacgacccgtcggcgaggcttttttccgtcccccaagcagtgagcgggtgtcctgcctgcaggtccccatttgccagtttccttgcaaaaaacagctcatcttccactacgcagccctgctttaccagagtttgtttcagaagaagcggaaatgcgtgctccggagacgctttcacatgaatataattggcttgaagcatgcccggaacggacgaaaaaaacggcagcagtttgtctaacggaaatgtacggtgcagctgaacaaagttatgcgaaaaaatctgcggcaaaaaagggtccgtatatacactgaaatgctcgaacctctgaatgccggaagtaagctctatatactgcttctcggttttatcaaattgatcggtcataaaagctctccttttccttacacatccgactgcatctctcaaccttttgttatattgagatttcttataatttcatcgtacaccggatagaacggcattccaattggtaattgtttaaattgttgaaaggaaatgggtatcgccttctgattcgcaaaaaagcgtttcgctacgtcatgactgatcggatggagaacccctctcaaataaacataaaatttccgttcaatgcgaaacagcattctcccgggcagatgttgaatacagcccgctgtcccccggctgatcggcggaccgtccggaagcgattgtatttcggcccgttctaaagccggaatgtcatgccgtttaaatcggtaaaagcgaaatgcgctatgatcaaccagccttttctccccgtcttctataaaataaacatgaaactgatccctgacgagctgaaaattcggaatactggcggagtcctcttcctcatattgaaataaaaacggatccggaatgacgacggttcggccttcatataacgtatgccagcgctcgtttacaggcttccttttatttcggtcaagctgatatactttctgatccgtcccctttacaaaggatccgtcgatcaggacagacggaagcgattgatacgtgttctgaaatgagtggggtgttttataggtcgtatccaacacttcttttatcggcagaaatgatgtaaatgtgttgagcctgctccaaaaaacagagtctccgtgattccaatggataacatcttcgtcccaaaagctgccgaacttctctttcacacgctcaagcaatgatctccggtgcatcactgaacagtgatcaacgagaaaagcggcctgatcaagcacctcttcagcgaaacgatagaagtggaattgttctgttccgcgcccgtttacatgtatcaccttctggctggaatagacggcatcaaactcgctgcattgattaagcgcttccgccatgcggctgagcctattcggatgaaatacggtgtcgtctgtcaaataagtgatgtattcgccttcggcccgtgaaagcgcatcattaatcaaaacggcataccgggtcgacttcagccgttcggccggattgataaaactgttgtcataatatatgcgatgatcttttatatacgtactgatggcagccgaggtttcttcatttgaatgatcatccatcacaaacagctcccaattgctgtaggtctgatgcaaaacactttcaatcgcctgtttcacaagatccggtttgttgtaactcgttaagataattgagatcttcttttccatcccatcaccccttctgtaaaacgtaaaaaacggctccgaaagagacagagcctgatatccgttattaaaaagcaccccagctgacgatgcttgaaatcgcgacgtttgatctcgtattattgagcggattttgaaaaacggccaaatctgacagcacttctttgacaattacgttctgcagtgtgctgccgttaatcagattgacgcgcggtacaggaaccccaagctcttttgccattataagctgacgccgcaaatctgaatgatctccggacggctgatgagataacaaaagaagaagaagcagtacgagctgaaattcctcctcaaaacccccgtgttttacagtttctcctgaatccaaaatattcctctccttcatttttttaatctatacaacgtatgtcatactcttacaatccgcataggcaaacaaagcctgattcgaaaattcagctgtttgattaaatattgaaaaaaacacaagcaaaacggcattcgacttataccaatctcttcaatcaggaatatgaataaacgtgaggttgaaattgttaaaggaggtgtatgtccgcatgagcgaggatcgtttggagcttaaaaagaacttattgaaaactcttttagcccctgtatttgacaacagcgctttatctggcggcacagatggaggagataacgtgaaaaacagcgtaaaagaattattggaatcggcaattgatgcaaaagtagatgaagcagcggcgaaagacagtctcagcgcacaatcagtattgggaagcggtatttcattagcggcgagatggatttttgcaagaattcagcccggcactgtcatcagcattgtaatggattcaggagacatgatcggcccggttcaatttgtttcctttgacgaaattcacggaatcgtttttgttacgcaggaaaattccgttacaccggcaggctctgctacaacattgcttgacgtcgacaaagttgaaagtgtcacgttcacttcgtaacagcatatgaacgttttatatatccgttcaggatataaaggcatatacacgtattttgaccgctggatcgaggaaggctttttacagtcttccgtccgctttttttctgtttctgagtttgaggaagataccatccgcagtatacgggcattcaaaccagacatcagtctgatgatgacgggagaccgtattccgtctgaatggcttcaatggctgaagacagaacagattcccgtttatctatggatgacggaggatcctttttatttcgatgtgagcatgacaatcgccccgcttgccgatgccgttttaacgatagaacaaaacgcgcttgatgcttaccggcaaatgggcttacagcacgtatattatgtcccgatccccgttaatcagcggctttttaagaaacaacctgctgaagcctctcttcacacaaatctgcttctgatcggatacccgtatccgaaccgcgttgaactggtgaaagcaacggcgaagcttccgtatacgcttcgtattatcgggaagggatggcgcagacatctgcctaaaaaaatcgccaggcagcaaaatgtgctcgtaatggatgaatggattgaacccgaacatgccgcattatattacaacagcgcagacgtggtcttaaaccctcaccgttcttatcggtttgcgctcaatcagaacggacgcggcatcgaaaataccagtttaaatacgagaagcttagacattgcggcttgtcaggcctttcagctgacagacctttctcccgcgcccccgttttcatcatttgtttcttacagcgggtttgcggattttgcggataagatccatttttatatgacaaacccgggtgaacgtaaacaaatcgcggcgcttaattatcaagagacagtaccggcgtacacgtatgaccggctgccggctgtgcttacggctatccgttccaagactttctcatgaaacgctcttcacatcaaaaagcagcttggataagctgcttttttcatgtttattttccgcttctgtcagtcagttttctcgggtcaacctgtttattgacctgcggatgaaagccgattttatcagcgattctttcccatggcaccattttaaaattttgattggccttttggccgtgatctatattctctccgtcctgtgcgacaaaaaggccgaacggatactcaggccccagcccgaaacccagaacgtcaattccgtctgtatcgcttgtgccgtctgtttcaggcccgtctgttatctgaaagtccgcaacatatttgttctgtccctgtctttcataaatcgcgtagctgctgttaccctggcttgaggcaagcagataacctttcccgtcagcagcgtagtaaatcgtcagtccttcaatatcaggggttaaatgcctgccgtcggcacgatcgataaccgttccgttactgccgccgtccggctcagcactgaacttccagatggcctcatcttcttctgcgatataaagactgccgtattcatcgtctgctgccattccttctgtctgagaattcattttaaacgcccttacctttttgccggatatgtatccatttttatccgcatttaattcgtattgttcaaattcgccttctttccctgtcaccatcgcgtaatattttcctgttttttgactgtggtacaagctgaaaccgtatacttcatcaattgctgatgcaatcgggcggtctggatccgtaatgctttgtaatgtgccgtttttcccgtcaatggcgtaaatctcaatggtattctttccttcagaccgattggatgccgccgcaatatcgactttttttccgttcaacggaaaatcatagcggatatcaacattgttcagcttcccggtatgataggaatgaagcatctttccctctaggctgtacacgactaagcctgattttttattggttgtgatcaatttgctgttctgaggattcttggggtccagccaaatcgcaggatcatcagctgcatcaccggctgtatcaacaggctccgtttccgccgccgcattcacggtaaaatgataaggatcagacagcttatgtttggcctgggaagaaaccgcaccgcatgtgagcatcaatccggctgccgcggttaacaaaagtgtttttgaatgattcattttccatcctccttttatgaacgtgcaatttaattgtaaaatacatacaggaagttcagtgttaagtttttgtgaagattgtccgcatgtgagaatttatggagagaaaaaattgacgtggacaaatatttaaaatgaatatttagtacaatgttttatttgtgatttctattctattaatcgggtaacgcgatatgaaagcgcatcagattaatgtttttctctaatttttgatttattggtttctttcattaactcgctgaaattgttcaacatatgatgcatggtagagaaacgagagttggaggataagccatgcctaaacagcaagcagtagagctacaaccgttttttcacgataaaactgttctcgtcacaggcggaacaggatcaatcggaagccaaatagtaaaacgccttttgctcttaacccctaaagaagtcattgtgttcagcaaagatgacagcaaacaatatgtgatgaaacaaaaatacgcggatgaacaaagactgtcgtttgtgctcggcgatgttcgtgactacagaagagtcaaccaagtgatgaaaggtgttgatattgtctttcacacagctgcgctgaagcaggttccgacatgtgaggataatccctttgaagccattcaaaccaaccttatcggcggacaaaatgtcgcagaagccgctttgctgcaagaagtgacgcatgtgattaatatcagtaccgataaagccgtttattaagatacttaccacaaacaaatcaaaaaaagaagcttactctgcactcctttccaaagcagcctccaataaatgctgagcaaattgtttataaaattcatctaagtcattactcgcttcatcctgttctatatagcggatactgtaattatctttatggacaacctttattgttttcttctttaattcctcataacgttggtaaggttccaaaactacacccccgctttcacaggagtattatatgtatgtaatggttcgtctcttgactgttctttctttatcaaagcctcgcaagcttgttcaaatgtatgatccagcgttcagtaccgatctcttcgcatatgaatatgagaatgctggctttattcaaggtgcccagtaattcaaaatgtgttcttgacatatgccttctctgcacctgagtcaacaatcgtcaaataaatcccggggcaggaataagccaccgcgaatgaagaatgacgtgaggtttgaagacattatttcggttcaatatgccgcttcagttttgcagcggtatttctgagaattaaagaataggtactaaatcctttcaaactttgagatatttgtttttagcggtgaagattcatttaattttttataccaaatacgaattttttgtcctttgcttaagtcatctttattgttaagctgactaagtcccagtaaaactatatccgatctatactttttaataatctctttttcactaagattttcatagtctttaacatcagctttttcattaggtatgagaattgcttgattctctccttttaaaatgacatagccgaccatagtttgctcagcctccataaaatgtttgttatgttggttttgacaccctaatgttatacataacaaaattaacagcattataaacactctatacaagttcaaaccgcccttcttgcatatttgtaacaagagtaaaacactgttttaggaaatgacagactaaaacgactcattcttatggaacacggcgaggtcttcaccaacatagaaccgcacaattgcatcatgaaatattcaattggctgatcaaccacaacaccttctttaagcggtctaatgtggaatacgtgtaaggaggcggtttatttgaaaaacgatcagaaaataacacttgactcttcttttgcgttatccactcttattgtcttacttattgcattgtacccgtcctattcttcttggtttgtcacaatattctttttaggatttgcactaatatacacatttgaaaaaagagcaaatcttcaaaactaattgctattatctcttatccattatttattgttgcgtttgtttacagcataataaacagcatgtaataatcctcccacctaaggcaggattatttttatcacattgcagcagcttttgagccgcctttgtctgtgatgttaaagctgtcactcccgattttttctttcgatccttatcttcataaatcgttacatggtcttttgtcattaaaattgccactgccatcttacattcctgcctatccttaaagtaaacaattttacattcacctagaatgatcattattagctaatccggctaatcagatgaccagccccctgtaggcaaattaaaagcaaatcctaatgtttaaacgacagtagcagttgagtatttgtcaaagttgatcgtagacgttgctttcagtatcattccaagtctgagttatctctttcgccttaactcctgccccaaaatcataaagcaaaccactcttcagcagaattccaaaaattccaattttaccaatgttgtttctcaaacctaattctccctctgagtgttttaataatattacactcagacgttaccctgaaaatattcataaaaccatattgtatttaatttttcctggactgcaaataaatcagaaagctttctttctgatactttgatatcaattttatataaggtatcaaacaattgtttgatagctcgtcttactggtgcttgctatatcaagattccttcttttcatgctgctcttttccttggcctcaattctttaaaattacgattttaagttaactttaaactgcattatgttgagaatatcacctttaattggtaagctgacaccagatcatacttatccaatgaaggtgaaatcatgaataaaataatcggaatgaccggattaattatctccttacttgtgcaagggttttcagcaagtgattcattgactcataagatcgccatggcttgtctatttttgttcttattggtttataattttaaccatactaaggagttctctaaaaagtctctcgctattataggcgcttcctttgttgtgctgatgcttggaatttatcaattgctcttttttactgaggattactttgaaaggcacggtttgaattttgggtttatcctcttacttgaaattgttttagttattgcattagtgactgctgcgctgagtttaattaagcatattgcagaccgcttaaggaaaacacctgatggtaaagagcgttgactctttgcctttttttagctaaccacttctttttatgccgtctttctatgtacaaaatcaaacacaatatcgacttttgccggctctcttctgtcaaatgatgaattgacttcaggcattccatcttaacggactcttcatcattttttaccataatttctcaaacaattaccttttttgacaatttgcaaaagatcaagcgcactgctctcttttaagagctctacatttctaatagcaagattggatattgtttgttaatacactcggccccaacttttgtgtcttagaatttgaaaggcgtacttgcactttaacatttgtcatttcagctgatatagaatcaatccttccagcccaattagggctctcttcctcgggagtcggatatagtttaaatcgccaactgatctcccctgttttgaaggcaaatccttcataaccgtcgtagcttccataagaagatggctgaggaaggtggacagcaagaatacttatattcgttcttgcagcacttggcgggtataactgcactttatagattagtgccgcacccttcgcatttttcaatttttgattcaccggttcgagtactgcactacaaggcattggacttgcttttatttgagttggagagacaataacagcagccaataaaggtataaccaagataaatcgtttcatctaaatcccctcacatttttttgttaatttcccttactcccgccttgaatattcatcacttttgaatggttagcttcattaaaaaggcagtactggagctactaacgctgccggtgaagatggaaaatcagcatatgaattagccgttcaacaagcagaacattagatgagtggcttgcctcactgaacgcaacagcaaactgatcatgtacccttctctaacgagggggttctatcgcattccacaccgaattgagaaattaagaaaaaacacccttcccaacatattacattatgataaaatattacataatcagacggaatactaggaggttgatttttttggagcaattgatctcttcttcaaaggttggcttaaaaatcaatgaatggtacaaatatataagattattcagtgttgcagatgcagaaattctaaagggtgaagttgaacaagaaatagagcatatggaagaagatcaagatttattgttgtactactcgctcatgtgttttcgacatcaattaatgcttgattaccttgaaccaaaaaccatgaatgaagaacgacctaaaatttcagacttatcagaagagatcgaaagtaaacaaagcgatctaaaaggaattcttgaatattattttaacttttttcatgggatgtatgaatttgaacagtacgaatatcttaaagcaataagtttttacaaccgagctgaaaagaagatatctattgtccccgatgaaatagagcgagctgaatttcactataaagttgctgaagtgtactatcacatgaagcaaacccacatgtctatgcatcatattgttcaagcaatagaaacctacaaagcacacgagacatactcaataagagtaatccaatgttcattcgtcatcggtctgaattatttagacatggagtatccagaaaaagcaataccgcatttcatgaatgcattaaaacaagcacaagaaattgatatgccacggttaataggatcttctttgtacaatctcggtttatgctcatttacaacaggacatatggagaaggcattggagtattttaaagaaggcgtctcaatttatcaaagtaattctcttcacaattctagccgactgcttgacatacttctaatgttggcaaaaacgcactttaaattattcaacacggttgatggaaaacaggtttgtgaacaaggtcttatgctgtcaaaggagttgaacgatgacgtattaggaaaaatgtttgattttcttatgggtttattcgttgagaatgacaaagaacgactttttaaaatcttagattacttagaatcaaaagctatgctttcagatgtggaagacctagcgactgatgcagcaatgtattataatgtaaatgaagaccataaagtagctacagccttttatgagaaagtgctttatgcccaaaaacaaattcagagaggggattgtctttatgaaatttaaatttgcatcggcttttatctttttggttatcttacttgggcttgttggacattatcttcttgacggccacaaagtttttaaagaagcccgaagaggccacacagccagtatccatatcgcgcttgatcaccataatgacttctcagcggaacgccgagggcaaaccgcataaatgttttggcactcccgcatagggggtgtttttttatgatctgtgttcacctgtagagctctatgcaatgctgtccttcatagtaaaacaggtaagccttattcatagctgcaaccaaaaaaagcacaaataaatagtattgctctaatcttgtgtggcaatcatacaaaaacacaaaaggaaccgacctagacagtaatggaggcgcacttttcacacctgcagatattgaccgctcatcaaaaactgtctgctcctaatcatttactttgcagatttattctgcaagtgtctttttattgtatataaaagataaggagcgttatatgaaaaagtcttatgttttatatgggatttcaggagttctaattggtgcaatagttatattgttgatcaatgcattctttataaataaaggtgaacactctgtacgtacttctaaaattaatccaaccgaggataaaatcttttttatctattcaaatccactcatcaagaaaagcgtactcatatccacatcccaaggagaaaaattcaataaacgatactttaaggtaccggatataccatatatccagaaaaaaaccccctcttcagacgatatcgtcttgttagctgaacatgaaccatattattacacattaaaaaacaacaccattaaagaacataaattatccaatccatttgctttttggtatcaaggagaagatatttctgtaaaagcctataatgtcgacaccaatggaaatgaactgaaagtaaatgataaaaagttcaataaaaaatatagcctgactttgcctaccctcgtaaccatgggaggaagcgatgataatgataagtatatttacgtcattcaaggaatgtctttgtacgtcattgatagaaaaacagaagagattattaaaacgattggattagcttcctatggagatgtatttgatcactctgaaaaatatgttgtggctagctcagaacatgaactaactgtaatcgaaaaaggatcatggaaagcaaaattcataaaatatcctgatgatctcgaacaagcggacgctatgtattacgacaaaaaaagcggtaaattttacgttacatatattaacaaattcggataaacctgcttacttgagtacgataaagatttttcttttgaaaaattcgatttaaaatttccgtattatgaatgcaaagtttaaagatcaaaaactttatgtgatttcacaagaggaaaacaaaaaaggcattggcggctatatggggatttttgatatccgtactaaaaagaaatttaatgaatttgatttgcctaaaaagaaacaaaagtgcaggactttatggttttagattaaacatcaagaatgagttgcaaagcaaaagccccttcctgaataggggctttaattttaaattaaatagatgttttatacgcgttaatggcttgatttctcaaaagcatattatctctcgtcaccattccaagattgtatgcttgtttgatgatatccagcacttgattatcagtttcagttacagctcgtcccccagttattctggacttccagtaatcaaactggtgatttaattccgaactgcttttaaggtttttattatcaactactttgccattctccagcgcttctttgaattcattaaaaccaattgaacattgctgattcgaactaattcctgcaccttctgtcgctaaactgcaaaacgctaaaaacttcggatctttcgtgatattgtaagagttatttagaccttccatagcattcaccctctctcaaattttgacggggtgtgaccaacaccatgctctttttattttatgcatttcttattaaaaagatacactataaccagtttgtattttacagtttgattataacagatcaaatgaaaccattggaagatttacaaaaaatttgttttttggataaaaacattttttatagattacacaagtgtaatacttttgcttaagtgtcccagtcttcatcctcaatccagtcgtctttcgcttcttctagttcctctattaaaaactctaggaatgtgctactaacttgtttaccatatccctcttggttatcccaaagaatgacggggcattcactatttttcatcttgttagtatcaagacaataagaaaattcatctacatattcgataactacgagaccatcggaaaggttataatactttttatattcattggtctgctcgacaacttcagcaccgtgagagtcataaccgagtatcatagtcccgtatgctccccctgaaccatactcagtcaaaaaccatttatagctgcctggaagggttacattgagatcctcttctatttctttaatctgatcttcagtaacacctcctgtgagaattgaattttctttattttcattgaagaaagttttcacttttgaataatccattaaaccttcacctcattatttttggttctcaaattgctgagctctccatctccaatactttcttctgaaacttttatattgtttatcaagtactgggtcatttctaaaactctgtccattccctttcaaaccatgtaaaacatcactgtacttattatgccagctttcaggtatctcgagcatatttccaggttcttcttgaatcaagtgatgcaaattaatttgggttccatcttttgcaaacggagcgttaccatttttcatcagttgaagattcgtaaggcctttccgatttttttgattaagatcaatatctttcattgtatataccctacggcttacatctctaggctgtcctttaacttttaccttaccgtctatttcgtatgcttcatatttttctttatttaaccaagggacattcactttctggcctgtaaatggctttcttgtttcatctaatttctttgcattaataaaaagttcatttttaaggttttggctgtcaaccacattgtatggtacgtcacccgacagagcaagatcatacttagagttataaggaagcaaatctgcaatcttaacgtctttaattttcttccctgcctgtcctgctttgtttatgaccttccccgccgcatctgctttgttaacggctcctgcgcctttcgttccgacgacagccacagctgctgaaccaattgcatatgtcacccatcttgatctggagtaagcatctccgttcaccatatctttttgatacgattcctcgattgctgctgaaacagcatcatatgttttaactggatgaagtactgcgtttcccagtgctgacaaggtttctcccggatcggttatgaagtcccatagaccggttaccgtgtctttcccgacatcatataaaccaacgccggctccttttaatatatcccaagtcacttctccggcttcttccagctgttttgcttgttcaagctgaatgacatattgctgctgggaaggttcaaggctttcatagccgatcttcttcgcaatttccaaatattcatccggatcagttacaacgtcagcgagctttttcttcagattcttgatttcctgctctttcgcctctttcttcttaaccgtcaaataagcatctgaatgtcttgcaatctcgccttttttcttatgtatatcgctttccttgtacgccttggcgttatagtgaagtggtgttgcgtttttccctttacccgtggcattttggagctgttgaaagtcggcttggatgaaatgctcgttcgcttcggtttctgcatattctttcgttagatcatgatcaagcttgccgagcttatgtatggcctcatcccgttttttatctgctgaatccagcttttgatcgacatcttctgtcgagaaaacttctagttgaatgatatcactgatttcatcaaggatacctttcatttcattgcgctgctcctgcatgatggcttgtgatttattcttcgcatgaatcagctcatgttctaaaaatgactcttccacaaacgaatcggtcaatccggcatcagctacttttcctgaaatgctgttaagaaaagcaatcttcatatcgatcaaatcaagccagctgtctgtgacactagcgtgatcttggaaaaaagctttaatgttgtcagcgcctttgcctgaaaactcattgtcatctaagtcagccatttcctgaaaagctttcctgagattgataaattgttctctaatctgatcgtattctttcgcccgcttttccgccgctgaaatgaacgaggctgcttcaaatactttcatagctgtctccttcccacttgattttatctaaactttctattctgaaacatatttataatactcttgagttttcgggctcacttcccagtattttgttccatttgaagacactaacatgtcaaaccatacctcaaagttagagtctaaatataccgtatcttcaatgtcatcaattgaatctagatacaacatatactctaatcccttatttgatttgtttgtgtcaataacatacctgccatcatagtggtatccaattaggacatagcctttagggaaatcttgaacttcattaaattcaattatcccttctgtgctaagaagctcaataccattaaacatttccattccgttgtgattgaataggaactctttataatcattaggcaaagttacccctaacatcttttctaaactattaatttcttgaggactggccggatctctgaattgaaaagcagcgtcttccatgacatgcccccatgttggaacataggaaaagttccgtatttagaaacagcatcctttattccattaagagtcatgtgaattaacttcccttcttccatataaattccctcctctaatgtttagaccactaaattttacctcaaaactgtatttgagtgtcttaaaatgccaaaacagaatttacaatctttggttttatatttataattaggaaggtttgtccgatatagagacagaacaaacaaatttgggggaattacattgaagaaatggttattaggtatttgcgcattatctttaagcttttctttggccgcgtgcgggtctgattctgattcttcagataaaacagattcagacaaagctaaaacaacgcagcaagaagaaaaggatgtaaaagagacaaaggcagacactcaatcaaatgacaaaagtactaatgacaacaatgaaaaagccgaaaatgcttcaaagaaggattcgtcggataaaaaggcgtctgacaaaaagaaaaggctggtcgatgtaacacttaacagaacagttgatgggaatacgattaaagtaaactataaaggcgaagtcaaaacggttcgttatttacttgttgacacgcctaaaactaagaagccaaactcttgcgtacaaccatatggtgaggaggcttcagcaagaaacaaacagctggttaacaagggaaaacttcaactggagtttgataaaggagatcgtacagacaagtatggcagaatgctggcttacgtttatgcagatggcaaatcagtacaagaaacactgcttaaagaaggattagcacgagtagcttatgtatatgagccaaacacgaagtatttagacacgtataagaaagatgagcaagctgcgaaagataaagacttgaagatttggagtaagaatgggtatgtgactaataaaggatttaatggctgcgcaacgaaaccgaagaaatcagtaagtgtatctaagccggctcaaaagtcagttacaacacaccaatccgagacacataaatcgaaccccagcaattcaaattcaagcagttcagcatcaagcagctcttctaactctgcacaagcctccccttctgctggaggaacagaacactttgcaaactgcacagagctgagaaagaaatacccgcatggcgtaccaagcactcaccctgcttatacatctaagatggatcgcgataatgacaactttgcatgtgagaagaattgataattttagaagtcctctgaggcttctttttttatttggatacattcaaaaaaaccacagagcgtgtgaaggactctgtagtctatagtggctgattaaacccctatgatacatcaattaggattttatcaaaacttttcttttaaagataacatcatctctgtctcaaataatgcctgcagcagttcatctatattaatttcgttctgcttgtaattattcttttcataagtacgaataatttcttcatattctgatcgattatctcctttaatggagctaattccaagctcttcaccatatcgggtaatgaataattgcttactcatttctttcgctttatcattttcataattacaaaatgcacctgacaactggacgagaaaagtttcgtcttcagaatttaggttattttcgttacaccagtctacaaaacgatttccagtcatggtatcacctttaattttagtatttaaagaacaagataatctgcagcaaggatgatatattctaccgccatgccaattgtttcagcaactcctgcgccaactgcacctttaatagctggtggaatttgttttcttgccatagcagcaacctctttaggagctccggttataccttcgagaaccttacaaattttgtttgtgtttttaataatcttgtttaccgtggactttccgaacattgtacctaaaatgtcttttgcccaagcattattcgctagtcctctaataaccttaatcgcttctttagctgcggcgcttttagctcccatagtactcatttgatcttgtgagttaccattttcgagaccttttaattcttcagtcgcatttaaaatgcctttttctttaactgacgggactgagtattctttagcaagtttttgaagctcggttggattataagtaaattgcacatcctgtttagaagtactcgcttttttcacttccgaggccgaagctccaacagttgggatggctataacggctgcaagcaacataaagagaattttagcaaatagacttttcaatttgaactctcatttatccctaattttattgtttaacacattgaacaccataccataaaacatttatattttttcctgtttttattatattcgtttaaaaaaggtaaggcagtcctacgtttgaaaccgttcaaaaatcactgcggtgatcaaatattcattcacaatttaagatatatttactacacaaaaaaggctgtttttgagacagtcttagatgtttttaatctatatatccgttagaatagatcaagattcaaacaatacaatccttacaatatattacgttattttcgtattcaatgtcagacagaatattgtacgaatacttctgtttttacagtaaatacaataaagaggaggtgctgattttttggagttaaaaaacatcgttcattcttacaacattacaaatattttgggttatcttagacgctctcgtcaggatatggagcgggaaaaaagaacaggcgaagatacgctaacagaacaaaatgaactcatgaataaaatactgaagccgattgaaatcccctatgaattaaaaatggaaatcgggtcaggagaaagcattgagggtcgccctgtttttaaagaatgtcttaaagacctcgaggaaggcaagtaccaggcaattgctgttaaagaaataacaagactcagccgcgggagctacagtgatgcgggacaaattgttaaccttcttcaaagcaagcgattgattatcattacaccatataaagtttatgaccctcgaaatcctgcagacatgcgtcagattcgttttgaattgtttatggccagagaagaatttgaaatgaccagagagcgtatgacaggcgctaaatacacatatgcggcacaagggaaatggatttccggactagcgccttatggataccggttaaacaaaaaaacatccaaactagtcccagtcgaagaagaagcaaaagtcgttcaattcatctttaacatctttttaaatgggttgaatggaaaagattatagttatacagcgattgcttctcacttaacaaaattacaaataccgactccatcaggaaaaaagcgctggaatcaatacacaattaaagcaattctgcaaaacgaagcgtatatcggaactgttaaatataaggttagggaaaaaacaaaagacggtaaacgaacaattagacctgaaaaggaacaaattgtagtatcggatgcacacgcccctataatagatcaagaacaatttcaacaatcacaagagaaaattgcaaacaaagttcccttgctgcctaataaaaacgcattggaattaagtgaattggcaggcgtatgcacttgttctaagtgcggtgaaccattatctaaatacgaaactaggcgaacgcgagaaaacaaaaacggcacggaaagtgtgtatcacgttaaatcactcacttgcaaaaagaataaatgcacttatgtgagatataacgatgttgaaaatgccattttggattacctctcttctttaagcaacttagataataagactttaacaaaacatatcatttcgatgatttctaaatacgaagacgtaaatagtaatgtgaaaacaaagaagcaaatgtctgaacatctttcacaaaaagaacaagagttaaaaaacaaagagaattttatcttcgagaaatatgaaagcggcatttacactgatgaactttttttgaaaagaaaagctgttttagatgaagaatttaaagaactccagattgccaagcatgaactcaatggaactcaagaagcgcaatcagaaatagacagtaatacagtcagaaacaacataaataagataattgatcaatatcacattgaaacaagcacagagaaaaagaactcactattaagaatggtcttcaaagatgttatcgttacgatgacacaaaaaagaaaagggccaattccggctcagtttgaaatcacccctatcctgaggtttaatttttcgctttcgatctcaccgccactgatagttcctcaaaatgcagtaaatatcttaaaaaaccgataaagccgtttccccggtaaacacaatgggggctacgaagctgttgtccgagaagctgtttcatcaggcaaatcatcatgttcaaaaccgcggtacggtgttttgttcggtccgcttcggcaatgtgctcggttcacgcggttccgttattcctattttatttgagcagttgatggcaggcggtccgctcaccattacggataaaaacatgacgaggttttttatgtcgattgatgacgccgcaacgctcaccctgcaatctgcggcgattacaaagggcggagaaacgtttatttttaaaatggaatccctgaggcttgaagaactgcttcacgggtttgaagaatatgcgttccggcatggactgccgcggccagccgctgttgaagtgggaaaacgcccgggtgagaagcttcatgaagaactgacctctcctcatgagacggaatctttatatgaatggggcaatctttacgcgatattgccggatcccgccaaacatccggaatttcggaaggtcaatctccccagatatcaatccgatcaggcgccgctcatcacaaaagacacaatcgtaaaaattattgaacgattacatgaagaaaaaaaaacatagaaaaaaggcctgtctgataggcaggccttattgctgagctctatttttcaaataaatgcaggcaggcttcatagccctcttccttcagcttgtctttcggaataaaccggagtgccgcagagttaatgcaataacggagaccgcttggccccgggccgtcattaaatacgtggcctaagtgggagtccgctgttttgcttctcacttccgtccggatcatcccgtggcttgtgtccagtttttcgtcaacctcttcttcctcaatcggttttgtaaagctgggccagccgcaatgagaatcgaatttatccagagatgtaaacaagggctttcctgatacgatatcaacatacagcccctcttctttgtgatcccagaattcattttgaaacggcggctccgttccgttattttgcgtgacttcatattgcatgcggtttaatgatttgattttttcttctttattaaaagccatcttatctgtccctccaatgctcatccagaaagccttgacgtccggaacctacacggtagcgcccgtagtgatcaggatttttcttataaaagtgctgatgatagccttccgcttcataaaaaggctcagcctttaaaatgtctgtgacgatcggctttttaaatatgccgctttcttcaagctgtttttttgaggcttcagcgatttgtttttgctcatcattatggtaatatatcgccgcccgatatgaacttccgcggtctgcaaactggccgcctgcatcagtcgggtcgatctgctgccaaaacagctcgacaagcttttcatacggataaatgtcaggttgaaatgtgatttgaacggcttctctgtgtccggtcgtttcactgcacacttcttcataagtcggattctcagtatgacctcctgtatagccggacaccaccttttcaatcccgggctgttcgtcaaacggcttcaccatgcaccaaaaacagccgcctgcaaatgtggcgatttcttttttttctgacatacgggtgccctcctttgttcatacgtggtattattatattatagcatgtataaacagaataaaaataattctgctctcaggggaagctgaacgaatgccacgctgactacatattggaggttcatgatttgaaagtaaggacacaaatgatgtatgatatggaagctttgcttcgaaaagtgtttaaacaaatcagaaatgaagttaatgaaattctagataaagagctgtccaggaacgaattcaccattttgcggattctcagtgaacaagggcctaaaaaagtaacggaattcgcccctattcttgaggtctccgcaagccacattaccgcagtgaccgacgctttagtagaaaaggaatggatcacccgcatccgttctaaagaggacaggcgaattatcagaatccatattacggaagccggggagaaaattgtcgatcatttcaaccagaaaaaaacagaatacttttttaaacggtttgactgctactctgatgaagagcttgcgacgttaatcaaactgttcagcaagctagacaaaaaacgctgacacaaaaaaacacaaatccctgaaaggatctgtgttttttttatgaaaacttattgtttcggatgataataggaaaattcaatttcatccgtatcgagattgattttatccgcttttacatacatgccgttgtctaaaggcatttctgacagacggatctcgatgcttttatccccggaatgaacgtgcacaaatgacgggagttcgtaaaagctgtccatataattcagcacaaagctgatcggcaggcttaattcgcctaatgaaaacttcgtcactttcaaaaccacatctccgttctcctgtacggacggttcaaatgtgacgaccgcgttaatggaggttgagaatgctttgattttacctgccacgtgcacatcgttattgatgtccactttgtagtcaagctgattcgatgccttctcttttaagtacgaattcacaaacctggcaagtgattctttggagcttgtgatatgaaagccgtactcactttttgtctgatcttgtattttcgcctgctctcccggcataaccaataatgtcacaattaccgcggcggcaatcacattgagtgcgagaagaacaaaaaacagcgatttccactttttcatcatttcaccctattctgctggtaacccttgtttttctatgatgccgtataatcggtcggcgatgagtgcatacccttttgcgttcggatgaaaatcatcatcctttgaaatccgtctgctgccgcttttttgactgaacaagtcttcaacattcaccgcagcggcgtggggatctttttccagctcttttgcggcgatcttgttccaatccgtcacaaccccattaatttcttttaattcaggcagcgtaaacgtgaacggattatacatgctgacatacaccagctctgcgttttcattatatttgcggatttttgaaatgatcgccttgaaccgtttttcaaaaggtttctcttccttttggaacggctgaaccgtcagctgcatcatattctggcggagcaccttcattaagtcattgccgccgatggtaaaaaagatatagtcggcgctctttaatgatttctgcacttttttattatcaagcttttccagcaggtccgacgttttgtcgccctgcaccgcataatttttaatatctaccgttttcacatgtccctttttcttaagagactccgctgtcttgccgacgtatcctgaaccgtcaggatctcctactccttcagtcaatgaatcaccgaccgcagctatgacaatatgatctttcgttttcggttcttcagcgtcagaaccggtgcgctggacagaacaagctgataaaagcaaagccagtccggcgatcaatgagaacattcgcagcttcaatctggttgctccttccccgtctactagtggaaagtgtaacatgttttttcagttttgaaaatgtctaatctgccagtttacttgagctcctcagccgctttgacatctgagaggatatcatcatacggaaccttctgcacgccgtcataatctttaagcaccttgccgtcaggtccgactaaataaaaagaagttttatgtatgacctgatcctctccctccggctttttgacgattgctttaaagctgttcagcgcaaaatcttcaatgtccttttggctgtaaccggtcagaaaatcccagttgcgaagcgaaagcggatatttggaagcaaaggctttcagctgtttcggcgtatcattttcaggatctacactgaatgacacaatccgcacgtccaggttctcagccttcagttttttttgcagttcggtcatgtgggccgtcatcggcggacagactgtattacagtttgtaaacataaaatcggcaatccagacatgccccttcaggcttttcagtgacactgttttcccgtcttggttctgatatgaaaacggctcaatctgatagttcagcgggtcttttatcgttttcccccgcaggcgcacaagagcagcaaacaaaagacggcagcgaagcttttcatttttttcatttccattcccccccatagataaaacgcttacagcgttcatcataaaaaaattcccgcaccctcccttatcaaaaggaaggcgctaaggaatgtgcaccgttatgcgttatgttttaaaatctcttggatgaaaacggcctcataatctttccacttcatacggcgcttgacatattgtcggaatgaatacactgttctcacactttgtgaagcaaaaacttctctcaaataaagctcaaggtgctgatgaatttgaaaaaaataatgttcaccttccgtgacaaccggtatttctgtcacttttacctgaatcccgtcctgtcgtttgaactctaggcttttgagtaacaagatatcaatccttctttttcgattgttttctttttattatatacaatctgagaaagcgtgtctgtcattttgcgcggccgttctaaaaaaagtcagattaacaggtggaacagatcctgatctttattcacctctacgtaatgaaatcctttttgattcatccgggcaatgagcgcgccgtaatcttcccgatgcttaagctcaatgccgaccaatgcggggccgctgcttttgttattttttttcgtgtattcaaaccgggtgatgtcatcatcaggaccgagcacctcatcaaggtattcgcgaagcgctcccgccctttgcgggaaattaacgataaaataatgctgcagcccctcgtaaatcatggagcgctccttcatctcctgcattctgccgatgtcattattccctccgctgaccatgcagatgacgtttttccctttaatctcttctttgtacagatcaagtgctgacacggacaatgcacccgccggttcagccacgatagcgcattgattatataattcaagaatcgtgctgcacacttttccttccgggacaagcaaaacgtcatcgacgatggtttcgagcgtttgaaaggtttcagcgccgattttttttacggccgccccatcgacaaatttatcaattttctcaagttcaaccacttgtccggcttttttcgattcaaaataggaggctgcgcccttcggctctaccgctatgatttttgtatccggcgagatgtttttcatgtacgtgccgagcccggacaggagtccccctccccctacgcctgcaaaaagaaaatgcggttcaacatcaatgtcatttaaaatttctatggcagccgttccctgtccggccatgacatcgggatcgtcaaacggatgaataaacgtgcggttttctttttcacagcattccgcagaactcttatacgcatcatcgaaagtgtcacccgtcaatatgatttcaacaaattcttttccgaacagctccacttgggatactttctgtctcggtgtagttgacggcataaaaatcttgccgtgaatgccgaggtgtttgcatgaaaacgcaaccccctgcgcatggtttcccgcacttgcgcatacaattccgttttcagtctgctcttttgagagctgcctcattttattataagcccctctgagcttaaatgatctgaccacctgcaggtcttctcttttcaaatagatattgcagccatacctctcagaaagtctgtcattcctctgcaaaggcgtatgtatcaccacgtcctttacgttttggtgcgcttttaaaatgtcttttacctggatgagagagtcttctttaagcaacggtttcatttacagagtcctttcttatttaaatccctatttaatatgccattataacatgaatattcgaacaataagataattattttaattttgtaaataaaaataaatgaaccgatacaagagaaaaagatattttcgatcgcataaacgtgttatacttaaaccaattagaaccaaaaggagccaattcatgagtgtaattgaacaaactgatcctttttatcagctagccggcgaacatcacaccttttcagaagcgaaacgattggcctcgcaatttgccttatctgatttgccagtcttcataacaggtgaagtcggaaccggaaaaaaacaaatggccagagcgatccatcataaatcccgcagaaacagcgaactatttattaccgttcactgcagccaaagcgaagatcggctcgaatatgaactgttcggcgctgaaggtgcattaaacagagcccgccgcggaacattattcttatatgaaatcggagacatgccgctctcggtacaggcccgccttctttccgagctggacgccgggctttccgcccgcatcattgcaagcagcacggcgaatcttggcgataccggcgcggaaaacacgttcagcatagatttattttacaggcttcacgtgttatgccttccgctccctgctttatctgaacgaaagagcgatataccgcttcttctgcagcatatgctgacagcctcgggacagcatattcatatcgacccgtccgtttatccgctgtttgagcggcacacctttaacggcaacatcagagaacttcaaaatgcggcgcactatatggccgcggcagcatccggcagcacgatttatcccgagcatgtcccgccgtatatcaaaaacagccagaaagcgaaaaccgctaagaaaaaagaaaaacggctgacattgatggagaaagaagagtttttgtttattttggaagcaattaaagacttaaatacaaagggcgaacccgccagcagacggagcatatccgaattaagcgaaaacagcacaatgacattaacgccccagcaagtcagaaataggcttgattacttagaaaagatgaactttgtgacaaaaggccggggacgcgcaggaacaaaaatcacattagaagggttgacctttttgcagtcactgcaaaaacaaatcctttaaaaaggaggacatttgattgttcacaataaaagaagaaatcgcaaatgccgtcacacacggaatcggtgtattgctgtcgattccggcgcttatttttctcattatcttcgcggtgaaatacggctcgccgacagacatcgtcagcttttcaatcttcggcacttcaatgctcctgctgtatctcagctcgactcttttgcacagcatccagcataaaaaaacgaaagacattcttgagattgtggatcattccgcgatatacgtattaatagccggaacatatacgccatttttattaggaccccttaaaggggcgctcggtctgacccttttaattattgtttggtcgcttgccatcggaggcatcgtgtttaaaatctttttcgtgaagcggtttatcattttttcaacgcttgtctatttaatgatgggctggctgatcatcatcgccattaaaccgctgtacgcttcgctgtcaggccccggtttcggtcttcttcttttcggcggcttattgtattccgccggcacaatattttatatttggagaaaagttccgtatcatcacgccatttggcacagttttgttttaggcggcagcgcctcgatgtttttctgtattttgttttattgcgtcaaagttccctttatctgaaataaaaaagcacagcctctcgtatagagactgtgctttttttatgcacggagccgtttctgaccggccggataataagcgggctttatatgtaattcaatgtcagccggtttcagccgtttcaataatctgccccgcagcagccggtctgttcccgaagtgctgacgggcacaatcgggagatcgaaacgtagggccagttcctccggattgattttgccgtcttcggacagaatcagactttgccctttctgcagacggacttccgcctcctgaagcactgcatcccggctgtctccgccacaaatgacacccatcagacgcagccaatttccgagaaacggcatccggaaagctttctcgccagcgataaaaccagccggctcttcaagatgtcccgcgagcagcagaagatcagccgggcgcaatttgggatgcacatacaatacggggccgtccgggatcggctgatcatgatgaatgccgattgtcgatcccgagacgtcaatacagcctctcataaaggctttcggccgttcatacaccagcctcatctgtttttgaaaagaaagccgcgggtcaagctctttttgattgatatattcctgaatatttttcatgaacataaatacaacgtacatcacaaggcagccgtaacgaatcaattcttgtccccctgcttaattctttttctcgtatacaaggtactcataatcgtaaggatttttttcattttttactccctgtttgcgggaggtcaattcccattcggcttcattaaattccggaaaaaaacggtctccttcaaagacatggtgaatttttgtcatgtagagtctgtccgcataaggaaagagcgcactgtacagctgggcgccgccgattacaaagcattcttcatccgccgggatcagcttgagcacttcctcagccgagcgggcggcaatacagcccgggaatgaagattcgtcccgtgaggttacaacgatgttacgccggttcggaagcgggcgtccgattgattcaaacgttttccgccccattacaatggtgtggcccgtcgtcacttttttgaaatacgcgagatcatcgggaaggtgccaaggcagatcgttatcttttccgatcagccggttctcatccatcgcaaaaataaacgaaatcatacgctgacagctccttttatgtgcggatgcgggtcataatcctcgatgataaagtcttcaaacgtaaaatcaaaaatagaatcaacatttcgcgcaaaccgcagtttcggcagcggacggacatcccttgtcagctgcaaattcacctgctccacatggttttggtaaatgtggacgtctccgaatgtatgaacaaactcacccggttcaagccccgtcacatgcgcgatcatcattgttaaaagcgcataagacgcaatattaaacggcacgccgagaaagacatccgctgagcgctgataaagctgacacgacagttttccgtccgcgacataaaactgaaacaggcagtggcaaggcggaagcgccatatgatcaatttcgccgacattccaggcgctgacgattaaacgtctggaattcgggtttgtcttgatgtcatgaatcagccgggagatttgatcaatggtctcgccgtccgctccgcgccacgaacgccattgagagccgtaaaccggtccgagttctccgttttcatccgcccattcgttccagatgcggactccgttttcctgaaggtagcggacattcgtatctccttttaaaaaccaaagcagctcatgcgcgatggatttaaaatggagctttttcgtcgtaagcatcgggaaaccttcctgaaggttaaaccgcatttggtagccgaacgtgctgatcgtacccgttcccgtacggtctccttttttttctccgttttctaacacatgacggcacaaatctttatattgtttcatttttttcatccttttaaagtagtcttttagtagtgtaacacaataaaaaatcatttctgcaaaatttctcagaaatgatttttttatttcttctcgctattacacgctcatccagtcaggcggcgtattgcggtcccagtaaatgctgccgagctcatgatgtgattgaaatccgtcttcagcggtatggtaatgaaaattaaaccagtagccgtcttgcggaggatgatcccggcggacgtggaaccttaaaagatcttcacctgtcagcctgttatacacatgaaaaattttttcggtttttccggccgacggtttactggaaataaccacatcctgatacgcttcatcatcttgaaacttggctaaatgtcctgtgatcacatcttcgattttcggcagaatttcacttctgtaatcatcttcaatgaccggagagattttgctgccgaattttaaaaatgattgattttcagcatcaccgagaagctgctgctgatacgattgaaacagtaattcaggctcccgccctgccttcgcttctcccggcagggcgtgttcatcataaaaagcggtgtaatcattctgctcaagactgctcgactgtcctgaaggcttgtctgtcatcaaagcagccggaggagacacgagtccgaacgttacaatggtaaacagaaccacaagggtctttttcatccacaatttcatgatagattgttcccctctgttttattgtcctcttttcctttattttagcatagattaaagcacggcgtcatgcccggcagcgtattatcatgcaatatgggaaattggtaactgtgaccgagcggataaaccgcttacaataagaaggagaaaaaggaggggatgagatgattaacgctttatttgcgactgtatcacttctcacgctgctttattttgtcgttatagaaatcactgattaacgaaaaagaagcccatgatatcatgagcttacatggatgacaccgaagtggaaaagcgccgtctttcttttcagcaccttgaagccgtgtcgttcaaaccgcgggcttttccaatggtctttaagcactacgcattttttcgccgcccggacggcttgcgtgatgcactcttcgttaaaaccctcttctgccagcgcgcggagcggtgcaatgccgtctgacgtttcaacaggttcgtgaaacatcgggtcaaaataaatgacatccaccgatgaatcaggaagctcccgcaaataatcggcgcagtcggcatgtttaacctgaatgcgtttcatggcggtttggagcggctccattccggtttcccacgtttgaagtcctgtttctacaagcaatgagacaagcttgtttttctccaggccgatgacttgtccgctttttccgactgccagacttgccaaaatcgcatcggatgccaggccgagtgtacaatctaaaaaggaatccccctcgcgtaatccggctgcttttaacaacggctcggcttcccctctcaaaaaccgctttgcgcggaacatcgctgtattcgggtgaaaaaagaacttctccccttgcttcgtgtaaagttcgaaccgttcctttccgataactaaaagatcgctagcggctcgttccagcattttttcaatgggctgtttattgcggctgcagtaagtgtcacccagcctgacactgagtgactgcgctgtgtgtatcgtatattcgcttggtctgtaactcgttgtaatcatctttttctccaaaaagaaaatgcccggaattcgggcatttcagcagtgcgcatcgaaggcatccgtcagatttttcataatttcctccatgtcatgcccttcgatttcgtggcggggaataaaatgaacgacctctttcccttttaacagtgccattgatggcgaggaaggttcctgccccgtaaaatattcacgcatttttgcagttgcgtctttatcttgaccggcaaatacggtaaccgtatgatcaggcgctttttcatgctgtaaaacagcctgagtcgcagccggacgggcaagacctgcagcacagccgcacacggagttgacaacgaccaatgtcgttccctctgcctgttccataaagctttctacttcttcagcagtcgttaattcctgaaaacccgcacccgtcagctcacggcgcatcggcacgaccagctggcgcatatattcttcataagccattgacataaaaaagccccctctaaaatccttatatgaagtcaaggatactatagagggggccggaattcaattgttcaggcctctgttttatattttcatgattccgcctgtattggcgcttgttacgagtttggaataccgggctagatatcctgtttttactttcggctcgaagcctttccattcggccttgcgtttttcccattcttcttcaggcacttgtacgtccaaaatccgtttttctatgtcaacgatgacatggtcgccgttttctacgaatgcgagcgggccgccttcagccgcttcaggtgatacgtgcccgattgaaagaccccgggacgctcctgaaaaacggccgtctgtaataagcgccactttcgggccaagccccattccgacaatctgagacgtcggagcaagcatctccggcatgcccggtccgccctttggcccttcataacggataatgacaacatctccttcttttactttgcggtttataatgccttcaagcgcggcatcctgagaatcaaagacgacagcgggaccttcatgtcttgtaatcccgtcctgtacgccgcctgttttgataatggcgccgtccggagccagattcccaaacaggacggccaaaccgcctttttcggtaaacggattgtcaagcggatgaatcacgtcataatcctttacttcatgacccgcaattgtttctcctagtgtgcggcctgttacagtcagcgcgtcaagatgaagcgccccttcttttttcgccaattcattaagggccgccgagactccgcccgcttcgtgcagatcttcaatgaagacgtccgaggccggcgccaatttcgataagtgaggcactcgttcagccacttcgttaatgcgttctaaagagtactcaaccccagcttcattggcaagcgcaagcgtatgtagcactgtgttggttgagccgccgagagccatgtctaacgcaaacgcgttgtcaatcgctttttcggtgacaatatcacgcggcttaatgtcttttttgatggtctccatcaattgggccgctgattttctcacaaactctcttctctccggtgaagttgccagaattgttccgtttcccggaagcgccagaccgagcgcttcagacagacagttcatggagtttgccgtaaacatgcctgaacaagatccgcacgtcggacagccgaactgttccagctcctgcaggtcgctttcaccgattttcccggcttgatatgcgccgacgccttcaaatactgaagaaagcgaaattttgcggccatcgcttgtacggccggctgccatcggccccccgctgacaaaaatggtcggaatattaatccgcatagccgccatcagcattcccggcgtaattttgtcgcagttcggaatgcagaccattccgtcaaaccagtgcgccgagacgaccgtttcaactgaatcggcaatgatttcacggctcggcagcgaatatctcatgccgatatgtcccatcgcgattccgtcatctactccgatcgtattaaattcaaaaggcacaccgcccgcttccctgattgcttcttttacgatttttccaaattcctgcaggtgaacatgcccgggaacgatatcgatgtatgaattacagaccgcgataaacggcttgccgaagtcttcttcttttacgccggcagcgcgaagaaggctgcggtgcggcgctctgtcaattccctgtgtgatcatgttgctgcgtaattctgccatggtgatccccctactgtttttagactgtgcattatttttaaaattttcagtttattctagggcgcgttctgcaaattacctgtttacagtgtctttgccctgtctcgcttttctattctttctgtatttcgataaaaaccctccaacaattaatattgtacttactatatagagttttgaatcatttttcaacaatattctaaataatttttataaaaagtgaattcaaataaaaaaggtgcatggcgcacctttttgttataactgttctttttttctgctttcagtcatttgtttccagactgaacctttcgcctcttctccgtgctcaatccgttcaatcgccattttaacttgcaggctgacttcgaattccggatcgtcttccgccgcttttaatgcttccagcgctgtttcatcgccgacttcatataaaaacatggccgcgcgccagcgcacgagcttgcttgagtcactgagcgattttatcattgccgggatggcgctcgcatcgccgagatccgacagacagtcacccgccgtccttctgaccgtcaccgttttgtcttcaagcgctttgtataacagcggaagcacagacggcttttcgatcattcccaaataaacgacggcttgtcttctgatcgaagtcttcggatcatgcagcgccttttccaatactggtaaatcgtcttcatccggatccatttgctcaagatgggcatagcgctgtttccagtcttcatcatcgagcatttccaaagtcactttataagctttccgctgcactgccggtttggcctcacccttttgctgtacggctgcttctgtcaggcgtttgagccgctcatcactgtaggcggcctgaagctcttctgtgacatcgtgtccgatttcggtaaaatccccgaagcgcacgccttgttctttccaagcccgctcaaatacaacatttgaagcttcggaacgcagctttaagatggcttcttggaaacgttccggaaggccgaagcgctcttcacgttcgccgtccgtcaatttgacctgcatcgggattccgctgaacatttgtacgaaaaccttcacttcaccgaacgattcctgttcagaacggctctcagactgctccgtatgttccattccgaaagcggaacggacctgaggcagaatgtccttccagtcaaaacgggcgtttctctccacagccaggaaatcggcaacgtgataaacgccctttactccttcaatgtttaaaatatcacgtacgacggccggagcatcatctgcctgatcgggcttgtaattgttgcttttccccgccggaagctcttcagtcaaaatcactttcatcgtgttcggactcggcgtcggttctattgatttaatcttcatattggtcctcctatgcgcaatctgacacttattctaacatagtcggcacaagcgttctattgcgccgcttagcttttgccgatgccggcctctttttggatacgggcggcgaactgcaaaagaaattgatgccgctcctctgctaaaccggcccccgcttttgtattcattaagcctttaagcttgattaatttatcctctatatgggccagcacacttgtttgagttccgtacatcgggtgacccttcgcgccggcaaacataaaagccctgccgatgcccgctgcgccgatcgcatcaagcatgtctgcatcctgaacaactttcccctccaatgaaagcggccgctttatcagcagttccctgtgtctgaatgacattctcgtgatgatatccgcgatctcctcaatggagccagccgcaatgttgaaagcagccagccgttctgtcacttcgcctgccgtcagcctttcgcttttttcgagcttggtgtcaatcagatcatgaaccagcgcggccgtctcagtgataaataagtcggcgccttcttcttttgccatataaacagaaagtgctgcgacccgggaaatatgaagccagtcatggcccgtacgttcattgataagcttttctctgacccaattcctgacgctttccagctgctctttttcgttcaccgtatcacctcttattgggccaaaagcctctgcaccgtatcttcaagctcttttgggttgacgttaggtgaaaaacgcccggtgacttcaccgtttcggtccacaataaacttagtgaaattccatttgaccgcttttgtgccgagcatccccttcgcctgctccgtcagatatgtgaagagaggatgagcgtctgctccattgacatcaactttcgcaaacatcgggaatgtgactccgtagtttttcacacagaactcttgaatttccgcttcgtttccaggttcttggttcatgaattggttgcagggaaatcccaatatttcaagaccttcctcccgatatgtatcatagagctcctgaagctgcttgagctgggatgtaaacccgcatttgcttgctgtattcacaatgatcatcaccttgcctctgtaagccgatagcgtcatgtcttcgcctgttatggtccgtacgtttatatcgtaaattgtcatctgcggccctcctttttacattcttcatttattttacctgttttacactgcaaaacaaacggtaaccgctttttccttccacttaacggaaaacgtattttccgaggaaccatacggctctttacccgtcataataaagagccgctccgaatttatgtccatttaccgcttttatccctgtcattatgcgttaaatgcggtttattacgccgggatggattgaaaaatggcttaaaaatttctataatgaagaaaattaacggggaataacggaggtggcatgttgcctattaatataccaaatcacctgcccgctaagcaggtgcttgaaagtgaacacatctttgtaatggatgaaagccgggcttttcatcaggatatccggccgcagaagatcgtgattttaaatctgatgccgaaaaaaatccaaacggaaacccagctcctcaggatgcttgggaattcacctttacaagttcactttacgttcttaattccgagcacacatactccaaaaaatacggcaaggcagcatctggatgaattttatacggatttttccagcatccgccacaaacggtttgacggaatgattattaccggggctccgattgagcacctgccgtttgaagatgtttcttactgggaagaattgaaggaaatcatggaatggagcaaaacgaacgtcacttcaacactccatatctgctggggcgctcaagccggtttatactatcattacggcattgagaaagtggagctgccgaaaaaaatcttcggtgtgtttgaacataccgttcttaaaaaacatgagagattggtaagaggatttgacgagctatactatgtgccccactcacggcatacagatattaatacggagcagctgcaatcggcttcggatctggatgtgctcagcgtttcagaggaagcgggggtctgtttaatcgtttcaaaagacgaaaaacagattttcttaacgggtcatccggaatatgataccgatacgctgcttcaggagtatgagagagacatagagagaaatctttcaaacgtagaagctcctaagcactattttgcgcccggcgggaaagaacctgttaaccgctggaaagctcatgcaacgttattgtttatgaattggctgaattattacgtatatcaggaaaccccatatgaatgggattaatttttgttttgagtgatacggtgacaaaaatatgataaaatactcttgattcagtatgcgtataacaaaactttaaaataatggaacatatcaattaaatttagtttaaatatgttgccgcgcttattataaaatgatgcacttgtgttatgtttatctatagacaataactccttacgatgcatgaagcttgcttgttgttgattacattgaggtgaatttacttgaataccaataaaaaagtattaattttgactgcaaattacggaaacgggcatgttcaagtggccaaaacgctctacgaacaatgtctgcgtctcggcttagatgtgacggtttccaatttgtatcaagagtcaaatccgattgtttcagaggttactcaatacctttatttaaaaagcttctcaatcgggaaacagttttatcgtttgttttattacggagttgacaaaatctataataaacgcaaattcaatatttattttaaaatgggaaataaacgtttaggccagctcgtcgaagagcataagccggacattattatcaatacatttccgatgattgtcgtaccggaatacagacggagaaccggaaaagtgatcccgacgttcaacgttatgaccgatttctgccttcacaaaatctgggttcatgaaaatgttgataaatattatgtcgccacagattacgtgaaggaaaaactgattgaaatcggcactcacccgaacaacgtaaagatcacaggcattcccatcaggcctcaattcgaggaatcgatgccgaaagaaccgatttataaaaaatacaatctctctcccgacaaaaaagttcttcttattatggcgggagcgcatggtgtgctgaaaaacgtaaaagaactgtgcgaaaatctcgttcatgacgatcaggtgcaggttgtggtggtatgcggcaaaaacagctcgctgaaagaatccctcagcagcttggaaggtgacaatgccgaccggctgaaagtgctgggctatgtagaaagaattgacgagctgttccgtattacggactgcatgatcacaaaaccaggcggcatcacactgacggaagcgacggcgatcggagtacccgttattttgtacaaaccggttcccggacaggaaaaagaaaacgccattttctttgaagatcgcggtgcggctgtcgtggtcaaccgccacgaagaaattttagagtctgtcacctcccttcttgcggatgaggagaagctgaaccggatgaaggacaatattaaaagcctacacctccccaactcttctgaagtcattttgcaggacattataaaagaatctgaaatgatggccgggaaggcggatatggcattatcgtaaaagaaaagcacacgaacgattcgtgtgctttttgtttttttccggttaagctttgttactggaaaaataaagataaaaaatagggagcggccgcttgacgcccgctcccatatggtgtatagttgaaccatcatttaacaacgtttacatacgtacggttggatgatgacaaaattttttttagcacgaaggtgctacagtactaggaggaattaagcaatatgcaaaacggtaaagtaaaatggttcaataacgaaaaaggattcggcttcatcgaagttgaaggcggagacgacgtatttgttcacttcactgctatcgaaggagaaggatacaaatcattagaagaaggacaagaagtttcttttgaaattgtcgaaggtaatcgtggacctcaagcttctaatgttgtaaaactctaaactcaatacatgttgatcagatgacaaatagaggagaggcgtatgcctctcctatttgattgccgtctgaatctcaattgcgacaagattctgcttacagcgctgctcgatttcttctatttgcttctcctttgacggcattcctttttttgccattttcgctaaacttcccaaatcaccgtatatttctttaaatgtctgctgaaggattgtttttaaatcattatcattcacggctggtttttcccttctctcccaagataccctgaataatagtaaataagccctaattaatcaggttcaatagttatatcggcttattttctatatttttttctattttccgtacatatttctaaaaaaaatctccaaactatttgcggaggtgttttttaatggactctgaatttttcccaaacggactgacggataaacgccagcttgaattagcagtggaaactgcccagaaaacaacgggagcggctacccggggccaaaattcaactttggtggaatctgcttaccaagcgattcaggatgccagaacgatgtcacaatccagtgaactgcaagctctcgaccaggattttctgcaaaagcagcgaatgcttctcgacgattgccagcatcagcttgatgaattcgaaaaataaaaccgcagaagctgcggttttattttttattgatttgtcagcaccttgccgtaggctttcagcttctcccccaccgtgcattggttgatacagaaagaatgagcgtgcgtttttccaaactctttgcggaaatgctttttcacgaaacagtctttgcaatattcatcctgaagctctgtcaattctttataaatgctttttttatccaatatcagtcatctccgttaccttctaatgttatgcggctttcaatttgccggtccgagagaatttttctggcaaggtcatccgcttcttgattttcctttcggtttacggcttcatatgccggtgtcagctttaaggattcgagcagcgcttcaattttatccagccattcgttttgcgtttcatcataacacggccagctgccgtcaagctgatgcaaaacgacgagggaatcccctcttatcgtgattgaatttctgcttgcgccaagttcctgcacttccttaagcgcttcgtacaaagcggcatattccgcctcattgttcgtctgaagcgttaagcttttgtttttccgtatgcgatgccgcttgccgccgagagaataatacacgacaattccgagtcctgcgcgtccgcttgttttgtcaaagccgccgtcgaaatacactgtaatgtcgtcaggttcgtacgcaagttcttcagtaagcttttctaattctttaagcgtccagctcgcgcctttttcatcctcaaaataaatgttttttatataaggaaagcggctgacttctcttgcaagcatgcgcgctttcggaacggtcagccaatcttcggaaaaaaacgcgacagagcctgttccttttgcttctatttcgatatacggcttaagattcattgaaatcaccttaccattcattagttgacgggcgtgtgctataatcaaaccattctcaaattgaaaggaagtcagcaggttttgtttaacgatgtgttatggagcttatttgcggtcattcattttatcattgttcttctgttttataaaggatttggcaaaacgggcctattcgtatggatcggtttcgccacggtgtgcgccaacttgcaggttgtcaaaacagttgagctgttcgggctcacggcaacactgggaaatatcatgtacggcaccgttttcttcgcaacggatgtgctgaacgaaaaatacggtccccgggaagcgcgcaaagccgtctggctcggcttttccactctgctcgctttaacatgcgccatgcagggggctcttttatataaaccggctgcgtcagatatcgcacagcctgcccttgagacgattttcggttttctgccgcgtgttgcgctcggaagcctcttggcttttattttcagccaaacgatagatgtttatgtatattcaaccattcggagaatctttccttcagataggcttctctggctcagaaacagcggaagcacggccctcagccagctgctggatacatttatcttcactgccgtggcctttctcggcgtttattccgcgggcgtctggttcagcatctttatttcgacttatctgattaaatttgcggtatcactcatttctgtcccttatgcgtatgcggcaaaacgaatgacaccgaagggagagtgagggatgatgcccgctgaaatttacgtggacggtgcaagcgccggaaacccgggcccgtccggtatcggtatttttattaaacatgacgggaaaacagaatctttctcaattccgatcggcgaccattcaaatcaggaagctgaatttctcgctttaattgaaggaatgaagctgtgtgccgcccgcggatttgagtccgtgtcattccggacggattcggatatcgtggagcgggccgcagatcttgaagcggttaaaaacaaggctttccagccgtttgttgacgaaatcatccgcttaaagaccggatttccattgtttttcattaagtggattcccggcacacaaaaccaaacagccgatcagctcgcaaaaaaagcgattcggctgaataaataaccggaatgaaattgcgtctcactgttcatcctacaaatgaggtgaacagctatgagaaaagaaaataaaggccggctgaccgggggcgtgaatcctcagggaaatatggaaggaaatgcgcataaagacccgaaatcagcccttgaaaacaacgcaaaaaaaagcaatacaaaacgctagagggatcagctgatctctctggcgttcagcttttcgagcattctttcaattccttttatctgatggcgtctgagcattaaggatgcttcttccatcttcaatgaaaaaagtgcttcttcaagcgtacagactaacggcacctcgcaatgtatttcagcaagctgccttgacagctccaattctttcaagctttgctgaattttcgtttgctggcccttcggcaagagagcgaggctttctaataaccgttctatgttttcgtattcacggatcagcttgtacgccgttttttccccgatccctttaacgccgggatagttatcgctcgtgtctcccatcagcgccttaatgtcaatcagcgcttttggcggaactcccgtttcttctctgaatatctcatctgtatataccttataattgccgatacccttttgcagcagcgctacttgaacttgttcattcagcaattgaagcagatctttatcacccgttacaatcgtaatttccgcttccccggcaaatagggcagaaagcgtaccgatacagtcatccgcctcatagccttttatgccgatgtttaaaaacccgagctctcgcgctgcttctttcgctaaatcaaattgcgggatcagctcaagcggcggttcgcttctgttggccttataatcttgaaacaaatcattgcggtacgttttgctccccatatcccagcagcagacgacatgtgtgggctgaaacgtatcaaccgccgtaatgagatgctttagaaaaccgttgacgccgtttgtcgggattccgttttcatttatcataaaattgcgatgaacagccgtcgcgaaaaacgagcggaacaaaagcgccatgccgtcaacgagcagtaatttgttattcatatatcgaaactcctttttttattcaatgttcctattttaccaaagaaggcggtaaaaaaacagcatccccccatttggaagatgctgccgtcacgttactcaccgtgtcttttattgcttgccatcagcttttcagcttcacggccggcataggaatcaaatttctgtccgaagccgtttttctttttggcattgttattctgctgagcatttctgtttcccagttttgttctgcccatggtcatatccccctttagagaagatacggatagtatgtacagcaagcgctgatgacacacgcggcaggttcatccattactgtctgctgacgaattctttcaccatctcttcacttacgaatcgtctttgcggcacgatgccctttttcgccagctggttcatttttgcggtgatgccattaatggcatctgtcgtgaacggttcattctgtctgcattttacaatggcttcttcaatggcctgttcacgctcatagtcaagctgtacaaatgttttgacgtgctgatgctgttttgcggaatgtgctgaaattgctttatggacttctgacataaaaggtttcatctcgcttttttcattttagtctaccacgactgttatctgcccgccaaccggatttttaaattttcagcatttcatctttctttttccatgctttttcggcctcgtaaaggtgttcaatttcccttgcactcgtattttccgccgcaagaccttgtaaataagtgtcccgctgctcgcggatctgggacaggcttttatccgccatgtcttcttgcagacggcgcacctgctcagtatatcgctctgaaaggctttctttctcctgctcaagccacttttctgtcactttttgcaggctgagcctgagcccttccacaaacgctgcttttccgttctgttcaaaaaactgcttcggcgatttaacttcttttatgtgatgtgtgaatgccgagacgtcaatgaccggagcgacctctttcagctgaacggcaaattcgttttcggcgctcacataaatagagaaatctccgtcttccataagcttcttctgacagttttccatccattcctcagtcatatgacgctcaataaaaccggtcatccggatatcgagcgttttcagctcttgaatatattcaaaacggaattccttgagcgcttcattcagcgccgctgatatattttgtttccaatcaccgttttgaagacccggatggaaggcggttttcagcatatcattcgcataaaacgtcaggcgatgtttaatgtgatagagctgctcttccgtatctttcatcacttttcgaatgatgacctcagacgtacggcgctttgaaatgtcagcgagagctttttcataggaagactccagacgctgtttctttttctctttttcttctgccgactggtgaagagattcgtgaagctgttccaccatatcgcacaatttgtcggcctctgttttcagctgggcgcagcttgccctcattacatcttcctcaataaagtgctcaagcccggttcttacatcagagaacctgttataaaaagctgcttttttacccgcaagctcttctttacttgagacatgatataatttcggccggttaattccctcttttgagagttctgagcggacatagtctttgacggtttccagctcgctttcggttttggccagatctgcggcgttaatgacaaaaaacattttatccatgccgaatgattctttgacgaggccgagtttcttcagaaaagacctgtctccttttgaaaaagaatgctgatagtacgtcatataaaagaacgcgtcagcatcttttatatattgaaaggcaagttccgtatggcgcttgtttatactgcttgctcccggcgtatcaacaatggtgatgcctttttgcgtgagaggcgaatcataatacacggtgacttcttttacgcagcaggccgttttttcttccgctgcatacggttttaaatcttcaaccggcaccgtcagtgtcagcctttgacggatctgttcttcatacgtatcaaacgcctgcagcatcgtctgaatcaccgggataagttcatccggaacttttccctttttaatggcataattccatctctctttcagtgaacgtccctttacatcagcgtctttcagctcagtcagctgaagcatttcagcgtccagctcctcctccgttttaaaaacgatctccgcagatttatgcggtttgccgtcttgcggtttcgttattttgttgatcgtagccgttgtgggcgtcggtgatgacggaagcacgtattcaccgacaagcgcatttgcaaatgatgatttaccggaactgaatccgccgaataacgccaaggtaaactggcggtttccaagccgctcaatcctgcttcgaaaggcttctgcctgttttcctaatatgctcgaggattcaagaatcccagcaagctcatagaatcgatcagtctgctcttttatagaaagttccttcatcgcatttttttcgggcttgtttacttcatactgtacagtctcttttggtttctctatttggacgggcgcgtttgcaagacgtttttttcgcgtataccagtcgccgcttccagtatcacaggtcaattcttcttcccacaaagcgcggactcgggctgctttttccaaggcattgcgttcttcttttgccgattgcgcgagctcatcccttatcttcttttctttttcgagccgttttttcaagttctcaatgagcggtccgttttttgcctgaacataagcggtcagctcctcaatgagttccgctgtttgtcttttggcttcccttctgatcatctcagcgaggtctttcgtataagttaatacgtattcagatgaaaaggccgctccctgcttaatggcctgagcggtgatatcatcagaaagcggtgtgcggtacgcctggattttcttgatcagttcgtccgaatccgcttcataccgcttggccgctttcgtaaatgtgtcgataatatgccaatccgcttccccttccgttctttttttaatatcggcaaaaaattcagcatgccttctctctttctcctgagccgttttcgcttttgaaaagaataatccggttttaaatgagggctgctgtgattcaatataagcagatgcaagctccctcatctcaaaaggtgtcagattagcgttctgcaatatgttctgcacgtcttttctgatgtctttctctgctgtttcagcctgttgaaccgcttttttaagctcatcttcaacagaacggacaagtgcttcttgtttgtcaaactgctctccgctgccgtttttatcttcttttacgagcatctctgtatgctctttgactaagtgtgcgacttttctctccgttaaggaccataaatttgattttgcctgctgtttcagcttctgcagatgttttttcagctgttccatgccgtttaaaggatggtcaggctcagtgacagacgtaaagaaaagcgattctttcggtattcccgcgccttcaagcatatcttccacctgcctgcggtactcttcaaacttcgtttcggtttcatcatgcctgtcaatttggttgacgatcagaaacaaattcggaatacggtctttgatggagctgagaaacagcatattttcttctgaatgaacgtgattataatgaacgacgtaaaataaagcgtcagcctgatggagaaccgaagcggcagataaaaaatgcgcttcgtccgtcgaatcaattcccggtgtgtcaatgtaggccgcataaggctctgactccttaaagccggcatagacttccaccgtttcaatttgctcaccgtctttacagaattgctgcacttgttttttatcgtaacttcctttaatttcagcataagccccgtccgtcgtatgaagcacgactttatcttcaccgtgccggatgacaacgaggttggcgcttgtgggaatcgggcttgtcggcagtatgtcttcaccgagcaatgtgtttaataaagaggactttccggccgaataatgcccggtaaacgcgatataaacctcttcatcagccgcttttttcataatggctgcgagctgatcggcccgtttttcatcttgatgatctaaaaattgtgcgtataaggcacccgttctgctgaaaatctccctgttatggcgttcttcttctgtcatgtgtctttacccctttgtgtctgtcgcatcaaatgacgttttcatttttagaaagctctgaaaaaaacctctcccccattttacacaagaatggcccacttttcttcaggaaacgtaaaaaagccgccgatatcggcagctgataaagaaaaaacacccgcggcattaaaaaccgcagatgtttaagaagacatcgatttattcgaaacttttttcaatacgaaaccaattaaaacactgtatgtacaaacggctgcaaataaaaataacattgtcattttcggcaccaccttgaatgagaatcattttcatatttacatcttatcatgagtgagaatgattttcaatctctattttgcggtgttttcttctagcgctttctcttcggcgcgaatcctcacagtgagcatgcaggcattgagaatcgaaaagagaaatagtgtccaatacgctccgtataacagcggcagaaaaataaattctaagatgacgaccatgtagttcgggtgtttcatccacctgtacggcccctttctgacaagctccgcatccggcacgacaagaattttcgtattccaataccgccctaatgataatagagcccaatacctgatcccctgtacaaataaaataatacatataatggcggcccaccttggagaaagcgttttttgaaacgccgccacctcagctgtaagagagacaaaaaagagcacgtgcatcaggacgagaaagggataatgtccttctccgtattcgactgcgccttgctctttcaccttttgctcattgcgccgggccacgatcatctccgcaatccgctgggccgcaagcagcatgataaacagccaaaacattaagaagcccccttttcccagctgaacagcaaaagctcagacgaaaatcccggcccgagagcgccgatcagccctttttcgttttctttctgccggccgcggagcaactgttcttttatcacgtgaaaaatagttgcggaagacatgttgccgtgtttttgcagcaccttccgagatgccgcaagatgaccggagtccattgaaagactcgttaaataggcgtcaatgacctttttcccgcctggatgggcaagaaaggttttaatgtcgtgaggatcgacaccatattctaataaaaattcatcaacattgtccttcagccactgtgaaaccagggtgggaatatctcttgaaaaaatgacttgaaaaccgctgtcggtgaattcccagcccatcacatcttccgcatccgacatcatcaccgattgagtggcaaatatccgcggaagaagcggctgtttgacgtcgtttcggttcgccttttcccctccgattagtactgcggcaattccgtccgcaaacagggaagttccgattaagttgctttttgacttgtcgttcggctgaaacgttaagctgcagagttcagccgcgatgacaagcacgtatgcttcaggatatgcgcggcagtattcgtacgccctggacaggccggccgctccgcccgcgcatcctaagccccagatcggtatccgttttgttttcgcagaaaacggcagctgattcatcactttcgcttcaatgctgggtgtcgaaagcccggtgctggaaataaaaaagatcgcatccactttttcatatgggaagggatttgttaaacaatccgggtttgttaaacaatcaagcgccgcatccgcactatgcttaacggtttcttccgtatacagccggttcttttctgaaaaaccccgcgccgttttataccattcaatcggccggacaaactgccttgattcaatttcgccgttttgaaaggcttttaacagccgatcaatatccttaaatgaatcggcaaacatccctctcgcaaaatctgccgccgtttcttgcgagacatgatacttcggaatgctcgttccgaccgacaacacatatgccatgcccatcacctcttcacataaaggtttccgcttttttcctgaatgtatgcataagtttgaatcgaggatttcactgacatgccattttaatttaaaattggcccttttgaatgataaaccgttcgactatacttgacccattcataaaaaaaggttgtgataagcatgctgaaacccgtcattcttaaagggtcactcgttcagttagagccgatgacgattgatcactctcaggcactttgtgaagctgcttcagaaaataggacgacttacgcttacacccatgttcctgacggaatcgaagaaacaaagcgttatattgaacgtgcgctttccgattatgaaaaaggacttgcattgccatttgcagtacggagtcttgaaacagaccgaatcgtcggaagcacgcggtttatggatgcggaagtgtttacgcggccggcggacgcagccccggaagtgtgtgagatcggcagcacatggtatgcctctgccgtacagcggaccggtgtcaatacggaatgtaaacttctgttgctgacccatgcgtttgacgcgtggcaagctgtcagggtgacgttgaaaaccgatgttcgcaaccagcgctcatgaactgcgattttgcggatcggtgcccaatttgaaggaatccgccgcgcgcatattccggctgtcgacggcggcctcagagataccgcctactactccatccttcgggcggaatggccttatatccggcaaaacctttctggccggcttgcagcatataactgaaaaacctgccgatatatacggcaggttttttacatattcggatcatggacgtataaattgagatcgatccgtccgtctgaggtgaccgctaccccctcagcttcaagagacagcttctgtacagaaaacatctcttcatctcttaatccgatttcaccctttgcattgatgaccctgtgccaaggaagacgatgctttttactcatggagtgaagaatcctcacaacctgcctcgctccctgcggacttcccgcaagaccggcaatttgaccatacgtcatcacttttccttcaggaatctgtttgataatggctaccgcccgttccgtaaatgtcatgtaactcctcatttcgcaagagcagatgattttcgagaaaatcagccacttcctgttcttatttttatagatgataattgcttcatcatcatacttattacatctctgcgtttaaatagattatctgtttgttcacaaaaaattaacaaagataggcatgtacatgtttaacataatatgtaataatacaattgtattaaaaaagaaaaggagtgtttgcaatgaaaatgaaaaaagctttagccggctcagccctatcactcgctttactctgttctgccgcccctgcttttgccgcaggtcctgctgatacaccttctgcagaaagcaaaacgaaggaagtatctgctttggcgacgttcatacttaatggttctggccctgattatcctacttcaatttaccagaatggaatcacctattatttagacaacatcaccttccatggtgctgatggcacttggacagccgtctacaaaagctgatttttcatgacggcggaatgattgtcttaagtaacaactaaaaagctgctaatataagggggctttgcccctttttttagtttcactgccttttataattgatccagcatatagcacctaggtgcgtaatttcatttcacccgatgatcattatcagtcgtactgttttctgcttttagacgcaaaaacacataatctaaaattctctcccgcgtgtctatccaaaagccgagtctcaactctatcaatccggaacattttatcgacgcctgagttccccagctaacgttaagaaacctcttacttgctcttttatttttgataaaacaccatccagggtgataacatgagatttgcttgggaagaattaattataattgcattcggaatgattttactgagaatttcagggagaaaatccattgcacaaatgaccatcgcacagacaatggtgatgatttcaatcggtacgattatcgttcaccccattttagaaactagtttattgaaaacattaatcactgcgtctatccttttagtgctttaattttgatggaatggtttcaagtaaaagtaaactggattgaattttttttaacccgaaaatctaaattcgatatagaagacggccaactcaatatagaaaacttaaagaagctgagactgacagcagatcaactcgaaatgcgtctaaggcttcttggcatttcaaaaataaacacaattaaatatgccactttagaagctaatggacaattaggctacgaattaaaagatgactgtaagcctttaaccatcaaagatcttaaaaatgtgatcgatccaaaattccttaacaatgagtctccatctcaaacagagggtcaagccaatctatttgaggaaatcaaaagacatcagactcagcacaagccaaaaaatcttgaataattcgctgattagtaaaaccttttgttattcaaaaccgaagccggatccagaccgttaaccgccgatcattttttaccgaaatcggtttataagaaacaaaaaagcatctgaagcagatgccttttttccgacgaggtccttgtatgcgcctgaatatgcttttcagccgcctatacccaccgtcggccttagccataatgttaatcagtttgtttttataaaatcattgattaattgatcagtcgttaatattgtggcaaattcatcatgcaatgtagccagagatatattgtgaatagtctctgcatcataatatgtatcattttggtctctcatcccgaaggctgctgttgcatctgaaatcaggtaggtatcaaatcctaaattaccgctcattcttgtagttgttgaaacacaatggggcgtagtcaaaccagttattacgacagttgttatatcatttgattttaaaatctcttctagattagtcccgataaagctgctgtttactttcttggttataatgacttctttatccataggtttaacgatttcctttatagcaaccccctcattttttggataaaataaagaaccaggtttatcagaaatatgttgtatgtatatgactgtccatcctttttctctccataatttcagtattttactaatattttcttccgcttttacgttatttcgttctccccattttttatcatcgaaagctatttgtacatccacaatgattaacgcttttttcttttctgccaccagataacctcctatattgaaaattagtatttataacattttaaataaagtttttacttttgtacaattgtttcagttttaaatttcatatcacacctttcccgttggaaaagcgctggaatagctaaagcaaacactcactcaaaggctgcagttcaccagaggccagcaataatcaactctttttctctatatacttatcagtatcccttttgccatccactcccctaacaaaattcacgctacgctcacaaaatattaacaaaaaaccccttggttatttttgtatttcatgtaataatacaagtgtattaaaaacaaaggagtgtttaaaatgaaattaaaaaaagttttaactggttctgccttgtctctcactttactcgtttccgctgcccctgcttttgcatccagccctggcaatacaaatagcgactcaactcaaacaaaattttcgacacaagcgaccaaagattcttttacaatggattaccttcatagatgggatatcccaaatacaactgttaaaaatggtgttacttattaccttaagaaagtagagataatcgaagggttctatcgcgcaacttttgaaggatggattaattagaagaaggggctttcccttcttttactctcttttgtaaggatcggtgcacaagacactccccctcagtgcccatcctgcagtttcatttcggcatcaggcatttcattccatgtctcaaccaagtttcgtgtcatcacagtgcgagcaatgatattgtttacgatatgatcccccattctccttttttttcttacatttagtcatatgttcacgtacatatagttcgggacggtttttcggcgaaataaggcggatgccgcatcactcaatttgttttttttcaaacaatgaaactattaaaaaaagaggatgcctcgcaaaaagttcagcaactttcggaagcatcctcgatctggataaaataagatgttattttaaagaaaacggatcactaaccctcttgaacccttgtcacatcaagggtttttttcgttttaggaatcatattataaactatattcaaaagcacggcggtaaagcttccggcgacgattccgtttgtggtcagcaaatttaagtaagacggcaggtgcttaaacatatcgggaacgacagttacaccgagtcccaatccgaccgaacacgcgacgatcagaaggttttcctgctttttaaagtcaatttgactgagcattttaatgccgtaggaaatgaccatgccgaacatggccaccatcgcgccgcccagtactgaagacgggatgatggtcgtgaaggctgcgattttcggaaaaaggccgaagagcattaaaagtgcgcccgtgacaccgatgaccgcgtttttcttaatccccgtcagctgcacgagaccgacgttttgggaataggccgtatacggaaaagcattgaaaatgccgctgatgaataccgccagaccttccgcgcggtagccttttgctaaatcacgttcagacaggcgccggtttgtcaggtcaccgagagcgaaatagacgccggttgactcaacaaggctgacaatggcaacgatggacatcgtaataatcggtgccgcatgaaatgtcggcgtcccgaagtaaaacggtttaatcatttgaatggcgtcagcattcgccacattgtcaaattgcacttttcccataaaataagcgatggccgtcccgatgacaatgccgattaaaatcgaaatggatttcaaaaatccttttgtaaaccgataaagcagcacgataatgacgagcaccgtaaatccgagggcaaggttagccggatcaccgaaatccttgctgccttccccgccggcaatatgattcatcgcgaccggcattaaggtcatcccgataatcgtcacgacagatccggttacgacaggcggaaaaaaggatacgagcttgccgaagaaaaatgacagcagaatgacaagcagacccgatgccaaaatgcttccgtaaatggctgaaatcccgtactccttaccgatggaaataatcggcgctaccgcggtgaacgtacagccgagcacaacaggcaagccgatgccgaaacatttattcctccatacttgaagcagcgtagcagccccgcacataaaaatgtcaattgatacgagatatgtcagctgttctgcgttcagtcccaatgccgctcctacaattaaaggaacaacgacggcgccggcatacatggcaagcacatgctggataccgagggaaagtgttttggcatagccgtttttcataaacggacctcctgtacaaatgtcacttttccgtcttcaagcgattgaattctcgccagtgattcgacccggcatccttttttcaccagctcgtctcttcccggctgaaatgacttttcaatgacgattccgatcccgcaaaccgctgcgcctgcttgttttacgatggacaaaagcccctctgccgcctgtccgttcgctaaaaagtcgtcaatgattaacacgcggtcttctttcgagagatgatttccggagattgcaatctgactttctgtttttttcgtgaaagaatagacggacgccgtcagcagatcatccgttaacgtgagagacttcctttttctcgcaaagatgacgggaacgccgagttcaagaccggccattaccgcaggggcaatgcccgaagattcaattgtgacgattttggttatctcgtctttttcaaaacggctcgcaaattcccggccgatctgctgcatgagaaccggatcaatttgatggtttaaaaaagaatccactttcagcacttgatcagaaagaacgattccgtcttctgctatttttcgttttaatgcttccacaatgattacccccgcttataaaaaataaaaaaagcattgcccgctctccaaaaaaagagcaagcaatgccgaatgatctacacgtaacggccgaataaagccgtcccattgctcactcatagtcggacatttacggtgaccggtagaaacttgcgtgccatatccacgcgattatatgagtgttcgtatgatattaatcaaattataacaagatacacttcttttgcatagtgaaatttgaatattcccgaacttttacaaagaattagttttcgattattcgtctttttagaatttttagaaaaacgcccggtgtatgccgggcgtttcgtttataaatataaatttgaatatttgccgacgagatactcaatgagatattgaacgttcaattcttctcccgttgcatcttttatgatatcaagcggcattttgcgtcttccgtgctgatgaaccttttctgtcagccattgtttgatcggctcaaagtcgccccgttctattaattgatcaaattcaggcagatcctcaagcatggtatgcttcagctgtgccgcatacatatatccgagcgcataggaagggaaatagccgaaatcgccgcccgcccaatgtacgtcctgcaaaatgccttttgcgtcagatggcggcgtaatgcctaaataatcatgatatttttgattccacaatgccggcagttcttccactgtcacttcattgctgaaaatcgctttttcaatttcataacggataataatatgaagcggatatgtcagctcatcggcttcaattcggataaaggacggtttcgcctcgtttacggcgcgtacaaaatcctctctttttacattttgaaattgatcaggtgaagcctcaaccattttttcataataggcggtccagaattgttgatttctgccgataaagttttcataaaataacgattgggattcatgaattcccatggatgcaccgtcagataagttcgttccgctcagggcttcgtcaatattctgctcgtagatcgcatgcccgcattcatgaatcgttccgaaaatcgccgtgcggaaatcgttttcgtcatatctggtcgtcacccgcacatcgccgcggttgatcgtcgtcataaacggatgaaccgtttcgtccaggcggccgccgtcaaactcatacccaagttcttttaagaaatacaaggagagatctctttgtttttctttcggaaacgttttcgttataaaggaagtgtccggtttatttccggatgtcgtcacttttttgacaagcggaatgatcgcttccttcaattcagaaaacagctgatccagcacctttaccgtaacgcccggttcgaaaatatcgagcaatgcgttgtatggatgatcttcatagccccaatacgaaataaaccgcttattaaaatcaatcagcttctcaaggtacggagcaaacatagagaaatcagaggctgcccttgcctcctcccaagccgtttccgctttcgatgtcaaaatgacatattctctatactcatcttcaggtatttttttattatgatcataatctttttttgcaagttccgcagctttcactgtatcttcagagagctcttctgcatgcgcgagaaggatgtcaatcagctctttcatccggtcggatgtctggatttgaaaaacgtcagccgacagctgcccgatgctttccgcccggtcatcagaaccttttttcggggctcccgttcttgagtcccaatgcatgagcgcaatggcttcttcatagtgggatactctttttaacagatcaaaaaactctttttcatatgtatgtaaatccatatccgttcccctcccttttcactatcaattacaggctaatggaacgccgtcataaagtcaacttcccggatttaaaaaagccgcaggataagattcctgcagcttttgtttttatatgattttcggtgtaacaggcaagacctttttgacttcggccaggacccgttcactttctccgcccgcataaatggatatggttccgctgtcctgattagaacggatgaggcggccgattccctgccggactctcaaaagcatgtacggcagatcaacttcctcgaacggatcttttttcgctccgtttcgctttgcggtaaacacaggatcatgaggcggatacggcaatgcccaaatggtcacattccggagcgagtcaccgggaatgtcaagaccttcccataagtggacggaacaaagcacggattcttcatcccgctggaatttttcgaccagactgctgatctcttcgtcaccttcgtagtaaatcggatacggcagctcccacgcggcagcctgttctttaaattccttcatgtcttcaaaggaagggaaaagaacgagagtgcgtccttcattctccttaatggtttcaatcgtttcggctgttttctgctcagacgtcatgtcaccgtgaagcgaaacagacatttgctcctcgtaatcgtacggagattcaacggtaaatgataaaggatcacggattccgagactgtcagcgatataatcaaatgaaccgccctcagaaagagtggccgatgagaagatataaggaatctttttagaaaagaccttttctcccaaaacttcggctacagttctcggcataacgacaaacgttgagtctgtatcccgcgtttcaagccagctgatggcatccttttgatacagcgacagcgaatatgccatttgttcgacgtattcttctacgactgacagctcgtacttatcgatcgtatacatttccgattcaaatacgagcgcctcgccgattttatcgagcagacggcacagttcgtcagccgcacgcttaacacgctggtcgttttggatgtccaatcggtgagagccggcgatttccttcgattcctctgacagcacatagaaaaactcatcgtttgcggcaagggcatcttcaatcagttcggcgaattcctctctgatgtcattttgaagcagacgctctaaaaacagctcgagcgtcgactgcttcacacgatacgttaacgctttttgcgcggcgaattccagcagatgtccttcatcaaacacgacggcgctgtgatccggcaaaagcggcagctgcccttcccttttgcgtgattcttccgtccatacatgctccatgtagaaatcatgggagcaaacaatcagatccgttgattttctgtaatgatctcttgaaagtgttaaaccgcatctatgtctcatatcacatgttaaacaatcttggaaggaatcatagctgacgcctgcccactcttcatttgtcaaatcagcgtactgtttgcggtcgccgtacggataaaagcgctgcatcgcttgtgattcgtgtacgaatgaaggcagcgactcataaagatccagccacttttcatcatcagaacgctgcatcgttttctcaagctttttcagacacagatactgctcatgggatttggacagccgtgtatcaatctgcagatccaaatgttctgtcagcttggaaatgtcgccttcttttttgacaagctgttctattaacgtttcatcggcgcatgcgataatggccggtttacccgtatatctggcatagctgatggcaaacagcagatacaccagcgttttccccgtaccgactcctgcctcagcgaacatgacctttttctctttaaaagcccgttcaagctgaaacgccataaatacctgctcatcccgaaggtcaaagcctttctcgggaaggatatcgtaaaacacgtcaccaatccaattgttcaattcttcgtaaaaattcttttcttttgttaaagcaaaaggcaaacgtgatgttgtcacccaactccaacccctaactattcggcattcagaccatctataatatcatttaacccttttcaatacaacaaaaaaacttggccacgccaagtttttgtcattactcatttccggttaatgatatgtgtacataggaacggatggtctgttgaatgtgtatgttttaccgcattttcaagttcttcctgtgcgtgtgtcatggcggaaggaccgaactccgctccggcttcctccagccggaaagcagttgcatctaacgccttttgtattttactgaagtgctcgctgttcagcataaaataagatcacctctcaaatagaaataatcatcattctatgccgatgcttcactttctatacatgccatcctgaatgatccgcacctgacctgcacaaactacaacagatattcgatcgaatatccatcttcacaaaattattctatccgggagtgatggttacatgagttataaagatcgattagatcagcattctgaattgtttcatcacaattggacgcggccgaaacgctctaaatcgcaggtgaacggccacaccgaaatgtcccagaccaacattattttacggagcaacgcaaaagcgcaccgctggtaatggcagaataaaacgtaaagatgccggagaagacgctgtttcaggcgtcttctctttgttacggctttttccgctgcggccgcactttagcccagtactgataataatccgttttgataaaaccgttaaagagcttccgtttttttgttgcttttcttccgtagacctcttcaaattgttcatttgacgttaacatgtagacagaccatgtatcaagagattcaaatgcccggcccatttctttatacatctgctcgacttcctttttttcgccgagccgttcgccgtacggagggtttccgacgataacgccgaattcgagtttcgtcgtaaaatcctgcactcgcatctgcttgcattcgatcaggtccccaagtcccgcttcttctgcattttctttggcgatgtttaccatccggtgatctacgtcactggcaaagatctgcagcggctgatcatagttcgccttttcttccacttcaaggcgcgccttgtcccatagttcttttccgatccattcccagtcttctgaagcaaaatcacggttaaaacccggagcaatgttttgcccgattaaagcggcttcgatggcgatcgtgccggaaccgcagaacggatcgacgaacggacggtcaggcgtccagttggttaacagaattaacgcggcagcgagcgtttctttaatcggagctccgccctgatcaaccctgtatccccgtttgtgaaggcctgttcctgatgaatccagcgtaagcaccgctttatcttttaaaagggaaatctctaccttatactcgggtcccgtttcttcaatccattcattttgttttcctgattgaagtttcagcttttccgctatcgcctttttgacgatccgctggcagtcgggcacactggcaagcactgatttcacggactttccgataacggggaactttgcgttttcgggaatgtacgcgcgccagtcaatcgcttttgttttttcaaacagctcatcaaacgtttttgcctgaaactcggcgacctgtactttaatgcggtcagccgtccgcagccataagttagcgcggcagatcgcaagcgcatctccttcaaaaatgacttttccgttgtctactttgcattcataacctaaatcacgcacttctttggcgacgatcgcttcaattcccatcggcgccgtcgctattagtgtgtacttcttcatcgtatcaccctgtctcttttaagctttcgtttcattcaagataaaagctcccctttaaaggagagctctaatttgtcatatcaataatgtttaacgttctgtaagccatgttttgttccgtcgtactgcaatcggctcatcacctcgtactcaggcggcaatcatctatctacagaaagtattctgtccttctatctgttcagttccttcaagaaggttcccctaccaaaatttgggtttctcgctcgaggggtttaccgcgttccactctcaccatttctgatgagacttcgtcactgtggcactttcaaggatactcagccatatccggagacgtaggcttttttcctgccgtcagcctatcaaggctgccctagcttatttcttcgctaggcacgaacactacgggcatctcagcaccgtgcgagcatggactttcctctacagattcaaagatctgcagcgattacccgaacgttaagaacacttgttcattataaagcaacttgtctcatttgacaagtgcatctgccttattcgtcataaagtttgctgccgaatacatgtttctcaaggttggacagccttttcagaatgtcaaagttggtcgtattggactgcaccggctgttttttgcttgcttcttcaagctgttttttcagctgcagattttcctgctgcagttcttcaatttcttgatgaaaggtttcataatccttaataatcatatctaaaaatttgtcaacgtcttcttgtctgtaacctctaacgcctgttttaaattctttttccaaaatgtctttcgcagaaagctttactttatcagcaagcatctttttcacctcatatcgtgaatcatcatgttatattttattcagaaacacgtcccgttgtcaaatattctctgacgtgttatgtaaagaaatcttcttcttcaacggcggcacggagatcatccatcgtaatcgaataaatcggatatccgtcggtttcacggcgtttttctgcctgctgcagcatatatttcggcgacccttccacctccggatcatataaaagcaaaagcgcatctgacttttcaataaagaacgcgtttttctgccggaattggagcggactttcgtacggccgatgcgtcaggctctcctcataatctgcctgagcaagcaccgcttcatacatttctttattcggctccttccacttttcctcctggccgtagaaaggcgtgataacggcaacctttaattccggatactcttctctgagatcgtacgccgtttctgccgcccaaagctcagtccccagctgtccggatatgagaatccattccaagccttcgtcaataaagcttctgagtctggtttctatcgccttttttatataaacaagcgcccggtcatcccgtttaaaaatcccgagttcaaacggcttgtaccccgttacggctaatactttcaattgatcacctgcttaaaaaatggggctccccatcgggccccattttgatttgctgatatcctaaccgatcttgcttaagcattcaatactaatgatcgcagcaagggcttccgcactgaaaatgctggtgagttgtcgggtcaacatttgaaaaagtgtgcggatagtaatgaacgtgctcaaagttgtggtgatttacgttagttgtatgttgcggatgaatatgcggcacaaccgtgttagaaaagcaatggtgttcacagcaatgagtcggatggacaatcggcggcatcacgtttggtctgcaacaatgatgatgaaacatgctaaatcccctctccattaacttttattacactgttaggttatgaagaaaagagggtgcatgttctaattcaatcacccaatttaaaagtgcgtcagcaagctgtctttaaaattcgaaaatacaaacgcaatcaaaaaaaccacgacaaagaacaagtaaaaaacacctttatacataccaactctcccctataaataactaacgctattttacaagatgcggcaccattctacaacaaaatcgatgcggattcagaaaaaaatatttttggcgaaacagctcggcttttgcgctttcccgggcaatattttaagaggaatatttcctcttgagccgggcaattcttacatggagcttctcggcttctttttccgatatttccccgtcttctgctgcctgctgtgcggcctgcagagcttttttgtaatcttttgcatgatgctcaaaatagatcgccagctcaaccgctgattggtgtctgcatgtgtgaagatcagagcccgtcagtttctcccaaagggacacggcgtcttgcctgcggttttgttttttataaagcatcgctaagtcaaaaagggcccgatccgaatctttaaagtctttgccttgcagcgcttccagctgcgaaacggcgcgatcggtttctttatgagcgataaaccatttcgccatggcgtatgcttcctgacgttctgacgtctgatcagaagatgcaaaaatcttttttgacatatggatgtaaagagcgatgagggaaagcacatcttgttcattatgcgagagcactccctttaaaagagccgggtcctccgcctttaaaaattgaaaatacagcatcggcgccaaataaccaggggtgtcttcgtcccttttaaaagcaagctcttcattttcaaccgccgaaagcgatacacgctctaatttatgtttccaaagccgtctcgccccgtgcagaagatcaaagtgcccgaagtcaggaagtttcggaagcctgtcccgcagcaatgtatgcctggtttttacctgcggccagtcaaaggcttttccgttatacgtaacaagggacgtaatgtcaacctcacttaaaaagcttttgtaaagagctgtctcgtttcccggtttagggagcagatgctgtttaaccgcgacacggtcttcatacactcttgcatggccgagcaaaaagatcatattgccggccccgccgccgaggccggtcgtttcagtatcaaagaagaacagctggcttttttcgtatccttctgctgataaagtatgtgtcaaaccgcctttattccataatgccatgacgtcatcaagttcactgaagctgtaccgtccgtggcggtgcgaaagcggatagacggtttcgcggataagacagtattcatcctcaaaaaagaaaggcttcactccgaatgcctcccattcttctctaaacgggacttgaatatccgggaccgaaagttgtgaagctgccggctttttttcagcttccggcacattcaggtggtttttcatccgctttaatttatttttcaaggacatctttcgtcccccttttcttttacacgtaattcaagagcttgagtatcgctttctttgcatctattccttctatttcggagccgatgcaggaaggacatccgtcttgacatggacattgtctgatcaggcgctcagccccttcattgatttcatcaaatcgcttatatacttcatcggcaagtccgattccgcccggataatgatcatacagaaagattgtcggaagtcccgtatgtgcggctttgatttgcggcacgacatgcacgtcatttcggtcgcacatgacgtatacaggcacgatatgctgcaggacgtgggcaatgcctaaaagcagctgttcaagtgttttttcgccgatctccgaatccgtttcttttaattcaagccaggctgcactggtatgcagttcttcttcaggaagatgaatcggtcctgatcctatattttcaaatgtcgtcattttaatttttttaaatattgtcggaagtgcgttcacggtgacgtcgccgaaatgtaaggccgttttctttctgctgtccgttctgtcaatgtccagcactttcagctgcaccgctaaattggcatctgtataatattcgacatcgacctttcgcacgtacgcttttttatgatcccaatcaagcttttcaacctgatactgcaccccttcatgaagataaatcgcttcatcatgaagaagcgtcatcgcgctgaagcggtccatttctccgatgatttttacatcagccgtctctgagcggtcaacgatgaccacgttttcctgtgacgctgaacggagactgatgttggaggcgggaaaagattcgctcgcccagtgatagcgttcgcggttttcgtgaagcaccccttcttcctctaaatactcgagaatgtctctcgcatcattttctccgaatgtttcatcggctctgaaaggcagctcatacgcggcgcatttcaggtgatcgactaatataatgagattatcaggattaatccttgcagattcaggcgagcgtttaaagaaataatcaggatggcggacaatatattggtcaatcggatcagagttcgccaccatcacgataagcgcctcaccctgccgccgtccggcccggcccgcctgctgccatgcgctcgcgacactgcccgggtaccccgtcatcacgcagacctgaagctggccgatatcaacgccgagctccagcgcgtttgtgctgacaacgccgagaatgctgccgtctcttaacccccgctctatttctcttctttctttcggaagataaccgccgcgatagcctctgacagacttcgagccgatttctttttttacgatctcctgaatgtggcttaaaataatttcgacccggacacggcttctggcaaaaacaatcgtctggatcttattttttaaaaaagttttggcaagttcgttcacttccacggtggcgctttttcgaatatgcagcggtttatttacaatcggaggattgtaaaaagcaaagtgctttcttcctgccggggcaccgttgtcgtcaatcaggcgcacggatttccccgtcagctgctccgccaactccctcggattggcgattgtggcggatgtacagataaatgacggcgtgcttccgtaaaaagcgcagattctcattaaacggcggatgacgttcgccacatggctgccgaatacaccgcggtacgtatgtaattcatcaatgacgatatatttcaggttttcaaacagactcacccattttgtatggtggggaagaatggctgaatgaagcatatcgggatttgtgatcacaatatgcccggcctttctgactttctgcctgatagccggagacgtatctccgtcataggtgaagcttttaatatccatgcccgtctcgtctatgatttcattcagctcgcttttttgatcctgcgcgagcgcctttgtcggaaataaataaagtgcgcggcttgaggcatcttccgcgatagactgaagaaccggaagattatagcacagtgtttttccggaggccgtcggtgtgacggccacaatgctttctccgttttgaaccgtctgaaaagcggagtattgatgtgtaaaaagccgctcgatccccctcttttcgagagccgcccgaatgttcggatctacttgctccggcatcggcatggttttcgcctcccgcggttcctcttcatgccaatgcacaatattttcatgattttttaattcctgaatcagttcgctcagtgattttttcttcatcgttcacacctctttatgaggtacagtttaccgaatatttgtttgcctggctagatgaaaatcctgcacaagaaaaaaagcagggaatcagcccctgcctacttcatttttatcgtaaaaagctctgtttgtccttttttcgcttcatttgcgcctgcaaattgcaaaggttctgcggcatcgccattcataatcaccatagggatgacggtgctgcttgctttttcttttattaaatccagccggcacgttaaaagcagatcgcctgttttcactttgtctccttcttttacatgcgcttcaaagccttcgccgttcatattgacggtatccaaaccgacatgtatcaaaagttccgctccggaaagggtgcggatgccgacagcgtgttttgtatggaacagctgaatcacttctccctcaaccggtgaaacaatgtctccgtttgcaggctcgacggcgatcccgtcccccatcattttttgtgaaaatacaggatccggcactgaagccaaatccatcaccgctccgtcagccggagaaaaaatcacttcctcggccggctttttccggctgtctcccaatccgaataattttttcagcaatgtgttgtgctccccttcctaaatgtgaatccgttaccagtttattctccactatttaaccatactttcttttttccttcaattcttaaccatacggcatagcatcgcatagtctgtttgtaaaaaggcggtggtcatatggatcaatcacaaaacgataaacttgatccgcaaagtaatgaggacatcatcagccatgcgatggaccaattttttcactcaggtcccttcgcagaattgatgcagggttttcagcaccttgtcaattcggcttttactgaagcgcaagtgacgattgacgtcagagaagagccgacggggctcgcggttgatatcggcgttcccgagacgttccgtgacggggatatgctggtggaaacgaaagggtgctaccttcacgttacaatccgctacgatcataaacaggctcaatcatcccatgtgtcttcaagcatgacaagaaccgttgtcctcccgtataaggtaagtgaagaagatatggaaacatcctggaatgaacagacgcttaccctctttttccctaaaaaataagcatgaatgatgaatatcattcatgctttttatttgaagatactggtgaagcctttcaccagcgatccgacctgatttacggcgcttaccatctgccccgttgtatccatcattttattaaagtcaaactgtccgttcgtttttttaaactgggagagtatgcctgagaattgggaagactgctgctgattcggtctgggaacggggtaaggattcacaaactccggctggcccccgggcatgcctgcctgaggaggagcaggagcatacggcggctgcatatgaccgtattcctgattcggataaaattgctgcgggtactgcccttgctgatgatatggcggctgctgcaatggctgtatctgctgcgggtagaaatatcccgccggctgctggtacatattttgatatggctgcgctctccattgcatatgacattcccccttgtctcttactaagtttctactatatatgtatgaattccgccttggttatgtgctttcggtgattctgatctttgtcaaatgctgtcgaaagtcttaattttttaaaaacagaaaaaagtcgaatcgttatgttaacataatctcaacatacatgagaggggatgcaccattatgaacgtatcatacttaagaaagcgttttgctgaagtgaaaaaatatgaaacagattgtgcagataaactgatggactttgcaaaatttctctatattcaaggccatctcaccgcaaccgaatttcgaaacagtatgaaggttctcgaagcaagtggagcagaaaacccggcgtatgaataacatacccgacccctttatataaaagaaggcagccgttttcagctgccttctttttcaatttcatcccttaatatacgaagcgtatataaaacagattcagttaaatccctgtatctttttttatgaatatgatgaacatatgattggagcatcagctccccgaaattttctgtaacggccagaatttgtgcatgatgaacgtatttcggacggttttcctgaataaacgcaagcgctgcttctgtccaaagcgcgcaaagccggtctcttttttcaacatcgggtttaatcgtctcaaaaaaatcatatgaacggcctgactcttttccatcctgataccttttttcggcttccagaaccgcctctatcatttgttctgtcagctccaataacgactgtgtctgcaaacggactcacctcagtacatatggtaccaaagtttttgcacaaaatcagcttatccggcaggctctcggcaaatcctttttacgccggtcagtcaaaaacaggtcatcaatacaaacatgaagctcccgcgcctcttcctcaagacgggaaagtttctcctgtctgatttcttcagcttccgcctgacaggatctgactgcttgggtaagcgttttttcagcagcagaaatccggatttcaatatcagaaagcagacggagaatatcagccttgctcgtgtaaacagacattcatgttcctcccttttatcacttgcgtctctttcaaatataattctcgttttcataccgctctcctctgcacatgacaaaactagaagcagttcggcaaacaaacagagattatcctaaaaggcgtgcctttcgacaaaaaagtgccgcaaactttgtatgaaccggcacgttaatgcaaacgatacagttgaggaggtgccgtatgaaaacgagaccgaaaaatgcaggtaaacagcaaaaaaccgaagcaaaaacaactgatacgcttgataaaaaattaggcggcccaaaccgcccttccacgtaacacaccagcagcccgaaaccccagcgaacggtttcgggctttttcatttcttcagccactctttaaccgcgaagagcgcatggagctcccgtcttttctggaagtaccagtccgtcagttcaagctgtttcggcattttctcctgtaagaaagccccttttcttaaccttttttgaaaccaatccgccctttcgccgtctaatgggtgggcaacaatgggataggttgtcctcagcatgggtgatgttctttttttgattccgatcattttctccatatcaaagcgtgaaccggtatgaggaacggtatcaagaaaacggtaaaaagaagcgtgaagatcagggctgaacagaaggcgggccagctgttttccgagcgtaattctctcttcggtttttgaaaaccgtttgacggaaattccgtataaatgtccgtcgtcaaatgaagggaatatcaccgtattaaagtgaaaccaatcacttaaataaaaaggaatcgtgccaaaaacattctttttaaacgaaggattttgtataataggtgcttggatagtgttttgttcatttataataagagcatacatgagccgttccgtatctccgtcacgccaaaagcggaaccattcttcctgcataaaagccgagacgcggaaatgaggaagatgacggaaaagaggttcgccgatttgttttgaccactggtagaccagaagctgaggataggcatcagaaaaaatcagccaattcgccctttcatacgaaaggaaaaaccagtttttctgactgctgtcaaggccctcctgataaaggacgcctcttaaatcagtcatcgaccagcccgcattgcgggacacaaaggatgccaaaagcggccacttgatctcaggatggcggtcataatatgctttataggcattcgtccgggaaatattatcggcattttttattttcgtctctttttcgatcaggcgaagaatggcggttacggtctgtcgtttatgcacgttcattcacttccgtcactattagtttgataaggaggatggaaaaagtgattcggtacccgaatggaaaaacttttcagccgaacaaaacggtttcatcccaaaacagccagaaacggtctcattcatacagtaatcgcggcatgaccctcgaagacgacctgaatgaaacgaataagtattatctggctaaccaaattgctgtcattcacaaaaagccgacacccgtccagattgtaaacgtccactatccgaaaagaagcgccgcagtcattaaggaagcttattttaaacagtcttcaacaactgactacaacggcatttataaaggacgctacattgatttcgaggcaaaagaaacaaaaaacaaaacggcatttcccctgcagaattttcatgatcatcagattgagcatatgaagcaggtggtcaggcaagacggcatttgttttgttattatatccgctttcggaaaggtttatttcctcgaagccgacaagctgtttgtcttttgggagagaaaggagaagaacggcagaaaatcaattcgcaaagacgaattagaagatgcttcctttccgatttcccttggatactcaccgagaattgattatattagtattattgaacagctttatttttcgcaggaacagtagactgagcgaaaggttgataaacgaaaggttgagatgttatgtcagatcaatttacgagccgtgaagaacgccgtaaggcaaggcagacgaaaagcactaagccctcttcaccgaaaaaaggcaagaaacagcgtaaaggcggtttattcaaaaagattgtgctgtccttggttattctgtttgtccttggcatagtcggcggagccgcggcatttgccgttttggtttccggcgcgccgtctttggatgaagccaagctgaaaacgccttactcttcaacgatttacgacaaaaacggaaaagaaatcgcggaagtgggcggtgaaaaacgaacctacgtcccgattaaggatatacccgatgttgtgaaagaagcatttatcgcaactgaagacgcccgtttttataagcaccacggtatagacccgattcggatcggaggcgccttggtcgccaactttacggatgggttcggttcagagggaggaagcacaatcacccagcaggttgtgaaaaactcgcttttaacccatcagaaaacgattaaacggaaagcacaggaagtgtggctttcactgcagctggagcgccattattctaaagatgaaatcttagaaatgtatttaaacagaatttatttctcaccgcgcgcctacggcgtcggtaaagcggctgaagaattcttcggcgtaaaagacttgagcaagcttacggttgaacaggcggcgacgcttgccggaatgccgcaaagcccgaccggatataacccggttaaaaacccgaaggcttccgaaaaacgccgaaacatcgttctcagcttaatggaaaaacaaggattcatttcaaatgctgaataccaaaaagcgaagaaagtgtccatgaaagatgaaggcgtcgtcagccaaaaggaatacgataaaaaggacacaaataaatacagcgcttttgtcgaagaagttatgaaagaaattgagacaaaagaaaagaaagacgtcgatatttcaactgacggactgaaaatttatacgactcttgatacgaaagcacaagattatcttgatcaattgatgaacggcgacacagccggctttaccgaaggcatgcagggcggcgtcacgctccttgatacgacaaacggagaaatccgcgccatcggagcaggacggaacagaactaccgggggattcaattatgcaacacaaggtaaaacccagcccggttcaacgataaaaccgattcttgattacggcccggtcattgaaaataaaaaatggtcgacgtatgagcagattgacgattctgcatatacgtactctgacggcacaccgatccatgattatgacaatagatacagaggccagatatcaatgcgagaggccctcgcagactcacgtaatatccctgctttaaaagcattccaagcagttggaaaggataatgccgtggactttgcaaacgacctgggattaggtttaaacaaagatcaagtatatgagccctactctatcgggggatttggtgagggtaaccgcggtgtatctactatgaccatggcaggcgcctacagcgctttcggaaataacggaacgtacaatgaaccgcatgcggtcacatcgattgaatttaatgacggcactaagcttgatttaacaccgaaaccgaaaagtgctatgagcgattacacggcattcatgattaccgatatgctcaaaacagtcgtgcagtcaggaacaggcagactggctcaagtaccgaacgtggaagtcgccggtaaaacgggtacgaccaactttactaaagaggacattcaaaaatataacattgctccaggcggagttccggactcctggtttgtcggatacacccctcaatatactgcggcggtttggactggtgtagaatctggcaacaaagcaggcaagaaatcactgtcttctgcagaccagcaagtcgcaaaacggattttccaaaagctgatctcatacgttgatgacggtaaaggaagcttcaagcagcctgacagcgtcgtaaaagaaacagttgagaaaggctcgaatcctgccgctttagccggaccgaatacgccggatgacaaaaaagtgacggagtacttcgtgaaaggaacgcagccaactgccgtttctaaaacgtacacgaaagaaaaagccgataaaccgacaggattgcaagtgaaatacgacaaagataaaaaatcattaaccttaagctggaattatgacggtgatgcaacattcaatgtcaaacaatccgttgacggcggaagctacagtgacattcaaaacagttcggcaaaagaagccgtcgtctcagatgtcacgccaggctccacatacagcttccaggtgacagcggaaaacgatgacggaaaaagcgatacggcatcagcatctttcaaagtcccgaaagatgaagaagacgatgcggataaagataaagcgactgacgatgaacagaagactgatgaagataaagataaggacaagacgcaaaccgatgattcaaacaaagatgacgatcagacagatacgtctgacggatcagatcaaacaccaactgatgacccggataaaaatcaggatcaatccgataaggatcaaacagataacaacaatcagaatcagcccggcaacgggaccgataacaacggacagcaagataacggctctgataatgattccgattccggttcagacggctcaaataaacctgacagcggtcaaacggataaaaaccaagactcatcttcaaatatcaacgggcagtccaattcgtcaaccatccagtcaaatcccgctcattagcggacgaaatccttcaccccaaacaggtgaaggatttttttcatacaaaaaaaacctccttataagaaaaggaggtttttaacatttgttcatggcttcatatttatgatattgcttcttcatctccgtcatcaattcatccagctgaataaacgagtgaaattgagtcggttttgttaaaataaacgccattcgctccgcccaattgatcggttccgcgggaaaatgctttgtttcaagcacagtccagtcgagtgatgtgacccgctcccctgccgtccaatgaaaagcggcaatcagacaggctattcccttcagcatgtcattttgatcacatctcgattttcttgtttgaaaaacggggagcagcgtttctttcgtttcattccaaatctgaaacagaaacgggacatattcgcccctttccctccatggctgcactgttggctgaccgctgaaatccatatacagcggatggcggcgcagcgccgctttgatctcgaagctttccaagtccgtaaggctgcgcaggtatgtttcatagcctgccagaatgtcaatcgccgtcaccgtttcaccagcccttttttgtcacgcttctgcccttctctgcatagcggaagcaaaggacattccgcacagcggggagattgcgctttacagtgataccggccgaaaaatattaatctgtgatgcgtaacagaccaatcctctttcggcacttttttcattaatgttttctctacttccaaaacagagtccttccagcggcagatgccgagccgtttagagacccgctccacatgagtgtctactgcgatcgcaggtacgccgaaagcaacagacacgaccacatttgccgttttccgtccgacacccggcagcttcacaagctcatcccggtctttcggcacttctccgccgtactcttcgatgatcattttgctcagcttttgaatatttttggctttattacggtacagaccgattgatttaatatcctgctggagttcttccagcgatacggcaagataatcttcgggccgtttatatttttgaaatagcgtttttgtcactctgttgacgagagcgtccgtacattgcgcggataatgcgactgccacaaccaattcgaaaggatttgaatggacaagttcacattctgcgtgcggaaacatatcgccgattttttcaagacaatattcaatctgctttaaatttaacacgtttctccccttctcatgttattgttccagccaattgtaaaaaggcacctgcctcgtatactctttttgcggatcattctgtttcgtttgaacacgccggaatttttggctgtgcgccttcgcctgctcaaccgttttgaagccgttctttttccattcaaataaaatccggtcaatatagcgaaaactgagtttccccgataaaacggcttcttttaaggcgtgtttaatcagaatcgcatcatgctgatcctgatcctgccatatggccagcgtctcgcattcaagcggcgacagcggtcttccgaactcttcttcaaagatggtatacaggcttttttgttctctttctgacgttctttcctgcgtttcattttgagaatgctgcatgtaatcatacagcttcgcccataacggctgcagagaatatttttcaaactttatgccgttatggtcttcacattcttcaataaacagaaaacctttttgaataaacattctcaggcagcttgtacattcttcagcagagatggacatgcctgattgaagttcaaacggcgtcggaaaataagagcccttttccaaatgcattttaatcttcaaaagcaggatcaattcggtttcattcagcccgagctgccggtaatgtgtcagcagcaggttgggaatgcttgaaatgccgagttcctgcatatctataaattgctgttttttcatccttacacctcttactgtaaaaggttatctccgggagctttcccctttacttagaaaaagtctcccttgcaggagacttcgtttttcataactattacggatacagacggttcagaagtctcgggaacggaatcgtttcacgcacgtgaggcgctccgctgatccaagccactgtccgctcaagtccgaggccgaagccggagtgcggaacagaaccgtattgtctgagttcagcataccatttgtaagcatctgaatccagaccgtgttcttttaatctttcttccaataaatccatatcatgaacgcgttctgaaccgccgatgatttccccgtagccttccggagcgattaagtcggcacataacacgacatcgtcacgatctttggcaggctgcatatagaacggttttaatgacgtcgggtaatgagtgataaacaccggtttgtcatagctttctgcgatcgctgtttcatgcggcgcgccgaagtcatctccccactcaatatcgtcaaagcctttttctttcaagaattcgatcgctttatcgtacgtaatgcgcgggaatggcgctttgatttgttcaagcttcgatgtgtctcttcctaatgtgttcagctcgatcttacaatgttccagcacactttgtacgatgtatgcaacataattctcctgaacttcaaggttttcttcaaattcaacaaatgccatttcaggctcaatcatccagaattcgatgagatggcgtttcgttttcgatttttccgctctgaacgtcggtccgaaagagaatacttttccgagcgccattgcagctgcttccatatacagctggccgctttgagacaagaaggcgtcttcatcaaaatatttcgtcgcgaacagctcagtcgtgccttcgggagcgcttcccgtcaaaatcggcggatcaactttcacgaagccttctttgttgaaaaattcataagtcgcacggatgatttcgttgcggattttcataattgcatgctggcgtttcgaacggagccataaatgtctgtgatccattaagaattccgtaccgtgctctttaggcgtaatcggataatcagtcgcttcgtgaatgacttcaatggatgtaacagcaagctcatagccaagcggtgaacgctcgtcctctttcacaattccttttacataaagtgacgtttcctgcgtcactgacttcgcaatttggaagatgtcttcttctacttcagctttgacgacaactccctgaatgaagccggtaccgtctctcagctgtaaaaatgcgattttaccgcttgagcgtttattagcgacccaagctccaatcgttacttcctcgcctgtgtgtttatacacttggttgattgttgttttcaaactctttccctccagaacaagaaagacattcaggaatctgcctgaatctcttttttcatcactttattatacccgttctactctaacggggtcaatgcaagtgaaaagcggctttaaaagccgctttttcagaatcagctgtgtttttccgtaaagcggcggattctcttgaccgcttcttctaaaagatcgagtgacgttgcgtaagataagcggacgttgtccggtgaaccgaaacccgagcccggcacgatggcgactttttcttcttccagaagcgccttgacgtattcatcgacatctttgaatccgcagttttctgcggccgctttggcgttagggaacaagtaaaacgctccttcaggtttgacacaggtgaatccgggaatctcactaagctgagcgtaaatggtattcagtctgtgctcaaatgcctgtctcatctcttccagcggctcagccggcccgttataggccgcaatggcgccgtattgagcgatggacgtcggatttgaggtgctgtggctcgcaaggctcgtcatcgctttaataatcgtctccgaacccgctgcatagccgatcctccagcccgtcatgctgtgagatttcgaaacaccgttaatgatgatcgtctgctctttcaattcacttgaaagctgtgcgattgagacgtgtttttttcctccgtatgtaagcttctcataaatctcgtcagaaacgatcagaatgccatgctccagacacacttttccgagttccgcaagctcttctttcgtatacataacacctgtcgggttgcttggtgaattgataatgagcgcttttgttttctcggtgatagcctgcttcagctgctccggtgaaattttaaactgattggattccagcccttctgcatagacgggacgccccctgccagtttcacctgctcaggatagctgacccagtaaggagtcggtataatcacttcatccccttcatcgagaatgacctgaaataatgtatacagagcgtgtttcgctccggtgcagacaatgatttctgacggcttatattcaatcccctgatcgtttttgaatttttttgcgatactgtctttcaaggccggcagaccgcctgaaggcgtatattttgtgtggccttcattcatggaacgcaccgcggcatctataatgtgctgaggcgtattaaaatccggttctcctgctccgaggccgatgacatcatggccttctgctttcagctctttcgcttttgcagtaattgcaagtgttgcagacggtgttaatgcggatactctttttgccaatttcaacttgaactccccctaatacgtctcacggtgtgatgtttttgagaatcttgccgcttgtaaagtccacatagctaaagctatactgcccgcttttgttgatataggtcacttcccataacggaacattgttttctctcgccgggtgaacaccattcagcttggaaacaagcccttcgtcccgaacgatcttggcagccttgccgcttgaaatgccgtcactggctttttttgagagaatttttgcttttttgtcggccggaacccatacatacatatcttttccatgtttatccgttccggtaacaacataatatttctgtttgccgacaaaggtctccactttctcagcatctgtcagattcgttttttctttagcggctgcggcagctgtttcgtggccttcttctttttgagccattgcagatttaaaaatgctggccgaaaataaaagaactgctaaaaaaataataccaaatacggctgtaaatattaatgctttttttctcatctttttcacctatgtgcgataaatggtgaagaccgcttcattttgattttcttcgtcgagcgcaaggccgaacatcaggttgtcccgtttcaaagtccggtttaatgtatcgacgattttatataaatcatctgaatgctccacattaatcgttgacagaatttcaattttgctttccatttttataccctccatcggtcgaacaaattttgttagtcataacgggatgcgcccgcggcataataaaatcacaaggcggcatgaacccgcttttactataaaaacaattcctcatcccacaccacgaaagccgcgtttatgcggcttttattccgtttggctgacataagcccccagctcggcatccgtcagctccaaaagggatgaagtcgggagcgcttcaagaaacagccgtccgtatcccgccgtctttacacgctgatctaaaagaacgatcgttcccttgtctcccgccgtacggagcaggcgcccgatcccctgtctgaacgttaacacggcctcaggcagggaaatcgtctgaaacggatttttcccctgcttcttggcaaattcgcattttgcggcgtgaagcggattatcaggtgccctgaaaggaagtcttgcgatcatgacggttgacaattcatcccccggaaaatcaacgccttcccagaaatgattcgtcccgagcaaaatcgcccggcttgccgttttaaaggttttcattaatttaccgggactcccgcctgaaataccttgggcgagaagctgaatgcctgagatctccatactgagtttcagttcctgatacacttttttcagcatatcatgagacgtaaacaggacaaggatcttcggctgttttccctttgacatgatttctgcatacttggcaatatgctcaatgacttcccgctccccgtcatatttaacggatttcatctctttcggaatgatgacgttcatctgatcatcgtaagaaaaaggagacgggatgcttttggtgcgcggataaaaatccgaaagtccgagcctttcaatcataaattgaaaagactgctccaccattaaggtcgctgatgtgagcacaacgctttttttgcgggcgaaaaactggtctgccagcatttcaccgggctccaaaggctgcgcatagatgctgacggcattttttgcgcccttcgcatcaatttcaacccaaacggcttctttctcatcattttcaaacagcagcctgctgaacgtatcgcgatattctttcagccccctgatacactttacatattcgcccgctaaaaaagccgctccgcttttcatctgatcaagcttttgatgtaacagtttctcctgtacggaaaacatgtcaagcagctgatccagcatcgcacaaagccgctccgctccgtccgttatcatgtgaaaccccttatcctggcttttatgattgagactatagacgagacggttcagatcgtctttaggttttcttcgtttgacaaaagaatgcactgaactgaaaaatgcgtcgctttccgattgaatatgcttcatccactcatcggcgtcaaaaaaactttccgccggcagttcatacgtataaaacagttttctcatccgctttaacagtccgtgttcctttaaggttccgattcggctgagctttgtgtgcagtccgatgtatgaagctctcttccccaggtgctcgctggcagcgcgttcgaaatgatgcgcttcatcaatgatgaccgttccgcttgcaggcagttttttcgtttcactgctttgatctgaaaacagcaaagcatggtttgtgataatcagatctgcggcctgcgctttttctttagcccgttcataaaaccccgcagccgagtccttcccttttttcataaaagaattctcatcgtaagccatgcgctcccacagcaatctgccgcctgatggaagattcagctcagcggcgtcgcccgtttcagtctccgtcagccagacgagaagctgcgctttcgtcaaaaccgcatcatagttgtcatcttcctcatgcagaatatgttcaaacttcggcaggcacagataatgtgatttcccttttaaaatagcggctttgaccggccaaggaaacatacgctccaaaagcggaagatctttagacatgatctgctgctgcaaaagagtagagtacgtgctgataatgacgggagtttgttccgctttggcaaataaaacagccggaacgagataaccgatcgtttttccgatgccgggcgccgcttcaatcagcgcatgctcccgattgcggaaggcgccaagcacttcatccatcatcgtaagctgtcctttccgcttttcatagcgggggatgatgccggacaagatctgttctttttcttcgttccacttttcaaggtcaatggccgcattcaccggacgggaaaccggaatttgatcgggctctttaattgaaaaagaggcgtatggaatgcagctcttttcttccgccggcctgctttcatgtataaaggaatccaaaagcagcgtcaaatcgctgataaaatgctgtgaaagccttctaagctgctttaacgtcggtaaaggcagatgtttcagtttatgtaaaatgtctaaaaagaccagtcccgtaacctccgcatcgctgtctgcgcggtgagggcggtcatgaacaatattcagctctgcgcacaactcaccgagcttatatccttcaaaccccgggaaaacaatacgcgaaagctcaaccgtatcaagcacttcacaatccggcagctcatagcccgcttcgctcagttcatgccggacaaatccgaggtcgaaatgaatattgtgggcaacaaaatacgcgccgtcaagcagatgaaaaatctcctctgcgaccgcttcaaacggcagttcattttcaaccattccggacgaaattccggtcagctgttcaataaacggcgggatggcctgattcggattgatatattttgaaaaccgctcagttatttgtccattttcaatgacaaccgctgcgatttgaatgattttatcgccctttttcggcgaatttcctgttgtttcgacatctatgacaacgaaccgttgtttgttcattaaaatggacacctcaattcttgcttacgagaaaagtgtaacacgttttgttgagaaatggagcggaaaaacagcttttgcccctaaatcttaaaagaaaacccccatgaagggggctcttttacaaaatcgtgtgtgccggttcctggcccagcatctgctcgattttattctgatcatccagaacggccaccttcggctgatggctttttgcttcctgatcagacatcatttgataagaaataataatgactttatctccttcttggacgagacgggcggcagctccgtttaaacagatgacgccgctcccccgcttaccgggaataatatacgtttcaagtctcgctccgttgttattattcacaatctgaactttttcattagcgagcattccgacggcatctaaaagatcttcatcaatcgttatgctgccgacatagtttaaattggcttccgtcacggtagcgcggtgcagttttccggccatcatagtgcggtacatattatgatctctcccattcatcaatatcaataatgatattatcaatcagtctggctttagaaaattggacggcgcaggccagaatgaccttgccgtttaatgttttaagcggagtcagctccggataagcgtacagttcggcataatcaatgacgccgcttgtgttttcgatgataccggtgacggtttttataacggtttccggatttctttcaccgtctctgatcagttcggcaccttgctgcaatgctttatagatcatcggcgcttctttgcgttcctgctcagtcagatagacgttgcgagagcttttggcaagtccgtcttcttctctgaccgtgtccactgcaaccaattcgatatccataaagaaatcctcaatcaatccgtccacaaccgctgcctgctgggcatctttcaggccgaagtaggcgcgggtcggtttaacgagattgaaaaacttcgtcagcacagtggccactccgtcaaaatggccgacgcgggaggcgccgcacaacacgtcagttctccttttcacttgcacggcaacattttgctcgcctttatacatgtcacttggagacggcgtaaacaaaacatctgctcccgcctgttctgcaagccgggcatcgcgctttaaatctcgcggatatgcttcgtaatcctcgcccggtccgaattgagtcggattgacaaagatgctcatcacgacaatatcgttttctttgtttgctttttcaaccagcgtcaggtgtccttcatgaagaaaacccattgtcgggacgaatccgatcgtccggccttctgagcggtattgtgcaattaattctttcagctgttgagtttctgtcagttgtttcatcgcttactttcctccgtataagccttgcagcacagtttggtttatctgaaaggaatgcttttcttccgggaaaacccgttctttcacatcacggacataatcactgagggccgactcaatcgtgccgtcgattttggcgtattgcttcacgaacttcggtgttctgtccacgccgtggccgacgacgtcatgatagacaaggacttggccgtccgcttttgaaccggctccgataccgatgacgggaatggatacttcttctattattttagcagtcagttcagcaggcacacattcaagcacgagcatcatcgctcccgcctgctcgcatttgatgctgtcttcaatgagctttttcgcgctttgctcatcttttccctgcactttatatccgcctaatacgccgacagactgcggtgtgaggcctaaatggctgacgacgggaattccgccgagagtcagcgcgcggatggattcgaaaacgccgtctccgccttccagctttaacgcgtccgcgccgctgtcctgaataatggccgcggcgtttttcaatgtatcctcttttgaaaggtggtaagacataaacggcatgtcagttacgataaacgtatttttcgcaccgcgttttaccgcttttgtatggtgaatcatgtccctgaccgttacgccgacggttgaatcgagtccgagcacgaccattccgagcgaatccccgactaaaatcatgtcgactcccgcctgttccgcaagctttgcctgcggataatcgtaagcggtcagcatcacgatcggctctccgttttccttcattttcatgaaatccagttttgttttcattctgtttctcctcctctaaacggtgaggagatgagccgccaattcttcgcaagcaaaaaagccttctgtaaaataagaaggattcccacttgtttaacgttcggcgaatgtcatccctctgtcccagtccttttttggatcaaggcagacttttcgtaatctctgttctgctgatcaggtgcagttcattatgatactgcccataggaagtataccaaattcacgaggcttgtaccaactaagattaattgagctcaatatcggcagaatagatcttctttataccgtctctcgtttccaaaagaagaactccctcatcatcaatgccgagcgatttcccgtaaaacgttccttgcagcgttctcgctctgagctcgttccccagtccgaccgcatagctttcccatagcagcttgatcggtgtaaagccgtggttcaagtaatcctgatagcgtttttcaaaagtcagcagaatctcttgtatcagacccgctctgtcaattttttcgccggcttccatgctcaggctcgtcgcaatgtcctgaagctcgccgggaaaatcggtttcctgctggttcacgttgatgccgatcccgagaataaccgaacggacacggtcctcttccgcctgcagctcagttaaaatcccgacggcttttttgccgtgaatcattaaatcattcggccatttaatggcggcctgtacgcctgtaaaagcctcgatggcctgtacgaccgcaacggcggataacagggtgagctgcggcgttttttgcaaaggaacgtcgggtctcagaatgaggctcatccaaatcccgtttccctcctgtgaatgccatactctggccattcttcctctgcctgccgtttgtttatcggcgactacgagggtcccttccggcgcgccgtcattggcaagttcatgagcggttttttgggtggacggcaggacgtcccggtaatgaagctgtttgcccaaaacttctgttttcagtccgaaacggatttcggattcactgagtttccccggttttttaatgagcctgtacccttttcgtctgaccgcctcaacctcatacccctctttgcggagctcctctatatgtttccaaacggcggttctcgagcagccgagcgcgtcacttattttctgcccggagataaagccgtcacccgcctcagaaaataaatcaattaatcgggttcttaatgttgatcccatgatgcgagccactcctttatgtcatgttttcggttagggagcttccctgccaataccgcttcttcaatccggcgaagttcttcggccacccatttacccgcgcggcggtttctgagctccatcagatcagcgcctgaaatgtcgaggtctcgaaggcttttgatcggcagctgctcatacaggctctgaacttctttcagcttttgttcatcaatcgtcctatgctgtttcagcatctcgattttaacggctgaaaacagcgcctctcccgcccggtacatcgcttctgcttccagctgcgccggataaacgcttatgatctgcaccgctttttttatgacttttcccggcagtttccattgttttaaaaacgcctcggcgcttttcggacaaagaccaagaaacaataacagcgctgcccagcgttcttcgcgtgcatctaaagaagaaaacggaaagccgcttgcttcaagcatttgctgctcataaccggaaaggacgggcagctcttgtatcagacctgtctgcaccatcgtttgaatcgcttcttgtgagaaagcgccctgcatcagcttttcaaactcgacggtctttcgttctactgatacatgtgccataagctccctgtcttttatgacggcctctcttgtatctttttctaacagaaagccgagctgactcataaagcggacggctctcatcatccgcagagcgtcttcccgaaaacggtcttcagggttacccaccgtacggatcagcttttgtccgatatcatgtgcgcctccgaaataatcaagcagctctccttcggcagacatcgccatcgcattaatcgttaagtctctccgctttaagtcttctgataaagaagtaatgaaccgcacagcttcagggcgccggtagtccttatattctgattcggcacgaaaagtggtgacttcataggtttcatcttcccacaggacgatgacggtgccgtgctcttttcctacatcgacagtccgcttaaagagacgctccacctcattcggcaaagcgctggttgcgatgtccacatcacctatttttcgtttcatatagctgtctctgacggctcccccgacaaagtacgcctgatggcccgccttcatcagatgatgaaggatggggagggctttgacaaattcctgttccataagatcactccggtcctgccaattcgtcataaatccgttcatactgactgacgattctttgcgaagaaaaggcggtctccaccattttgagcgcatgatcagtcaatcgtttgctgagctgtttatcttctaaaacagcaagcgctttttcagatgctccctgaatatcgccgacttccaccagaaaaccgcttacttgatctttaatcacttcggggatgccgccgatatttgttccgatacacggcacgccgcaggccatcgcctcaaggaggacgagtccgaaactttctttttcagacagaagaagcttaagatcgctgatggaatacagctcttccaccctgtcctgatttccgaggagcagcacttgatcctgcagtccgtatttttcgacaagctgccaagcgacgcacttttccggcccgtcaccgacaagcaggagcttcgcctttgtgttggctgcgatattacggaaaacgcggatgacatctttaacacgttttacttttctgaagttcgaaacatggatgacgaccttttcatccggcaaaataccatgtttctcttttatactctctgtatttttcttaagataaacacgttcatcaataaagttgtagatggtctcaatttttttatccggcttgattaagtcatacgtttctccggcaagcgcggttgataccgccgtcactctgtcggacgcttcgatggcaaaacggattaaatcttttaatgacggatcatatcctaaaacggtgatgtccgtaccgtgaagcgtcgtcacgatgccgatgtcacgcttgagcatctgcttggcgagataagcgcataccgcatgcggcagcgcataatgcgcgtgaatgatatcaagattttccctcgcggccacctcggcgattttgctcgccagcgtaaggtcataaggcggatatttaaataccgcgtattggttgacttccacctcatgaaaatgaatattcggatgatatgtatttaatctgaacgggatgcttgatgtgatgaaatgaacctggtgccctttttccgcaagcagcttgccgagttccgtcgcaataatacccgagcctccgacactcgggtagcatgtaatccctatttttaatggtctcattgtccgcccccaaaaacatcatcattcaaaacgggaagctgttttgaaaagaagccttcagcataccccgtcccggcttctttgccatacagtctttcccgcgcttccaccatttcgatataaccgttggtcagcggtgtgttcactgactgcgccgtaggaataaactggctttgataggcgtgcaggctttcttttttcagatcgatggtttccgttatgtcgattacaaagtccggacggtgaaacccgttgatcatataatagtatacgcgctgagccttatgagccggcagttcctgatgatctctgtatttatgaattcccgccgagaacaccgcctcttcgaccaaagccgccgcattgccgtggtcaggatggcggtctttcggataaggcatgaaaacggttttcggccggcaggctctgatgacactgacaatccggcggatgccgtcctcacttttcaaaagcccgcggtcgggaagcgtaagctggattctctcttttacgccgagaattcgtgccgcctctgccgcttcttcttttcttatccctaccgttccgttagatgatagttcggcctcggtcaaatcgcatatcaccgcggtttttccttgagccgtaaattttgcgatcgtgccgcccataccgatctcgacatcatcactatgagcgccgaacgccagaatatcaacgtgttcagacattcggctctcctccgcgcacaagattgcggaaatcaaatgccccgccgtccagcgtccggacgaggatttccgctgttcccatatttgtggcgagcgggatcgcgtatacgtcacacagccggatcagcgccgagacatccggttcgtgaggctgcgcagttaacggatcgcgcagaaaaatgacgagatccagggcgtttgccgcaatcaatgcgccgatttgctgatctccgccgagcgggccggattgaaaacgttcaacggacaatccggtcgcttcctggatttttaagcctgtcgtacccgtcgcgtataactcatgatggctcaatatatctttatatgcggtcgtaaactgaaccatatcctgcttttttttatcgtgagcaatcaaagcaattttcattgatgttctcccccttgccgattcagtcgataatattttcgagtccgtatacaagctggtcgattttcatcacttgctccactgacagcttcactcctgacataaaggaagcccggttataggagtcatggcgcagtttcagcgtttggccgtccatgccgaacatgacttcctggtgggcgataaggcccggcagacgcacgctgtgaaggcggatgccgtttaattcagcaccgcgggcgcccggcagaatttctttttcatcaggatggccctgctgcttttctgtacggacgcttgaaatcatttccgctgttttcagcgccgttccgctcggggcatccagcttttgatcatgatgaagctcaatgatttctacatcttcaaaatagttggcggccatttgtgagaacttcatcatcagcaccgcgcccaatgcaaaattcggagcgatgatggcgccgattcctttttcttcagtcaaagcttgaagctcctctaaatccgcttcagaaaatccggtcgttcccacaacggggcggacgccgtgttcaagagcggctttcgtatgttttttgccgatttcaggcgttgtcaaatcgatcagcacatccggttttgtttcttggaaacatgcgcggatatccgtataaataagagcgtctgaatcagctgacatcacttcccgcaatgtttgctgatcgtatgtatggtcaatagcgccgacaagctcaaaatgaggcgtgcggacggcaagttttacggcctcctggcccattctgcctctcggtccggcaatgacgactttaatggtttcatttgacatggtttctcctactttccttcttcttttctagtccagcggtctttatcacgtgtattaaatttatgcatgacgcggttatgagcttcctccaatgaaatatcaagggagttggcgaggcagatcaggacgaacagcacatcgcccatttcctcttccatgcttttctcattttccgtcgttttcttcggcttttccccataataatggttgacttctcttgcaagttcgcccagttcttccgtgagacgggccatcatggcaagcgggctgaaatagccttctttgaattggccgatatattcatcgacctcagcttgtaagtctttcatcgttttgtcactcactgtgcgaatacctcctgtcatctcttccatgttagctaattcaagtacatttgacaaatgttaaaaacggcagtttgctgttttcttttgtatccactataatatttacgcaatcttatggaaggaaaaggggtttgatgcaatgcttggagaaatcagaatcaaaaacatttgctttattttaatcggcgccgctgttttttcattcggactggttcactttaatatgcagaacaatttggcggaaggcggatttaccggcattacgctgcttttatatgcgttattccacatcagcccttctatttccaacctggtattaaacattcctatctttttcatcggctggcgtatgctcggccggacgatgtttgtctataccctgatcggcaccgtctctctttccgtttttctgagtgtttttcagcgctacgaaattcatatgccgctgtcgcatgatttagcgctggccgccttgttcgccggtgtttttatcggcgcgggtctcggcattatttttaaatacggcggcacgacgggcggggtcgatatcatcgccaggctgatcaacaaatttttcggaatcccgatgggccggacgatgtttgcctttgacgcctgtgtcattctgctttctttgtttacgtatctttcttacaaggaagcgatgtacacgcttgtagccgtttttgtcgctgcgagattgattgattttatacaggaaggcggctatgccgcaaaaggggcaacgattatttcttcgaaaaacgatttgatccagcaaaaaatcattgaagagatggagcgcggcgtcaccgttttaaaaggacagggatcatatacaaaagaagacagggacgttctttactgcgtcgttccgaaaaacgaaattgtgcttttgaaaagcgtcatcacttccgttgacccgcacgcctttgttgcagtaagcgacgtccatgatgtgctcggcgaaggatttacgcttgatgaaaataaaaatccgatcagacgataataaaaaggcggcttttgccgcctttactgttcgtgtttccatttgacaaccggtgattttttctttttcaatcggcgggcgaatgccggactgacattgagcgtctgctcgacaaagcgctgcggcgtcagtgccagccattggtttaaggagacatcttcgaaacggtcgcttttgaagatttccagaaagcgaagcacggtgtcaccggtattctgaacataatgtcccattgcaaaaggaacatatcctacgtcacccgcttgatagttaaatgtccgcgctcttccctccgccgcaaacaccgtcattttcgcttctcctgaaagataatactgccactcgtccgtattgggatgccaatgcaattctctcatgcctccgggttcgacctccacaagagctgcggcaatcgtttttgacaccttaaacgtttttgaatcgacaatctttactcttcccccgccggtaacaagaggctcctgccgggaaagcttgtagctgaatggctccaaaacggggccttccggggaagaaactgctgcccgctcaatagggggaggcggttccagctggaacatgtaacgctctttcttgtgaatgtaagccagctcataacccggaacaccgaagttcgcctccagcacgctgcgcggggtatgggcaaaccagtccgttactgaaaaggtgctgttttctgaaaaagagccgtcatcaaagacgagcaaaaactcacttccctgctctaatccttgaatggaatgaggaatgccggaaggaaaataccacaggttcccttcacttacgttatcaataaaattccgcccattttgatcgaccgcagttaaacgtactcctccgttaatcacatatccccattcggcttctttatgccaatgaagctcccgcacagctcccggtttcagtctcatgttcaccgccgcgatgtttttggataccggcagttccctgaccgtcacctctctggaccatccgccgtcttcaagcctcatatgcgtatcagaaaatgagaatttcaagttttgaaccgttcctgcatccgttgaaggcggaacgagcatgtcaggattctggaagtcacgcgcgaggtttcgcggtccttcgtcagtcgccccttttctgcctctgatcggctgcgggaggtgttttgaagccaattgctggatgagttttttcactggcttagctcctttacagcaatttgtgtttatttagacttaggatactcacgctttttctctttctttttttccgctctgtattttcggtagccgacatatgtcagcgcagtaataatgataccgcctgttgtcagaatgacccagagcagcgaagggtcagcgtcatcccgctccaccttgtcaaaaacccgctttaaatcctgctgcaggagcgtcagacgctcaagctttgttccttttgtcatctgctgaaacccttcctgctcaatcacctcgatatgtttcgccaccgtatcaagctggccggccgacacatccattgtcaggctgggataaattaaatcatataatgatataaattcattccacttttcattgaaattttcacttccgtttccgctgacatcttcttttaaggcgctgaatgtcgccataatcggtctttcaagcgaaccccacagcggatcggagtggtcttccatcgcatccattaccaacctgaactgggcggctgcccggattttttcggtatctgaggcgtctgcctgtttcaggacgcgcactaaatcattaaagcccagagtcacctgcctgacttcggcgccgctcagtgagtttacgtgtgtcatttttttcttaaagtagccaagcacttgcagagcctcatcatactgcgaatgccgcgtcatttggaaaacggtatccgaaaggtcgttcagttccttgagaccgccctcatcttcagctttggcagttgtgatgaaacacataagagcaagtaaaagacagatcgtcagctttcgtttcatagaggtccctcccactccttctctttacagaatatgaggagcgggacaaggttagaccaagattctatcagtgtaagtcaagctttatccgtcttttggaaatcaccaaatagtatgcaaggccgagtgaaaatatgctcagccagaatgtagcatagccgatctcttgcatatagtcattgagcattgagtagcggggcatcatgccgaaaagataatcaatgacatcattatgaagcgtccaaacagcggcaacggcaagatgccataaccggaaccgaaaatacgggctgtataaaacgccttgaacggccatggcaaaatgtgaagcaatcagcatgtacccttcccaaggcatctgccccattttgaccagcacaaagacattcattccgaccgcccacagcccgtattttacaagggttacaagagccagcgcttcaaacagcggcgcgtttcttcccatgagaaatgccagaagcacaaacaggaagaaaaacgtcgccgtcgggctgtcaggcacaaatatcagaaatcggaacggcgtgtccaaaagctgcggcacataccaataatagccgtacaccgtaccgataaaattaacggcaagaacaagcagaagcatgccgcgcaaccctaaaagataagaaatccacctcataccatcaactctcagtccgtaaaaagtatgtatcatgcaaaaaaagctgacatccggtcagctcttttcataaaagtatatcctgctgttgtcttcttcacaatacgttatttcgctgtcgtttcagaaatgaacttcgccagctgatcaagctgtttgtcattccctttaaaaataccggctggcatctgccctttccctttgacggcgatttttttaatttcttccgggctcagcccgttatcgaccagggacggaccggcgcctcccccttgaagattatccccgtgacaggaaatacagccttgttctttaaataccttataaccgtctgattcagtatcaatggcggcttcttttttaattttcccttgctcctccgccttcgcccagtcatgtgtcgcgactgactgccacgttaaaaagaccgtagcgcaaagcgccaaaagcatcatcccgacggcaaccggacgcttccacggccttctttcagaccccctgtcgagaaacggagccaaaagcagcgacccgaaggcaagccccggtataatcatcgctccgataacggtgtagctccctgcggcatattcatattttaaaagctggtataaaaatagaaaataccaatccggcagcggaatataccctgtatccgtcgggtccgccacccgttctaaaggcggctcgtgcacaatcgttaaaacgagaaatccgacgaggaaaacggctccgaccatccattctttcagcaggaagttcggccaaaacgcctctgtctttccaggatactctgaatagtctttcggtatattcggttttttttcagccggtatccttgaatctcctacaaacttcattcctttcccccggtgcatgtcatcccctcccttttatatcagatttgtattaaagcggtcctgaaattccctgcttgcggatcatgacaaagtgggcgcccatgagcgcaaacaaagcggcagggagaaaaaatacgtgaatcgcaaaaaatctcgtcagcgtttgagcgccgacaatatcgtggtggccggcaagaagagttttcacctgcgctccgatcaagggcgtcgcctccgcaatctgaagacctacctttgtcgcaaacagcgccttcatatcccacggaagcagataccctgtaaaaccgagaccgagcatcacaaaaaagatcagaacaccgacgatccagttcaattcccgaggctttttataagctccctgaaagaaaacccgcagcgtatgtaaaaacatcatcacgatgactaaacttgcgccccaatggtgcataccccttacaatctgcccgaaagcgacttcattctgcaaataatacacagattcccacgcgtttttaatatccggcacataatacatcgttaaaaacatcccggacagcacttggataacggttacaaaaaacgtcaaaccgccgaaacaatagacaaaagccgagaaatggtgagcgggatttacatgttccggcacttcatggtcggcgatatcccgccacatcggcgtaatatcgagacgttcatccacccagtcataaattttattcagcatgtcacccttcccccctaggctttgcttttccaagatacaaaaagccgtcctttactttttgctcataacggtcaagaggcgcgagcggcggcgtgcccggaacgttcgtgccgtctttttcatacagaccgtaatggcagggacaaaagaatttgttcggatttttaggatcattgttccagtttacggtgcagcctaaatgcttgcagatcggagaaagcgctataatttcatccccatgcttgtaaacccaggctgatctggattcttccgattcgtaccaggcgtcgacttgatgaattttaaagtcaaaccgcttcggctccttcgtcagctcatccacactgacaacctgcaccattttttgatctcccgtcggttttaataccggatccagcgcaaaacggaccataggcataagcgcactggcggccataaatcccccacgccggtgagcgcatagtttaaaaattgtcttcttgatatatcttgttttccgcccatctcttccccccctaaagattgaccaaaaattaactaaaatagaaaataattctgagatttgacaccctcataatatatgaatctttcagcaaggtcaacagaggcaaaacgggtgttttgcaggatgcctggagtttttaagaattgttccacttctgtaacaaaacgttcaaaatttctccgcacttgtcatccgcaatttttctctttaaagagtctttcatatgttcaaacgggacggcaggtatgtatatgacatcagaccctatttcagaatccttccatttttcgtctgccgtcaggaacaaggcgtgccggaagttggtcatcacctcttctttgagtttttgaagcagggcgatttgtgattggtctatatcaacatatgtataagaggggaataaatatacccgtcccttcaattggcgctcaagctcttcagaaagcaattgggtgctttccccctgttcaacggcctcttttaagcctcctgaagacgttatggaaattaacggaatgacagcggtatcaatgtaatccgcagattgtaaataggcatcggcatcagcggctctccatctcatgtctcgttcctcctctttacgcaacaagccttgcatattctgcaaggctgtcatttatgtgagctgattcaattggcgggaaagcttttcaaatgtttctttgtcgtggcggtccagcgcctcgtcgatatctttaagcagcttttcccgctggaaagtggaaatggcatgttctaatattttttcagccatcccctgatcctgtttattttcaaacaggtctttcggcagatgcggatttgattcaagaacagcggcatattccggtgagctgtaggccgaacggaaattcagctggataaataaatcctgctgtttatttaaccggatgtcgtgaaaagatttttccgcgtccgtagtcatgacattttctttgtaaaacctaaacggcacctcatcaacgcaatgagtagacatgataatgcctctcgggcaaaattcggcttgttctacaaaatggactttttccattaatgaatcatgactcattaaataatttaaaatccagacgcactcccggcgtttaagctgataatgatttaaaaaccaacggataaaatcctttttttcattgacagaaacaggggtctgcatgtaattccctcctctatcgatcgtataatctgacatcacttatacattcagcaagcatggtccaaaatcctgcttatcttaaaaattcatcctctatccgtaagattgtttcttcaagctcttcgtttattccatccattgaaagcacttgttttaaaagcggcagcgcttctttctggagaccctcttccaataagaagtgagcgtattcatataagaaatcccgatcatcctgataatggagatacgcagcttcgaagctttttttcgcttcagcgtattgctcaaggcctgtataggcccccgccaaataccaattgtatttcggatcttcttccccgtagccgcggacttcctgaatcagatcaataatctcttcaaagctttcttctttatgatagacggctaaaagcgtatggagcgcttccacgtaacccggatcgagcgccagcgcttcctgaagaagctttttgccttcctcttcgctgccgagctttaacgccattttcgccgcatagagaaaaagctctttattgtattcatcgtaagtaataccttctttagcggtttttaatgcatcttcatacatgccttctgcctcgtagctttttgcaagcggcatataaagcgatgaataggaaggatcaagcccttttaaatcagacagctgcttgatggctgttttgaccattcccgcctgataggctgtgaacccgtacccgaaaatcgtattcggttctgtatgttctgccgccgctttttcataccatgaaatcgcttcctcaaattcacccgccgcgctcaatgactcagccagcctctgatgaacatttacgccgccgatttcgtgccgttcttttgccgtctcttcatagtaaggaacggcttttgcgtatgatccctgagtgaagtataattcccccagagcgaaatcaataactggttcatcttgtaacattgctttcgcctgtaacagcttttgctcacttacttcaaataagccctgcatctgatacagatcagccattaaaagaaggctttccgcgtaagacggatcttccggagaaatcgtctccagcacctcaagagctttttcttcttcatcaatatctattaacaattcggcgtaaaaattcgtcagctcagactcatccggataaaggtcatgcagatcactgatcagcgctaacgctttttcggcgtttccccattcatagtagagctgggctgcaatggctttgtcttcgtcatgaagctctgtttcagcttttgaaagcgctttgagtcccttttcggtttcacctgcttcaactaattttatggcttcttgaatcaatgtattcaaatcagaccggtcctttcttttcctatacctcatcaaccaaatgaaaagggtttttattcgggttattcttatcataattcagacagggcctgcccgcaaataagatgcttcacccggcattatagtttatcagaaaatggttaagaggaaaacggcaaaaaagggggcggcatctttatacgcaaacagcgcaatttgttccggctgtttctgtaacgaaaacgcattccccctttctgttatttttctgtttaagacaagctatgtcaaagcccaagattttatgacacatgaagaaaaaagcccgaagaacagtcttcaggcttttttggctaattgatctaaatgctcaaaaaatgtcggatatgagacatggatcgcctctgtatcacggatgtcaatcggctcttctgtcaggcatgaagcgataccgagcatcatgccgatgcggtggtcgccgtggcttgacacttcggctccgcccgcaagcgtttttttgccgtgtattttcatgccgtcttcagtcggttcaatgtctgcgccgattttccggagctctgatacgacggtgtcgatccggttcgtttccttcaccttcagctccgcagcgtctttaatgacagttgtgccttcagcctgcgttgccaaaagggcgataatcgggatctcgtcaattaaacggggaatgatttctccgccgatttctgccgctttcagagctgaggtttcaataaccaggtctccgtaaggctctgcgctgtccgcttctgaaggaatcacttcaagtgaagcccccatttgctttaagacatcaatcatccccgtgcgtgtcgggttcaggccgacgtttttcagcacaatccggcttccgggaacgacagcgcctgccgcgaggaaaaaggccgctgaagaaatatcgccgggcacgaaaatatcggctccccgaagcttctgaccgcccgttacggaagcgctcgtctccgtttccgcaagctcgacgccaaaagcgttcagcatccgttccgtatggtctcttgatttatggggctcagtgacggtcgtcttcccttcagcctgcaatccggcaagcagcacggcagatttgatctgcgcgcttgcaacaggggagacgtaatcaatgcctttcaattgtccgcctcttacggataaaggtgtaaaccctccgtccgctcttccgtcaatcgcggctcccatctgttttaaaggctccgtcaccctcttcatcgggcgctttgcaatactttcgtcgcccgctaccgtactgtgaaatgggcgtccggctaaaatgccgagcatcaggcggatggtcgtgccggaattcccgacatcaagaaggctgtcaggctcacaaagtgcgtcaatgccctttccgtatatcgttacatcacttccgttttgttcaatggagacacccatttttctgaagcaggcaatggtgctcagacaatcggctccgggcaaaaagttttttaccgttgtcgttccttccgcaagcgctccgaacataacagaacggtgggagatggatttatcccccggaatatgaatttcaccgtttaaagacgtcactttttctcttttcaatgttttccacctcagtcagcgtaaaatgtgtcatatttggcgcgggattgaatgcaggtttccgcgcgcttccggtcatcatcagtctggaaactgattctgagaattccgttaatatcttctcttgtttcgataatgcggatgttggtgatactgattttttcttctgccagtatcgccgtaatttccgaaatgacccccggatgatcaggaacatcgacataaaggtcataaaaggacgggatcgctcctttttgacggagcggcagaccgtcgcgataatctttcgcttttttaaaatatccgaacaggctgtccgcatcttcattttctacataagattcgatcgtgtcaatctcccgtttccattctttgaagcggtcaagcagtttatctttgttatgaagaagtatgtctctccacatcgccggactgcttgaggcgattctggtgatgtcccgaaaaccgccggctgcgaaacgcttcaaaaacggataatcttcttcagaatgatgagcctgatggacgaggcttgcagcaacgatatgagggaaatggctgataacgctcgttacgccgtcatgctcctcgggagtcatctccacaaagtgggcgtttgccgctttcaagagttccttcagatgcgttactgactctttagaagttgattttccgggtgttaaaatgtaaaacgcattttcgaataaaaattctttcgccgcagcggccccggatttatgagatcccgccatcggatggccgccgacaaattgatagtgagccggaagcactttgtcggcgtagctgacgactttctgtttcgtgctgcccacatccgtaatcaggagttcatgggtgatgtctgatgcggccagcatatcgagcattttcagcgtttgggcgacaggcgtggcgataatgacaacagacgcttgctgcgccccttccgtcaatgagccggcccgctcgtcaataattccgagcttcagcgcggcagtgagctgttcttccgaaatatccacaccgataatccgtttatgcggatgctcctttttgatggccagtgcgatcgatccgccgatcagtccgatccccgcaagcaatatggtatccttcatttcactcatttcctttttcatctattttaatagagcaaagaggtgatgcttgatcacctcttataatatttcagctaaaattgtgagaatttcctcattctgctctttcgtaccgaccgtaatccttaacgctgtcggaaatccgagcgcctgtcctgagcggacgatatatcctttttccaacagggcttggaacagttcatccgccggacggttaaaatcaatgagcacaaagttggtttgtgaaggataacaagttaatccgtgagtttccgcaaaatcataatactgcttaaggccggctttatttttctcgacgcattcctggataaatgtctggtcgtcaagcgctgccagtgccgaagcctgaccgattctgctcgtattgaacggctctctcgccggttcaatctggcggatcagcgcttcgtccgcaatgccgtatccgacgcgcagcgcggcaagtccgtacgctttagagaaggtgcggaggatcatgacattcggatattgctttaaaagcggaatgctttctgggtaatcttccgccgtaacatactcgtagtacgcttcatcaaggacaacgagtatatgctcgggaactctgtttaaaaaggcaattagctcttgctcagaagtatatgtccccgtcggattattggggctgcatacccatatgactttcgtctcgccgtcaattgcttccagcatccggtccaaatcatgagcgccgtcactgcggagcggcacctcgcgcacctcagcgccttcaatcaccgcattgtgtctgtattgcgggaaagtcggggcggcggtaatcgtgtttgcctgatcatttaataaagaacggcagataatctgcactagctcatcagagccgttgccgaaaatgatcgaagattcactgacctgcagatgctcactgagccgcgttctcaaagcggcactgtaaccgtcgggatacagcgcaagctgctcaatctcccgatgcagcgcatcttttgcggcctgtgaacagccgaacggattttcgttagaagcgagttttactactttttcaagcccgtattccattttcacttcttctattggtttgcccggctgatacggtttcagctgccgcagctgttctttaatctgcaaatccagtcacctcattttacactgtacagtcgtccgaacgtctttgcgtattcttcaaattcaagaagcgcatcagctcttgtgccgggattcacaagctttgttttaagctcttcaacttttttgacaagcgcgctgccgacaacgacaccgtcagatatttcattcatcccgtcaacctgtttgcggtttgaaatgccaaaaccgaccgccaccggaacagagctgaattctttcaccttacggatgaaagagtatacagaaggatcgaattcgctgcgtacgcccgtcactcctaaagaggatacacaatacacaaagccgcaggcctgttcagtaattattttcaaacggtcttcacttgtcggcgcaaccagtgagatataagcgatgttctcctttttgcatgtcatttgcaaaagggcgctttcctctaacggaagatccggaacaagcagaccgtctatgtcgttttcccgcagtaaagcgaaaaagtattctttttctaattgtaacacaggattataatacgtaaagaggataattggaatatgaacgccgttttttttcattttgccgccaagttcaatggcttttacgatattcattccgttttccagagcccgttttgaagcccgttgtatgacgggtccgtccgcaagcggatctgtgtaaggaacgccgatttcaagggcagaagcgcctgcattctgcaatgaaattgccagttcaacagaaatgtcaggaagcggatcgcccgctgtgataaaagggataaacaatttttcagaacctcgcagattaaacatgtgtctccaccccgttttccaaaacattcatcagcgtatgaacgtctttatctcctcttcccgacaaactgacgagaatgattttgtctttatccatgtcctttgccatttcaaacgcttttgccagggcgtgggcagattcaatagccggaagaataccttctgtttcagaaagcaggcgtaacgcggcaatcgcttcatcgtctgtcacgctttcgtacgttacacggccacttttgtgcagataggcgtgctcagggccgatccccgggtaatcaaggccggctgaaatggaatacggttcgataatctgcccgtatttatcttgtattaaataggtcattgatccgtgaatcaccccgagcgtcccttttgcgatcgttgccgcatgcagcggcgtatcaatcccttttccggccgcctcggcgccgatcagctcaatatcttcgtctaaaaaggcctgaaatatgcccatcgcattgcttccgccgccgacacatgcaacaaccttatccgggagcgttccttcaacccggcggagctgttctttcgcttcctcgccgatgattttctgaaattcgcgaacgatatacggatacgggtgcggacccactacagaaccgataagatagaaatgatcttcacaatgctggacccaatacctgattgcctcattcgtcgcatctttcagcgtgccgttgccgcttgtgaccggcaccacttccgcgccgagcagtttcatccggaatacgttcagcgactggcgcgcaacgtcttcttcacccataaaaaccgtacatttaaaaccgaattttgcggcggctgtcgccgcagccacaccgtgctgtcccgcgccggtttcggcgatgattttcgttttgcccatctttttagcaagcagaatctggcctaacgcgttgttaattttatgagagccggtatggtttaaatcttctcttttcagatagattttcgcccctcccaaatactctgacaccctgtctgcgaacgttaatgcagtcggtcttccggagtaatcaaacaatagtttttgatattcggcatgaaaaacgggatcattctttaattctgtgaaagccgtttcgatttcctcaaggggccgcatcaatgtttcagggacaaatttgccgccgaattcgccgtatcttccgatttcatttggatatggatacatagtggttcatcctttcttctaaaagccggatcagtgtttgatccttgtgtccgtttttttcaattccgctggcaagatctataccgcacggacgcgatctcagtaagccggtaatcgtctcaggattaacaccgcccgcaataaaacagcgcttgcttgcattttgagcctgctttcggtacaaggggacacgggcccatgaaaacgcgattcccgtcccgcctctcattcctgtcactgaagaatcaatgacatagccgtcgacagcaggtgcaaattgagccatctgacggagcgtcccttccccgtgatggagcgctttccatatttccgagctcacaagcggacggagacggagggcatcctcaggcgattcatcaccgtgaagctggatgacgtcaagtgccagatcagaggcaatttgcccgatgttttctatcgtttcatttacaaatactccgacatgtttcttttctgtccagacctgctctttccatttccggacctcatccggcgttactctccgtttgcttggggcaaaaataaatcccagataatccgcttctgaagctgccgcaagttcataatcacgcttcgatcgtattccgcagtactttaactcaggctttttcatatcgtcactccccgaacagtccgcggatcgccttttgctgtgaatcctctctcattaaggattctccgaccaatacagcctgcgccccgtgcttgttgacgaattgcaggtcagccaaagaaccgatgccgctttcactgaccagcaggcagccgtccggtacaagctgcgctattttttccgtttgcgtaacagaagtacggaacgtttttaagtcccggttgtttatgccgagaatgtccggctgaaacacttgtaaaatccgttcaagcacagtttcaccatggacttcaacgagaacgtccatgcccttctcgcgggcttccagataaagctcataaagctctgaaggttccagcgcttccccgatcagcaaaatggcatcggcgccgatcctgaacgattcctccacctgaagggaatcaataataaaatcttttctcagcacgggaagagacacggtttgtttcacatctgtcagaaattgatttctcccctgaaaaaaacgggtatccgtgagaaccgaaagggcgtcggctttagccgcttcataatctgccgcaatcgtttccggaacaaaatgctctttaatcaatcctttagacggcgaagcttttttcacttcggcaatcagcccgataaaacggttcgggttcaggagtgcttctttaaaggatctccgtttaatttgacaggtttccggcagcacgatggatttgatttcttcttttttctgctgaatgatttgatcaagcatacatttcttcctctttctgtttcagacgttcgagctgctttttggcatctccgttttgaatcgcttctaaggctgttttcgttccttctttcagatcgtttgcaagacctgccgtataaatggccgcgcccgcatttaaggcggtaatatgcagagcggatgacggagctttatttgcaaaaatattctgaatgagaagcgcgctttcttccgatgaactcacttgaatatccttcaatgaaccttctgcaaaaccgaattgttcaggtgaaacggaatattccagacgttcaccgtttttcagttcaatgatatcggtcggtgctgtgatggacagttcatctaatccgtcacgcgccgacacaagcatgacgtgtctgacatcaaattgttccaaagcgcttgccatcaggcgcgctttatcaaatgaatagacgccgatcacctgccgcttcacctgcagcgggttgctgagcgggcccagcagattaaatacggttcggaagccaagctcttttcttgcggcggcgacgtgcttcattgacgaatgaaacagcggcgcaaacaaaaaacccatttgtttcatttcaatgctgcgtttgacgctttctggagtggcttgaatggaaacccccagcttttccagcacatccgcgctgccgcttttagacgaaacggagcgatttccgtgcttggcaactttagctccggcggcagaagctgtaatcgccgctgccgtggatatgttaaacgtagaaatcccgtctccgcctgttccgcacgtatcaacgacatccgccaagccacccgccgtctgtgcccgcgcccgcatcacttttacaaatccggcaagctcctccgccgtttcaccccggtgggctaataccgataaaatcccgccgatctcagactgcgacatgtccccgttcatcatcatctccatcagcttttcggcttctccggttttcagtgtgcggccattaacgcacgattgcagaaatttgttcatccatcttctcctccccgccagaaaagatgtcttctgcgatttgaatcgtttttaaaagcgcccccgctttgttacagctctcttcatattcggcttccgggaccgaatcagcgactattcccgcgcccgcctgcaccgacgccgtaccgtttttgatactcatggtgcggatggtgatacacgaatcaattgacccgtcaaatccgatatacgcaatacatccgccgtaggtttctctggaagtcggttctaattcatttaaaagctgcatcgcgcggattttcggagcgcccgagagtgttcctgccgggaacgccgacatcagcgcatcaaccggatggacgccctgttttaaacggccggttacaacagagatgatgtgcatcacatgtgaaaaagaaacgacctttgtgaattccggaacggctacggaaccgtactccgcaactctgccgatgtcattgcgcgcaagatcgacgagcatgtaatgttcagctttttctttttcgtcattcatcagctcttttttcaggcgatcgtcctcttcttttccggcgccccttcttctcgttccggcaatcggatgaatttccaagtgcctgtcatgcacgcggatcagacgttctggcgaactcccgacaatgtctctgtcaggcagtttgatatagtacatataaggtgaaggattgacgatgcggagcaccctgtacagctcaaatgaatgtctggatatcggaatgtcaaacttttgcgaaagcaccccttgaaaaatgtctccggcttttatatattctttcagtttatcgacgccggccataaactcttctttcgtataattggatgtcacatcggcaaaacttggcgtgtcaaatgtttctttagaaaaaaacggctctttcatatctttcggttctgtcaaaataccgataagcttacgaagctccgcgcaattttctttaaaaacggcccgctttttttcctccgtctcccggccgttaagcgccgcatattgaataaaatgcacttgtttcgtttcgtgatcgtacgcgatgattttccggcagacaaacagcatgcatttttcgaaatctgtttctttcgcgtggctcggcacggaaggctcaatcaaaggaatcatgtcatagctcagataaccgacggcccctcccgaaaacgggatatcaagctcgggtgttttaatgcggaagctttcattcatccaatcaagcacggcttttaattctccggcttcaaacagcgtatgcccgtttggatcagcggcagtgaatgtgtgatgactctccttaatcgtgataaaaggatcaaggccgataaaagagtatctcgaccagcttgacgactcatccttgctttctaaaagatacgtaatgtttctgtccagtttttcaaccatctgaatgggtgtgatcgtgtcgaccgtaaaagtctctgcgattggaatggtgcggtgtgtcagactgtcctttaaaaataaagaaacatccgattgtaaattcatgattctcctccttacggtaaggagaatgagatgaagagtgagaggagtcttgcgtataagaaataaacccaaaagaaaggcttcttttgggcagaataaaaacgtgtttatctcagctcagctaaactcattctctgctaccctattctaaactcaactgttcaatatcttacttaccagctctatacacactcttgtgtatttctaagctttgtttatcgtattacatgtcagtattttttgtcaatgataaatccggccttaacacaacggctttttctaaatagacatgcttgatttcatcctgaggcatatccgtctgaaccgtcatcaggacacggatacacttttgcagagcgccggtgacatccatttcctgcatgcacgtcaccgggacgtactgccacccggaaaggcggcggaccgcttttgccggaaatacggaatggatatcaggcgtggcggataacaggatctgcacaacgtcttccggcttgcatccattttgttcaatgattttttcaagcagctgctgtgttttttctaaaatttcttgttcggtgtcttgttccaccgttgttgctccgcgaatgccgcgtatcatcatgctgtttcctccattcgccatttgttcagcaaattttcgagctcatcttttgaaagcatgcagtcccgcgcttcgcctaattcttttaacacgatgaactgtgtcatgcctccgcgcgtttttttatcattcatcatccgggcggaaagaaccggcgtttcaatatcttgtctgatgcttcccgggtagccgagcccaatcagccattgtgtgagttctttcctgttcatcttgcaacccgcaacctgttcactcacgtaaagggcaaactgcatgccgagggcgaccgcatctccatgagtaatccggccgtagccgtattccgcctcaattgcatggccgagcgtatggccgaaattcagaaaagctcttatcccctcttccttttcgtcctcacgcacgacggccgatttgattgaaattcctttataaatcatttcattcagctcagcgcttgtcagtccttgcaacgtgtcaaacgtgagaagcttttctaaaaaagcatgatcggcgataaacgcgtgtttgatcacttcagccatgcccgatctcagctcttgttctggcagggttttcagaagctccgtatcgtaaatcaccgctttcggctgataaaacgcgccgattaagttctttccgagtttatggttgacggccaccttgccgccgaccgcactgtcatgggcaagcagtgtcgtcggcatttgaatgaaatcaattccgcgcataaatgttgctgcgcaaaagccggtcaaatcacccgtcacgccgcctccgaaggcgatcatacatgaggagcggtccatatggaaagcgatcgcttccgtttgaatccgttcatactcttttagagacttcgcttcttctccgcttggaacgattacttttttcacgggccatgtttcgcttaaaagccggaacatctcatcgccgtaaagccggtcaacttcagcatcgatgacgagaaggatctttgtcagcggcctgttcagtgaagacaaaagagcagcggcctgtttccttatgccttcaccgatatacacgggatatgcggaggaagctgtccgaacctcaagctctttcatcagaattccctcgatagttttttcatgttttcaacattttctttaatgcggtcgatctggtcaagcccgaattgttctacgacggcatttgcgatttcccaggccactgctgcttcagccactacgcttgctgccggaaccgcgcagctgtctgaacgttcaatgctcgctgtaaacggttctttcgtttcaatgtcgacgcttttcagcggcttatacaaagtagggatcggtttcataacgccgcggacgacaatcggcattcccgtcgtcataccgccttctaatcctccgagcctgtttgtggcgcgtgtatagcctttctcttcatcccatacgatttcatcatgaacttcactgccgtttttgccggccgcttcaaaaccgatgccgaactctacgcctttaaacgcgttaatcgacagaacggcagcagcgagcttgctgtccagcttacggtcatagtggacatagcttccgacaccgaccggcataccttcgacgatcacttcaacgattccgccgatcgagtcaccgtttgccttcgcttcatcaatggctgccatcatttgacggcctgcttcttcatcgtagcatctgaccggtgattcttccgttacccgtttgagatcctcaatggatgtgtaatcggttttctctgcttttacgctgccgatttgcaggacatgtccggcgactttaatgccaagctccactaaaatctttttagcgacggctccggcagccacgcgaaccgttgtctcacgcgcggaagatcgttctaacacatttctcatatcgcggtgattatacttaatagccccgttcaaatctgcgtgtcccggtctcggtcttgaaatctggcgtttcatttcactttcttcttcttctgtaatcggtgcggcgcccatgatttttgtccagtgagtccaatctttattttctacaacgagcgcgatgggtgaaccgagtgtccgggcatgccgcacgccgcttgtgatcttcgctctgtccgtttcaatctgcatacggcgtccgcggccgtgccctttttgacgtctggcaagctcaaaattaatatcttcttcagttatataaagccccgcaggcacaccttctataattgtcgtcagctgcggaccgtgtgattctccggctgttaagtatctcatttctttcttctcccttcatcgcattaacgcttttaagtaaaactataccacaagttttcattaaatgtcttctatcttttttgataaaaaaatgtatcagtgctctcaaggccgaatttttccgggctgaaaatctgctctgtgcttccgacaaacagaattccgttctttttcagactgcccgccattttcacatacagttcttcttttgctttttcagtaaaataaataaagacgttgcggcagacgatcagatcaaaatcctgttcatagctgtcggcgagcaggttgtgccgcttaaaccggatgtttttttgaatctcttgttttacttgataactgttgtcagcctgcttagtgaaataacggcttttcacggaagccggcacctcttgcagcgagcgttcctgatagatgccccgcttggctttgccaagcgccttttcatcaatatctgtcgccaatatatcaaatccggccaaacccgcctgctgactgagaatcatggccaaggtatagggttcctcccccgttgaacaggccgcactccatatttttaacggtttgttatgctttattaacggaagaattgaggtttcaagaacttcccaccgtttataatttcggtaaaattcagaaacattgatcgtcattctgtccaatgtttcatttaataaaagcttgtctttctccaaagcggcggcaaattcctgaaaatctttgaatccctttttttcataaagggacgtcagccgccttttcatttgtgcttctttgtataaagataaatcaacaccggttatttgtttccacttggtgataaaaatgtcgtaaggctccattgcttctctcccaatctcgctgtcttttgtcctagtatagcctgttttctttctaatttgtacgatttcaataaaaaaatcagcccgcaggctgatttgtgagaaatgaaaagacagggcagcgcagcctctgtctttcttaaaatatgtaaaccttttcataacaagagaaaaagaaaggctgacggcttagtacacccagtcggccattaatttttgatacggtacaagctcttcctgtttgaagaaaatgtcaatttcccgctcagcgctttctaaggagtctgaaccgtgaatgatatttttgccgacaaacatgccgtagtcaccgcggatcgtgcccggcagtgcatctttcgggttcgtttttccgatcagctgtcttgtgatctctactacattttccccttcccataccattgcaaatacgggtcctgatgtaatgaattccacaagctcgccgaaaaacggcttccctttatgttcagcataatggttttcagccatctgttctgaaacttgcattagcttggctcctgccaattgtaagcccttacgctcaaatctggataaaatctctccgatcagctggcgctgtacgccgtccggttttaccatgataaaagttttttccataagattctccaccccatcattatgtataggctttcaagttgcacaccgaaatcgtaacatctttctgacaattaatcaatccagggcggagaatgttcacatcttgttcgtaaaaggaatttaaaatttccgtttgccgatatatttggcgatggcggccaatgatgagcgcgcccgtcctctcggcagtgtattcagtttctcaaacgctttttttaagtacctgtcactgacagccattgatttttcaatcgcgtctgtgcgtttaatattttcaataatgggggcgagctgctcctgtgttgtttcactgttaattaatttcagctgatttttcaattcaggctgacggagcgcgtacaaaacgggcagagtgacatttccttgcagcagatcccctccgaccggttttcccagttcctcttccgttgaagtgaaatcaagaatgtcgtcaataatctgataggacatgcccacgtaatagccgaaccaatataatgctttgtgaatcttctcatcagctcccgaagcgatggcgccgagctgacagctgacggcaatgagaagagccgttttccgtttgatgcggcgcaaataggttctgaggttttgttccatattgtatttatctctgatctgttcaatttctccgaggcatacttctacgatggttttggacaggatccggtgggctttcggctcatccaatctcgtcatcatctcaagtgagcccgcaagcatataatcaccggtatacatggcgatacggttgtcccacttggctttgatggtcggctttcccctccgcagctcggcgtcatcaatgacgtcgtcatgcacgagggacgccatatgaatcatttccagcgtcaccgcaacatattttattttattaatgtcatagtcgccgaacatgccggaaagcaatacgaaaacagggcggatccgcttgcctcccgcctggagcagatggagcccggcttcactcagcaagggatagtctgaccgcaccgtttgctcaagctccctttcgatcacatcaatatcgtcatttaaaaaagaataggccattttaaatttcatatcattcacccaaacatctgtatattcatcatttccaaccgatatgcgtagcggccactccgccggtaaacgaatggtatttgacattcgtcaggcccgcttcttcaaacagacgcgcaagttctttcataccgggaaattctcttgccgattcttgaagccaagaatattctttatagctcttcgcaaacatttttccgaagaaaggcatgatgtatttaaaataaagaaaatatgcctgtctgaatccgaacatttccggctgggatgtttccagacatacgacctgcccgcccggtttgacgacccgccgcatttctttcagcacggtcagatagtcgggaacgttccgcagcccgaagccgatggtgacaaaatcaaaagaatcatcagcgaaaggaagctccatcgcatttccgtgcaaaagttcaatttggctgtaaccgccctctttcacttttttctcgccgatgctcagcatatttttgctgaaatccagtcctttgatttcaccgctttttccggctgcttctgcgagggcaatcgtccagtcagccgttccgcagcagacatcaagcgcttttgcgccttcttttacattcatgatctgcatcgttttatcgcgccattttttatgctgctgaaaactgataacagagttcatttggtcataatttttatagattttttcaaacacgccgtgtacgcgctgttcttttgactcctgcatgttgattacccttcttccactttctgatgatatgttttgtcctggctgatcgccttaagccggttcagcattaggttttggattggtgaattgagcggcagcagcgtttcaatgctttgctttgcctttcggaagctatcttccattatgtcagcctttgatttccctgactttacaatattgccgatgacatcgagaaatatagcattgccgttcatcagccgcttatatacaaaaaaatcactcgccagctctttccagcgcggaagattaaagtggtctgacactctgtgaaacagggccgcttccacaatcgccatgctttcgatcaattgattcaagtcattgacagaccgatcgtacagacggattttatgctcattgatttctttaattgccgtagcgagcgtccgaatcatatagatatccttcatttcagataaaagcgaataatacagtccgctgaaatagtcgccggcaagcacggtgagctgccggtttttattttcgtctcgctttaacgctctggctgttgtcacttcatcgtgggtatcaagggcgctttggacaagcatcgcagttactatgtaattttctctgtcgttgttcttaatgtccgcctcttcaaacaaagcgtgaaaaagaagaagcttatcctcatcgattttaggcgcggaaatatgtttcgctaaataaggatgagacagcttttgttttaatttcgtatttagattcgctaaagttccgtagatgtcttgcaaaaatatcacccttgtccccaaattcacatttattctaatatgtatgagatttactcgtcattattatacgcaggtatcattatagcataaaaaaaagaaattggctgtattctcccgccgtttgcgggcatttggcaaaagcgggaaacagccggcttattttttttcgctgttcatttctccgtaagcggtctggatgagggcgttgcctctcactttgatggcagaggtatgctcagtaaactgagcgataatcacttcgcctttgtccagtttttcggaatggtgaaatttcgtatccgttcctctcgttaaaccgatgacgttcacgccgtcctcgaccgctttaatgacgacaaaatcacttgaatgctttgaattcatatctgcaccctctatcattattaatccgcacgtttaatatgttctaacacttcggaacgcgccgctgcgtcatctttaaaaatacctcttacagcggaagtcactgtttttgcgcccggctttcttacgcccctcatcgtcatgcacatatgctcagcttcgacgacaaccatgacgccgtggggatctaaggtctctacgatgctttctgcaatcgttgaagtaatgcgctcctgcagctgcgggcgttttgagacggcttccaccgcccgcgccaatttactcaggcccgtcactttgccgccgcgcggaatgtaggcaatatgcgcttttccgtaaaaaggaacaaggtgatgttcacacatggaatgaaacgcgatatcttttacaagaacaagctcctcatggtcttctccgaaaacggttttaaagtgttctttcgggtcttcatttaatcccgagaatacttccgcgtacatttttgccacgcgtttcggcgtatctaaaagcccttcccggtccggatcttctccaatcgcctctaaaatctggcgaaccgcctgttcaatctgttctttattaacttctttcattgtctgtgtcctccaccattgaatacatttaatttcgattctagcacatttgccgcgccaaaagcaaaacgaaagtcctgcccggtgaccggggctgcttaaatatgaaaagcccctttatcaaggggcttttctgtgaagaaacaaagtgtatgtatcagatgcatacacgatctatattcacaattattttcctgcaacagcgtctttaagagctttacctggtttgaaagcaggtactttgcttgcagggatttcgatttcttcacctgtttgcgggttacgtcctttacgtgcagaacgctcgcgcacctcaaagttaccgaaaccgatcagttggattttatcaccgtttttaagtgcatctaaaatcgtatcaaaaacagaatcaactgcttttgtagcgtcttttttagacaattcgcttgcttcagcaaccgcattgattagttctgtcttgttcatgcctttcacctcctcccaaaagggtatcaaatcagcagtttattatcatttcttcacagttcagcctgattctaaacctgtctgataaaaaatcaaagcagggaagaacagacaagtaaacggcttttcataagaaaacagacactttgaggaatgtttgtccaacaaagtgaagattttctgtatgtagagtaacacatataaaaagccatatcaagcattttaaagcctcaatcccttgctcgtcaaggttttcacgtgttttaccgaacaaatattcctttttttgcttttttcctcctaatccttgattgatttccagtatctaaaaagaataaaaaaagacccccgtttcaggaagaggtccttcagcttacaaaataatggcgatcaggccgcctgagccttcgttaataattctctcaagcgtttctttcagtttgtatctcgcattttccggcatgagtgacagttttgcggagattccttctcttacgatagagctcaatgatctgccgaaaatatcggaattccagatagaaagcggatcatcttcaaagtcctgcattaagtagcggacaagctcttcactttgtttttctgtcccgatgatcggtgcgaattcactttccacatccactttgatcatatgaatggacggagcgaccgctttcagccttactccgaaccttgatccctgcctgatgatttccggttcatccaggctcatatcggttaaggccggggcggcaatgccgtagccggtctgtttcaccattttcagcgcatctgatacctgatcatattcttttttcgcgtgggcgaagtcctgcattaattcaagcaggtggtctttcccgcggatttcaacgccgaccacttcttttaaaatctggtcatataaatgatccggcgcatacaaatcaatttctgccacaccctggccaagttcgattccggccaatccggcgctttcaataaattcaaattcactgaagtggccgacaacccggtcgacatcgcgcaggcgtttaatatcttttacggtttctttcactgattcctggtagctctctctgagccaatgattttctttcagcaccatgacccagctcggaaggttgacattgacttccagcacagggaactcgtaaagcgcttctctgaggacgcttaacacatctgtttcccgcatgctttcaacactcatggcgaggacaggaatatcatatttcgcgcttaattcagctctgagcgcttctgtttccgggtggtatggttttaccgagttgatgaccataataaacggcttgccgacttccttcagctcgtcgatgactctttcttccgcttccacgtaatcgccccgcgcaatatcgccgattgagccgtctgtcgtaatgacgaccccgattgtggagtgttcctggatgacttttctcgtaccgatttccgcagcctcatgaaagggaatcggttcttcgtaccaaggtgtattgatcattctcgggccgttttcatcctcatatcccttcgccccgggaaccgtatatcctacacaatccacaagacggatgttgacatcaagcccttccgcgacatgaacggacatggcttgattcgggacaaattttggttctgtggtcattatcgtttttcctgctgcgctttgcggaagctcatcctgcgcccgcgctcggtcggcctcattgctgatattcgggagcaccacaagctccataaattttttaatgaatgtagatttccctgtacggacagcgccaacgactcctaagtatatatcgcctcctgttcgttcagcgatatccttgaaaatatcgaccttttccaagtgatcccctcccggacttcctatccttatcatttttcattcaccattctccaatcaaatacaggacactatatgtgtatgacgttgtcctatttcaatatgacatctttagaaaattttcaggcagtcttttctatcaaaatcaaaaaaacctttctccctatttgtatgcgcgggaaaaaggttcattcctgtttcgtttgactttctaaaaaaacgggttcctgtttttcatttacggtgtatgtgactgaaaaggccgggacgaaaggagtctctttccataaaatatcctgaatttccgcccccggtttgattttctttttggtttccttcaggcagcgggcgagatcgacgcgatagtcggcatagatttctccgtcagcgccgattaaaagcggcagagacgtgcctgaaaccggacttttgaccgaaggagagtctttcatgccgagctttttttcatttaaagtgaacagcccttttgaaacggcgtcctcatagggaggatatgtatgcttttcctgatacattttgacacgcagcttcatgtcgcggattgcttccgccatttggagatcgaccagcttgacggtcggcttattttccacatcgacaagcacgtattggtacattcctccgctttcataagctgaggccggcggctcctctatgtatctgggcgcgagccgcttaaaatctatcggatatttttgatagagcggtgttttcatatcttttgtctgaatcggcagaagtccgccgttcgcctttttaaattcatccactgccgcttgcacctgctgaagctgatgtttgtaggatactttattttcagtttttttcgcttcagggtacagacagccggacagcagaagcaccgccattgccgttatgacggccatttttaacttatgcattccgcgccccctttttgctttattcattgacaggcccgctgaaaacgaccattaacacgatcaatcccgagatgaccatgcaggcataagcgagtgaagaaaccgctgcttttatcagtttgtttttcactttgtacctgctgacataaatagaggcgaccgcaacaaacattaatcccatagcaccaagcgcaaaccacattttcatcaatgccacactcacgttcgtgccccccgtcccatcattgtaagcgttatatttcattttaatatacaaatgttgaaaagatcaacaggttttccatctattgaaaaaacaaaaaaactgaagcaaagagggggactttgcttcagtcaagttgactatattcacctgtacgtctgagatacactctcttggacttcgatgctatagtatgcttagatgcgtacgtctgcatcctcttctgcctaaatcagcaaatgttttaagcgatttcagccggagagttctgcgttttggactttcgtcacttcagaatatgctgacggcatgttattgtcacttcacccggttttcgaatgtgttgaccaagtcttccatctcatgggttttcactctggccattaaggattctacggccgtttctaccttctgcccgttaaataatacttggtgaagcgcttctgtgatcggcattttcacctgatatttttgagacagctgatacgcagctttcgtcgtccgcacgccttcaacaaccatgcccatcttatccaggacagcttccagcttgtatcctttgccgagcaggttgccggcgcgccagtttcgggaatgaacgcttgtacacgtcacgattaaatcgcctacgccggtcaggccggaaaaggtgagcggatttccgcccatctttgtgccgagtctggcgatttcagcaagacctcgggtgattaaggccgcttttgcattatctccgtatcccaatccatctgtaatccccgctgcaagagcgatgatattctttaacgctccccctatttcaacaccgatcatatccggatttgtatagacgcggaaatgctggttcatgaataaatcctgaaccgcttctgcagccttgatattttttgaagatgatgtaacagtcgtcgggtgtcttaatccgacttcctcagcgtggctcggccctgaaagcacgacgatgtcttttctgtactcctcaggcagctcctcttccattaattctgaaatgcggagaagcgaatccggctcaattcccttgctgacatgaacaaaaatcgattgtttcgggatgtacggcagagcctttttcagcacttcccgaatggcttttgtcggaactgccacaatgatgaagtcagctccttttaaagcctcgcttaaatcggctgtcccgatgatagaacttgatagctccacacccggcaggtaatctttgttttcatgcagttcgttgatttgatcgatcaattcggcacggtgtccccacatcataacttgatgtccgttatcagccagcactaaagaaagtgcagtgccccagcttcccgctccaagcattgccacttttttcatctctgtatcacacctttttattttcttgctcttgcaaatattttaattggcgtaccttcaaatccgaaagcgtcccggattcggttttctaaaaagcgttcataagaaaaatgcatcagttccggatcgttgacaaaaacaacgaagctcggcggcttaacagcgacttgagtcgcataataaattttcagacgggagccgttgtgcgtcggagtcggattcatggcgaccgcatccatgatgacatcatttaagacatttgtctgcacgcggagagagtggttttcactcgctttaataatcgcaggcatgagtgtatgaatccgctttgtcgtcagtgccgacataaacagcaccggcgcataatcgagaaattggaaatgctcccgaatattctgttcaaattctttcatcgtgcgctcgtccttatcaacggcatcccatttgtttacgataatgacgacggctttcccggcttcatgggcgtatccggcgatccgcttgtcctgctcaaggatgccttcttctgcattcagcacaacgccgacgacgtctgagcggtcaatggcttttaacgcccgcagcacactgtatttttctgttgtttcatatactttacccttttttctcattcccgccgtgtcaacgattacaaattcctgctgattgtaagtgaacgccgtatccacagcgtctctagtcgttccggctacgttgctcacgataacccgctcttcgccgagcatcgcattgacaagggatgattttccgacattcgggcggccgatcaggcagaattgaacgacatcatcactgtacttcgtctccggaatgtttttaaaatgctcggcacaagcatcgagcaaatctcccaatcctaaaccgtgtgtacccgaaatcggatacggttctccaaagccgagcgcataaaagtcatagatgttcgctctcatttcggtattatctaatttattaacggctaatacgaccggttttttcgtccggtacagtatttttgccacttcttcatccgcagacgtcacaccttcgcggccgttcaccataaagatgatcacatcagcctcgtccatggcgatttcagcctgctggcggatctgtgtcagaaacggttcgtctccgatatcaattccgcccgtatcaatcaggttaaaatcataattcagccattccgccgaactgtatatccggtcccgcgtcactccgggggtatcttctactattgaaattctttcacccgcaatccggttaaagattgtggattttcccacattcggtcttccgacaatggctacgacaggtttacccatagtacccttcctttcaatccagccgcttacattttcacaaaaaattgttcaaccggttattaaaaatcatcttcgctatgaaaagaacccttcaaacagaagggcttaactcatttattatatcagttttcactgagatcacaatgtattcttcaaaatgtttcgcattcatgtaacagtctccgtctgttttcaagacatttttgtcgctcctttgccctgctttttgcttttttggctgatgcgcgccgcaagctgttcatatgtagtcagcccgacgagaagaatcactcccgccgaacagcctgaaagccatttataatcaccgacggctgctgcacccgcaatgttgcggatgaccgcagcatacaataactccccctggcacatgccgagaacaaaaagacaaagcctctcagggaaccgcccctcaacagaaagcgtaataacggtaagcagtataaccgccgcccattcaggttttatgataaaccaaacagggtcatataatgcaaaaagaaaaataaagccgtatgccgcagacgccgtcagatgaatcacaatatgacggagccgtttatgcatgccgaggcttcccgcatatacaaatgccgcagcaaaaaacatgacatatgccgcgttcagcgtaaaataagccgttatctgatgtatgcttgccatcatattagtcaaaataaagactgatacgtaaaaccggctttttgttttggcaaaaataaaagtcgcaagtatccataaaaaccacattgaccagtaataataaaacggttccataatcgctcctcctctgaccagtatggagcgggaacgcattttttaaaccaattatgcctgaaaggagcggataaggatgggaaaagacagacaggagaaaaaactgaaagcctcccgccgggtggaatctgatcgcgatgattcgattcaccataaaggagcgacaagccttgaacaaaacggtgaattccgaaaaagaaaatcgtaaaaaacagaaaaaggcatgcgagttcgcatgccttttaacgtctgctgaaacgggatgtgtcaattccccgttcagaaagccagtgatgtgtgtcaccttttatgaccaaaggcgccttttgcaattgggcaaccgattggcatccgagggcggtcataatcattttcagctcttgtaaaagcgccgtcatctcgtcaaacagcccctcttctcctttggaggtgagagctttcaggaaagtgcctgccattcccgcgccagaagcgccgagggcaatcgatttggcgacatccagggcactttgcagcccgccggatgcgataattgattgatcagcggagagcgagtggatttccgctaagcttgcggcagtggaaattccccatgtattaaaaaattgaagcgccttctctctgcgcatattttcaatcttagagaaatttgtaccgccgtatccgccggcatcaactgctgccgcgccggcatcaaataactgccgtgccgattccctgctcattccgaagccgacttctttgacaaaaacgggaactcccgcttccgccgcaatccgctcaatacggccgagagcgccggtaaagcttctgtctccctctggcatgacgatctcctgaatcacatttaaatgaatctggagggcatctgcttgaatcatatcaattgcccttttcgcctgctcggcatccgcctcgctgcctaaattggcaaatatcagcccgtccggattctcttttctgacgatctcgtaagaataccgttcggagggatcttttaaagccgacatttgcgaaccgacagccagcggcatgccggctttgcgcgcggctcttgccagcgatctgttaatttcgtatgtaagctgtccgccgccgcctgtcatcgcattgataaaaatcggcgaactgcttgtgagtccgccgattttcgttgatatatccactttttccaatgctaggttcggtaggctgacatgaacaaacgtaatatcatcaagccccgtttcccggttttgaccggtagacagcgcatgatttatatgttctctttttcgttctgctcgtgtcacgttttatcaccaatttattttaatttattaagcttgtctccgattaaatcgccaagctggaagccggtgctcggctcttctttcgcctggtattgacggaagtcctcctgatcggctttcggcgcttcttcaagctcacgcatgcttaaggaaatgcgctcttcgctttcgttcacgtcaagcactttcactttaacagtctgtccttcttcaagcacttcatgcggcgttccgatatgtttattggaaatttgcgaaatgtgcacaagtccttccacgcccggaagaatttcaacgaaggcgccgaagcttacaaggcgctgcacttttccttcaagcacatctccctgttttaccttttcgccgatctggctccaaggtcccggcagcgtttctttaatagataaagaaatacgctcattatcgcggtctacggacagtactttcacttttacgtcctgaccttcctccaccacgtcagacggtttttcgacgtgtgaatgagacagctgcgaaatatgaacaagcccgtcaattccgccgatgtcgacaaatgcgccgaaatcagtcagacgctgcacttttccttcaagcacgcttccaacctcaagcgtttggagaaaatcatgctttttggctgtctgttctttttccactacagcccggtgtgacagaatcacccggtttttatcacggtcgagttcaacgacgataagagagagggttttccctttatagtcagtgaaatcctcgacgaaatgagcttcgacaagtgatgcgggaatgaagccgcgaacgccgatatcaacgacgagaccgcctttcaccacatctttcacttcagcttcaaacacttcttttgtgtcgaattttttttcaaggtcttcccaagcgcggtcagcatcaacggcacgtttagataaaatcaaagcatcgtcttccacttttgttactttcaggtcaagctcgtcgtcaacttttacgacatccgatgctttctctacatgaagacttgataattcactgattggaatgattccggactgtttgacattgacaatttcgacatctacatgcttgtcctctacctttgtcacaatcccttttactacatctccaacctctggcacttgaacatcaatttgattcatttcctctgtcatttgaataacctccttggtccaaacctacacagcttaattaatacggtttgaaagttgaacatgtgaatgtccgcttttcagccgaatatgtattaaagaatcatccaaaaaagattttgaatgatcaataaaaagttttattagtattaacttctaataaaaggactggtttgtcaagcaataacatcttgtcttttgaaaaaaaattaaaaagcgctccgcccgaagttaacgtgatttctgttcgacgatctccagaatttttcctgcgacttcggcaatgctgagtgacgtcgtatcgatttcaatcgcgtcttccgctttgcgcagcggggaaacttccctctctgaatcgagtttgtcgcgtctggcaatttcttcaatgagcgtctcgtaattcacgtcatagccttttttcttattctcttcatatcggcgcttcgctctttcctctacggacgcgagcagaaaaattttcacttcggcatcaggcagcacgtgagtaccgatatcacggccgtccatgacgacaccgcctttttgtccgagctgctgctgtcttttaaccatttcttctctgacgcctttatgcttggcggcgatggatacttggttgctgacttcgtcttttcggatttcttctgtcacatcttctccgtttacgagaacgatttgtccttccggagcggatacaagctcaatttccgtacgcttcaaaagctctgtaagcgcggcttcatcggttaaatcggcattctgcttgagcgccgtatatgtaatggcacgatacatcgcccctgtatcaatgtacacatatgattttttctcagccactattttagcaacggtgctttttccggcagcggccggcccgtcgatcgcaattgataatttcttgtccataatctctctccttgctctttactcctctatggattgtatcatgaactgccggaaaaggggcgaaaaaattgagcagatttaccgctttaccgtttcaatccattcttttttctccattttatcaactccctcatatttcacggctttcgaaatataaggttcaataggctgataatgaagcaaaaactgcaccgcgcccaaaatgataagctgaatgcagaccaatttgaccagcagacgttcaaacgttttcatacacgcgcacctccattaggattagtatggaaaagtgcgctgctgtttattccgacagactgtttcttctctgctgcagctgcgcgcgcatacaatattggagtaaaagctgctgcgctgcggggccgatttctgtaaattcaagcgtcattttttgtttatccgccttttcatcataaaaaatccgctgggtaagagcctcagccgttatatccgcctccttttccttgccgggaagagaaaatgagacatacagcttttcacctggttccgcggaaatatgctcaggcatcacaacagcgattccgccggcgctgatattagaggaaacagtttggaaagcggtttttttcgcttccattttgacagatacatccaatactgcttctgcacggacgtatcggcgtctttgaatccgcttcatttccttctgagggggatgtccaatccgatcatcgggatgggttcttttttctttcctttgattatgcttttaaattgatacggtacttggccattccccataaattccgctgttatttccaatcctttatgcaaaaagaccgtccgtcccgaatccagatcgacgggatatgagatatggagttcgccgttttcaacgcttactgctttgctcctcgcttttttgggctcattgttctctatgtattcaatccaaatataatctccgacagctatcatgggccttcactctttcattatttatgcttttattaaagcatgtaatgaaaaaaaggaaaagacttttagtcctttcctcctttatttttataggtctttatatataggctctgcactttttaatttttctattttttcctcttttccgtcgtccgcattaatgaacatttgatacgtgtctttcccgatcgtcccgagcatttcgtagcaaagcacttcctgaccgagttcattcgtgatcagcgcctgccgggtctcccgcacttcaacatttttattcagcttcgctttcgcttcatcagctgacaaagcgggagccggaatcgttctcgtgcggtgcgccgccaggtaatcacgcgcggaaaaaccgacgacttcaccatcatccagcgccactttcattcggatggcttccggataaatgcggacgtttttctccacgggaataaaagaaaagacgccgatgttattatattgcgcgctttcatcaatttcgaggccttttgtttcatatccgtttttctttaaaaacgcgacggcccggttagatgcttcattgaggctgatcttttgtttcttcacgccccgtttttgaatcaaatagacaggatgtccccctttttgggtaatatccatatagataaaagatttgtgatccgcgtcattcatgcggatactgtatacatcccgattcgtcttccggccgcttttgaccactttaatggaataattatgatcaggcgcaaaccgttccgcgatttttaccgcttctttttccgtaatttgttttcctttcagatgcgtaaacccttttcgttctgtatttgcgcttgtaaacgtagggctggtactgtcttcagaaaaagcgcctacatttttttcgactgttttaaagctgtcgacgatcgtattatcgctttgttttttgtcagaggcgagcgccatctcaacatccatccaccgtaaatttttgctcatgacgagatgctgaacgctgcggagctggttttgaatgttctcggcctgtttgtacaggctgttcagtgttgtatattctttcttatcaagcggtttttggtctaaatcccggacggatgttttatagctgaaatctcctatattggataaaaactcctccgtcttattaaaaggcatgagagtcaggggcagctggctcacattgttatgtgcttcagatgtaattctccatacatcaatgagcgccggagacagagattttttactgttcattgcaagcgtcgtcccgattttgtcgtgaagctgatcaacatggtacgtcagttcatgaaaagccctctgataattattttccgcgtgcagaaggaccgcatctttttcctgatgctctttatatccccagtatccggttgcggcgatcgcgacaccgagaacagcgataatgattcctctaatcatgttaacacctcattttgcgtacttttactcacagaaaatgtgctttccgattcttttaatctgcggacgtccccaaatccatttgcttgtcgccgtatcaggattgaaataataaagcgcgttttcagaagggtcccatccgttgatcgcatcaagaaccgcttcttttgctctttcattcggctgcatgtatatttggccgtcggcaacggcggtaaacgcgagcggttcgaaaatgacgccggccaccgtattcggaaataacgggcttttaatacggtttaaaataaccgcggcgatggcaacctgtccttcaaacggctcaccgcgcgcttccccgtacacagcctgcgccagaagattgatgtcgttgtttgagaaaccgccaggcatattggccgctgtcgtattttgcttttgatttgactgaccgcctgtattgttttgcggcttttgagcaggcttattcgttcccgccggcttctgcgctccggctctcggttttgtttggttttccaatgggacgttgccataatgagtgaacgtattccctttttggatctgctccattacatattcacggtaatattttgattttgaaatcagcacctgtttggttttcgccccgacgaggccgtcaaccggcttcatgccgaatttctcctgaaaatttctcacggcccagtatgtggtccagccgtaaacaccatcgattttcccgttataaaatccgttatattgaagacgggcctgcaattctataacatcatcacccgtcgcgcctctttgaatcacttgatttgaaaacgcatgaatcgtttcatgatgatcgaagaaagcggcggcgaaagaaaatagaatgagacatgccataaaggctcctttgcacttcatctcttcaagcctcctactgcaaaatttaaagtgtacccgtattgtctgtcacgcggatatttttatacaccgtttccttcttatccctcatcaaggcataaaaaaagaaaccgcacgcgatgcgcggtttcttcacacttggatcatattgacggagcgtgctttttttgcctttcgcagcccgaaccaccataaaaacagcataaacggcagcatataatatacccaatgattgagggcggtaagaataaaatcgtacgaaccgtgcagacatgaaggcacggccagcgaaatcacaagccatttgacacgggcttttttctgcgaaaagcgggcttttccgagataaaaccccataatcactccgatcagcgcatggcaggagaccggcagaagcgcccttatgaaagcatgctcaacgccgtggccgaataaatacagaatattttcaagcgtggcaaagcctaaagacacactggccccgtaaacgattccgtcataatgctcatcaaaatgagcatgcgggtacacacttatcatcagaacgaaccatttcaccgattcttccaaaaatcccgaagacaaaaacgaaacgaaaaagcttcctccccccacatgctctttttcaagaacatattggataaacatggtcggaaacacaaggacaaccccgagaaaaaaagacctcagcaccatatgtacgggttcattgtcatactgatcttttaaataaaaatagcttaacagcgcaatgccgggagcaattcctgcagagatgattgcaaacatcaggcaacctctttcctttatattcctatatctatggtaccatgttgttcatatttttacatctttcaatttttttaaaaaagagcatatgaatgatcatatgctctctgcacccagccgttttgatatttcgtttgcgatcaagccgccgtgaaaacggccgttctcgataaaaatttcattggcgttatttccagccgcaatgactccggcgataaaaacaccgtcaacatttgtttccatcgtttcttccaggaaaaacggccggcctgattccgcatcaatccgcacaccgattttttcgaggaaaccgtgatcgggatggtatcccgtcatggcaaatacgaaatcgtttttcagccggaccgtctcatttcggccggagcggaaaatgatttcatcttccgtcacttcttcaagacaagcgccgaattccatccggattgtgccgtttctgacaagggcctcaaactcaggcagaatccatggcttgatgctcggggagtactcatgtcctctgtagagcaccgtgacgcgcgcaccggacttcacgagttccaaagccgcgtccacacttgagtttttcccgccgatcacagcaacatctttatcaaaataaggatggccttctttaaagtaatgaaataccttaggaagcccttcacccggtatgttcatataattcggatgatcataatatcctgtcgcaatgatacaaaacggagtgaggtagcggtcttttgacgtttctacaagaaaacggccgtcttcctgtttcgttacgcgctccaccgtttcaaaggcgtttacgcgcagctcttttcttctgacaacctctctgtaataagagagagcctgtattcggaccggttttctgttttccgtaataaaggcaacatcgccgatctccaatttttcacttgaactgaaaaaagtttggtgggtcggatagttataaatgctgtttacgacattccctttttcgatcacaagcgcgttcacgccaatttgcttcagatgtatagccgccgataatccgcaaggacctccgcctattataattgctttttcttctgtcatgtccttcaactcctgcgattggcatttccatcataagtttccactcatataaaaaatctcctatattatcataggagattttttttgtttatgcaaacgattggtttatatccagcctctgaaacgcgaagcctcagccattttccgcacgccgaccatgtaagccgcaagcctcatgtcaatccggcggttttgggacatttcataaatattattaaacgattttatcatcatattttccagtttttcctcgacttcttcttcactccagtagaagccctggttgttttgaacccattcgaaataagaaaccgttacaccgccggcgctcgccagaacatcgggaaccagcagcgttcctttgtctgtcaggattttcgttccttccagtgtcgtcggtccgtttgccgcttctaccacgattttcgctttgatgcggtcagcgttttcttctgtaatttggttttcgatcgccgccgggacaagtatatcacagtccagctcaagcagctcctgattcgtaatggtgtcattgaaaagcttcgtcaccgttccgaagctgtctctgcggtcaagcagataatcaatatcaagaccgtccggatcgtaaaggcctccgtacgcgtcagaaattccgacaactttcgcaccggcgtcatgcataaacttggccagatagctgcccgcatttccgaaaccttgtacgacgacgcgcgcgttctgaatatcgagaccttttttcttggccgcttcttttatgcagatggtgacgccttttgccgtcgctgattccctgccgtgggatccgccgagtacaagcggttttcccgtaataaagccgggtgagttaaattcatcaattcttgaatattcatccatcatccaagccataatctgtgagtttgtaaatacgtcaggtgccgggacgtctttagtcggtccgacaatctgactgattgctcttacatatcccctgctcagcctttcaagctctctgaatgacatatttctcggatcacaaacaattccgcctttaccaccgccataaggaagatcaataattccgcattttaaactcatccagatggaaagtgctttcacctctttttcagttacattcgggtgaaaacgaatgccgccttttgtcggacctacggaatcattgtgctgcgcacgatagcctgtaaatattttcacagacccgtcatccatccgaacaggaattttaaccgttaataatctgagcggctctttcagcagttcatacacttcttctggataccccaatttttccagagctttatgtattacggtttgggttgattttaatacatcatgtttgtcttcttcattatgaccggtgaatcgatcggctgccatttgagttaacctcctaaaatcttctgtttctctcatgctccctttcagtgactagtatacaccttcaatatctccgtgcatagaagaaagacaatgatttttccattatttcgcttaaaaaaagacggccgctgaaaacagctgccgtttcaaatcttttttatgaaaaatgtttctggatggtctccacagcattgccgtccatgatgagttttccgtactcatggagcctgtaaatcgtaatcgtcgccgggtgtccgtattcagccagcaccgcgatgacaccttcggcggaacgggagccgaggtcttcaaggcttacatagtattggttctcatagtggtagacggtgccgccggtaatcccgattcggtgaaggcttccggctagctgaatgatatcttcaaacgaatggaactgataaataatatccgggctttcgtcaagtttgacctgcatctcgatataatcatcgtcatattcgtcatcttctgcatccgcgtcatgatttttcgttacaatcacaaccataccttgtgcctgaagagaatatacttccaccgcgatcggaccattcgcttcaaagccgagctctgtatttgcttcattcatcatatctttaaataactggtggactttaaacgagtccttccagaggtcttcttttgtcagtccccgatcagtcagatcgtcgagggttaaaaagattttaatcttattatagttcagacgctcaagccgcataatgttccctcctgcctcttcttgcacacaaatcatataacacagtatatgaataaatgagtcataggttcttaatttgttatcagtttacaccgtgtacagcgggaagacaagcagaatgccgttttttatcaccgcggccgggttgtttcaggaaaacggctcatccggtccgcacagcgtaatcatatgcgtctccggcttcgccccgagcctcagcggaacttttgtcgtcccgtagccgttgctgatcaggtaatgcgctttttttaccgttcccgtcccgcccaattcatacggcccgaaccggccgaaacggatttggccgccatgcgtatggccgctgaacacagcgtcaatcccgtctgactccctcatctgctcatggatgtcaggattatggcaaagcaggaggtttactttgtcagcatccgtatatctgattgcagattcgtaatcatccatcatcattctgatatcatccaccccgcagatcgtaacggtttcccctttataagcaaactgaaccgattcatttctcagcggaatcactttgtatgcccgtaaaagtgagagcaatttttgctggctgacctcgtaatcattatttccccacacataaatgacaggcgcgagagccgtcagacgtttgatgttttcttcaattctggcgtaaggaactccgccctccgccaaatcaccgccgagcaaaacggcatccggcttataaactgccgcttcgcggagaagcttttcatcaattaaacggcggtgcacgtcagatataaagaagatggtgagcggcttcatccctttcattttatcaagcgtaaatgtatgtgttttcaaatggctgccgtttgccgttttgtacatgacggccgccataaccgcagccgctcccgccaatgtgccgagaattcccgctgtaagcttcataaacgcactctccattctgtcattgtcttacattagacggacaaacaaaaaaagacgtttctatcctttccggaaaacgcctcattttatttgctttcaaaataaagattgatatcataccgatgtttcatcaagtaaaaaacagattctctcgccctccatttttcaggctggggccataaatccgtgcttttttggataatttcacatctcagtttatgaaattcaccctcagctttttcttccttttttttaaaataataagaagtgcaatacgcaaaagcggaagccataatccagcacaaataaaccgtatggcctaatatttcctgcaggatcagctgcggagaggcttggggggcgttaaagcttttaaacatcagcagtatgcacatcagggaaaaacaaacgagggacgcccactgccatcttcggcactgtgcggcataattttcgtattttaatttccgtttcaccagcgcctgaagcatttgtttcgtcggtccgtcagcaaatcggtctaattgcttccataaagaatccatgcgcttcacaccttgtccgttttcattggtacactatatgaaaaacgcggtgaaaacatgcatttattttaatcagacagcggaatgttcagaacctggccggtgtacacgtcgtttccgtttaatccgttgtagctgcggattttttcttcgcccgcccggcttttataatatttcattgaaatgcggtaaagcgtttctttcggctgtacagtatgctgtacggtccgcacttttttcgggacagtcccggcttgatcacttgcggcagccggagccgctttttcacggacagccggcggagactgctgttttgtctccgcgtattcggtgtctgtcggctttacttgtttttctgaggacgtttccgttttttcaggtgttttttcacttggtttttcttttgttttttcagatgcagccgcttctttcttatctttgtcgtcagacttttttttcggttgttctaaaagagcggtttctgacgtttctttctgagcgcctttcggaataacggcaggcgcgctttcactgtggtctatgaagacatcttcatagtccttcgggtcaaatctgctgctgttcgtcatataaagaagaccgaaaaagacaccgattgttacgataatgaacaggacggtcagaaaagtgaacagcggcgtttttgttttggttttttccttcacctgctcttccttttttttacgctcctcttttacagattgtcttgtcgggaggctgtcttcaagatattcaatttgttcatccgcggccgcggcaacctgctgctcggcacgcagctgagcttttcttctttcaactcttgacatttccgtcatagaaacccctcctaacatattgaaaacggatctgacaggcaaataccgcatcaataataaaatgcgctgtaaccggaacgaataaattgccggtccattcatagataagccccagcaaaagactgatgcccgcaaccatcataaacagaagccacttcgccaagtatctgaaatgaagcacggtaaaaatgaagctggcggcccataagccgatatgtgtctgcagaacgcctctgaacaaaatctcttcgctgaacgaaatgagaagcgtcaaaaacaaaatgtgcagaaccggcctgttcttaaaaagcaatacattaatgccgccgtcatcatataaatgcgaaggacaccatttcatcaccgccagatcggcaaaaatgacaaggacggcaagagttacaccgtaccatatgatattatcgtcacgtatatgccacagctttaaaaaatcgtgaatgtcggtgaaaaagaaaaagccgataacagctgaaaccgccaatatgagcaattgggtggcatacagctgtatcacaatctcccggtctgagagctgctggatcaattcgctttgccgtctcagctgaactcacccgcagactctgaaccgaaaatccggcctaattccagcttccaatcttcaaaccgttccatgtttttccgttctcctttttgctcgtacggagccagatcaagtccgcagctgctgcagcattgtccggtttggccttcaggctcatacgattcatcaaaataagacagcagcgcttttcttatacattctttccgctctaataacgccgaaaaacggttcattttacgcagcttcttttccacgcggtatgtcagttcttcctgcagctgctcttttgtggtttttccttgcagatacagatggacggccgttcgcgcctgtgtttcctggacgcctttattgatcagaacgtcccgaagctttcgctcatcatccgtaccggcatcccgtatgacggccagaatgccttccagatcataatcagacaggctttctgtctgaataatctgctgctgaagctcggtatcgccgggcgccctcagcaaaatactgacactcgggctgccgtcgcgtcccgctctgccgatttcctgcataaaggcctcagccgtttggggaggataaaagtgaatgacaaagcggatatctgacttatccacacccatgccgaacgcattggtacagcagatgcaatcaagctggttatggataaattgctgctggatcaagattctgtcccctgtatccattccgccgtgataataatccgtccgctttcccgttttttcattcagctcagccgcaagctcttccgcccatttcctggtcggacaatatatgataccggggccttcaagcttttcggcaagctccgtgagcctgtttattttttcggcattatcagccaaatgttctgccgccaggagaatattcggccggttgactgaataaagatgacgcacagcatgctcaagtccgagcacatccgtcacgtctctgagcgtttcttttgtcgctgttgcggtcagcgccaatacaggcggctttccgagtgcctgtctgaaaggcccgagcttcgaataatcaggcctgaaatcatgtccccattctgatatgcaatgagcctcatcaataacaaataaactgaccggaacgtttttcaaacggttcagtacataaggtgaagaaagggcttcaggagacatatagagaaatttataccggctgatgttgctgagaataaaatgccgctctgcggaattcagcatgctgtttaatgccgcaacccgcttttctccttttgctttcagctgctgcacctgatcttccattaatgaaagaagcggtgaaataatcagcaccagcccgtccatcatgtaacccggaagctgatagcataatgatttccccccgccggtcggaagcatggcgatcgtatcctttttttggagaacgctagtcataatctcttcctgcccttttttaaaggaatgcaaaccaaaatacctggataaagctttatgcagctcagtcatgctgattcaccgtctttgccagcgccagcctgatctggaaatagctgaagcgcatctgcattccttcgcgaatccgtttaattttattcgtttgatgctgttttgcaaatgccgttatcatacgctgttcctcttcagaaagatactgttctataaaaaatgcaggctgatgcaatgatatttctacgatatggtcttcgattgtggcggtttttaaatttctgaccgcggcgatccgttcaatcggaaaccctttttccaacagctcgaaggtttttctggcagactgtgtcagcgcgctttccgcctgcagatcggacaacagctcgcgcagagcgggatatgcacattgcggaagcgattgaataacataatgtaccgctccccaaaactggacggacacataccattcatcttcgttcagctggagagcgagctgcttattcgttttgccgattctgttgaatgaagttaaagaatagacaaaaataagcgcctgccgttcacttacgccatgcagaagctgaaacagcgcgtcatgcatttggacggaaagctctttagcatctctgtttttccgcatgaaccgtttgacccatctcagcgtctgcacatcgttggtaaccgggatatattgactgcattgatgctctttgtttgacaggacttgaatgagcagggaaagccgcctccacaggatgacggcaggcgtttgataatttgcgccgtggcagtgcttcggccaaggccgctcggcaaacgcccgttcaagcctttgaacgccgcgcgcagtcactttccacgttccctcttcttttccggctgtaatgtatgagttctcggtgagtttatgcaaagaagccgcaatatcgccgcgttcacactgtgaagccatgccgaaatatttagcgatctgaaataagccggcatcctgaatggtttgagacgacttttttccttttaataaatgaaacacagcactcggagtccgttcgccgtctattttgtccagacagtcgagaaccacggtatcaaagtagtttatcgccaatctaaacacacctacatttcttttgtgacaagtttcgttttttggttctttttattttaacagattttcatataaatttgacgtttaaagtcatcttttagggggaagtgctaaagagaatcccttatgtgataagcattctcaatcatttttctgttgaaatttgacactaacatcattacaataagtaagaggaataggtgttatatttaaaaatatataaggtaaaccatttgttccaacacgaacaatctgggaggttttattcatggcaaagtacacaattgtagataaagatacgtgtattgcatgcggcgcctgcggagctgcggcaccagacatttatgattatgatgatgaaggcattgcgttcgttacgcttgacgaaaataaaggtgtcgtcgaagttccggaagttctggaagaagatatgattgacgcatttgaaggatgccctactgattcaatcaaagttgcggatgaaccgttcgaaggcgatccgctgaaatacgaataaaaaagccctccccgtgagaggagctttttcgtcctgaataagactccggctgttatcggccggagtcttatttttttgccgatcagcacaaacaaaaaaagcgcccggctgttcttcacagagcggacgctttaagcctttattgtgtttggatgctgcgtttttgttcaatccaaggtttcagcttcgtaaagatgaacgtaaagacgatggtgatgataatgccttttacaatgttaaacggcagaattcctgcgacaaccgccgttttcaactggctgtttgacaatgccggtgaatgtaaaaaccaagtatacgcgggcaggataagaatatagttcaaaatactcatcagcacggtcatcgccgcggttccggccagcaggctcactgcaagcccttttgcagaattaagctttttaaacataaacgccgtcggcagaataaacagcgttcccgcgataaaattggctgcctgcccgacaggcacgccggccatgcttccttgaatgatatactgcagaatatttttaatcgcttcaaccgcaatccccgccgcaggcccgtaaaccaaaatggcgataattgcaggaacgtcactgaaatcaattttcaagtaatccggcagccccggaaacgggaaatttaacagcataagcacaaacgcaatactgctaagcatactgatgacaactaatttttttactttcacaatgctctctccttttcgatcaaatctctcgaaaagtggaaaggttctttgcgccccaataaaaaaaccgcttttgttaaaaagcgggagcttactaaggcttggcaaagaaacgtttgatataagcatcaaaacgtctgctgaacctccatcttctcccatccagactatactgtcggctccggaatctcaccggatcctgccgccgaagcagctcgcgggcttagagcgtgatgctcatcaccgccggtagggaatttcaccctgccccgaagattgatcttatgaatttattcacattatatatgatcaaattgtaattgtatagagaactgctcaattttatataaaatattgatgaagcccattttaactgaattatcggcttccttttctcctttactgcgtcaatacacattgacactctattaagaatatgataaattatcagatatttagtcagctaaactaggaggaaatctaacaatgtttcgagttttggtctcagataagatgagcaatgacggcttaaagccgctgatggaatcagactttatagaaattgttcaaaaaaacgtcgcggatgcagaagatgaattacatacctttgatgccctgttagtccgcagtgccacaaaagtaaccgaagaattgtttaaaaagatgacttctttaaaaatcgtcggcagagccggtgtcggcgtagacaacatcgacattgatgaggccacaaaacatggagttatcgtgataaacgcgccgaatggaaacaccatttcaacggcagagcatacattcgcgatgatttcttcattaatgagacacatcccgcaagccaatatctcagtaaaatcaagagaatggaaccggacggcttttgtcggagcggagctctacggaaagactttaggcattgtcggtctgggccggatcggaagcgagattgcccagcgcgccagagcgttcggtatgacggttcatgtattcgatcctttcttaaccgaagagagagccggcaaaatcggcgtaaacagccggacattcgaagaagtgcttgaaagcgcagatatcattaccgtccacacgcctttaacaaaggaaacaaagggactgcttaacaaagaaaccattgccaaaacgaaaaaaggcgtccgtcttatcaactgcgcaagaggcggcattattgatgaagcggcgcttttggaagcgctggaaagcggccatgtcgcaggcgctgcccttgacgtgtttgaagtggaaccgccagttgaatcaaagcttcccgaccatccgctggtgatcgccacacctcacttaggcgcttcaacgaaagaagcacagctgaatgtcgcggcacaggtttctgaagaagtgctgcagtttgcaaaaggtctgcctgtcatgtcagcgatcaacctgcctgcgatgacaaaagatgaattcaaaaaaatccagccttatcaccaaattgccgataaaatcggaagtctcgtgtcacaatgtatgaaggaacccgtcaaagatgttgcgattcaatatgaaggcaccatcgccaaacttgaaacatcatttattacaaaaagcctgctgtccggtttcttaaaaccgcgtgtagactcaacggtcaatgaagtgaacgccggcggtgtagcaaaagaacgcggtatcagcttcagcgagaagatttcctcaaatgaatcaggatatgataactgcatcagcgtaaaagtaaccggagaccggagcacatttacgttaacggctacgtatatccctcacttcggtgaacgaatcgttgaactgaacggctttaatattgacttaaatcctgccggccacctcgtttatatccagcaccaggatacgactggtgtaatcggacgcgtcggacgcatcctcggcgataacgatatcaatatcgctaccatgcaggtaggccgtaaagaaaaaggcggagaagccattatgatgctttcttttgataaacatttagatgataaagtcgtcaatgagctgacttcagttcaggatattgtttccgttaaactgattgaccttccgacccattaaacgtaaaaaaacccaaaacatatgaatgttttgggtttttttacgtttaatgggtcggaagcggattaggcgcggcaggcacagcaattggttttgtcacatcataattaccgattttctttgcgtgtgcatgtgtgaacagcacctcagaataaccgaattccttcgcggttaacaaaagtccttcgatcattaaaatgccttccagcgaatcttcaactttatgtttttcagacaattggattcgcagctgctcgccgtcttccttttccgataccgatgcaatcgcatctgcttctataatgctcgcggtctgtgagcctccgtctgttgtcttcatcccgtcaatagcctgatatactgaataataggtttgttcagacgggatgagatactcttgtcccagactgtcgctgtaagaaaaatacgcccggttcgtctgtttatgtacggacatctcagcggaaatgccgtaagatttataaaaatcctgtccggctccgttttgaacctttttcaatttaatccgctcgtaaggactccatgtcaaagtctctttcagcatctttttcaataagtcagcatcggcagctgattcgatagaaagacgtccgtttacctgcacaagcaaatccttcttatccgccgttacctgcacaccgtccaaaaggttcggcacagaaaggaaagattcgggcacttctaagttttctgcatcagataatgcctctgaaaccgattcgtcaggcttctttttttcaaaactgaccggaatgacggcggatgtatctgaatcggcaaacgccaaagtaatgtaattgtttttgttttcgttagaaacgacaaacgtcttctgatccggcttgacagcagctgactgactggctttttcagcttgaccgctgtcagctgtaagatcaccggcagatttgtttgtcatcaggtgaggagaaataatcagagcgatgcacaatgcgcagatgccggctgcggcggggccgatccagcttcgggccggttttttcctgtacggtttacccgtttcaatattccggtaaatggcctcgggtgaacgatgatctctaaccgccggaagttgtcttaacaactcctctactctttcttcgttccaatatgacttcatcatccattagctcctccctcaaaagctccatctgtttccgaagtattttgagccctctgtgttgggtcgttttgactttgctttccgagaagcggagagcggcggctgtttcctgaatggaatatccctgaataaatctcaagataataacagctctttgatcaatggtgcaatgatcaagcgcggtataaatttcccggacattttcatgctgtacggcgagttcgtccggaagcaaatgctgatctctgacatcttgtgtatcccaatcaaacgtacccataatacgctgtctgatcgtctgctgcttgcggaaccagtcaatcgccacatggcgtgcgatggacaacagccatgttttttcactgcttcttccttcaaatgtatgataggaattcaagacgcggatatacacttcctgcgtcaaatcttcagcctgcgacttatcttttaccatataaaataaaaattgatataaatcttgatggtatgcatcgtataatatctgaaaggtttcttccatgggaaacccctccgttcacttttttgtcgtaaaaatgcgttgaaaagttacattacaactatattacgagaaactggaatttggaagggaatttatattaacatattcttaaatttttaaaggagaaacaaacaaaaaacacccgcagaacatgcgtggtgtttcgtatggaacaagattgttcgtcaatttcagacgtcatcctgcacttttgtcggaatataaaatgtaaacgtcgtccctttgtcgatgctgctgtgaaccgcaattgagccgccgtgggcttccacgatattttttacgatggcgagtccgagtccggtccccgccctgcctcttgttcttgctttgtccgctttataaaaacgttcaaaaataaaaggcagatcctcttccggtattcccgagccggaatctttgatatcgattttcagtccgtcttttacggtctgagccgcgatatgaacgcttccgcctgactccgtatggcgcagcgcattatctataaggttggtaaacacctgttccattttgtcttcgtcaaagacacactccggctgagacaccgagatgtcctctgtgagcgaaacgcctttttccttcgctagcccggaaaatttgcgggagatcttctccagaaattcatacaggtttaccgtttcatagcgcaggcccgtatgtccggattccattctggccaaatccagcaaatcattgacaagccggcccatgcgaagagattcatcataaatgatctgcgcgatttcttttttctcctcttcggtgcttgcaatgtcgtccactattgcttcactgtatccctgcagcatagaaatcggggttctgagctcatgactgacattggcaatgaagtcttcacgcaatttatccagcctgcgctcttcggtcatatcacggagcacggccacggcgccgcggacgtgtgattccgcataaagaggcgacatcaataaaacccatgaccttccttgaagcgtcatttcaatcatttgctctttttccgtgttcactgcattttgaaatagctcttttgcttcagggggaaggttgtctccttctttaatgttcatgttctgctcataataccatgcctgcagaaaacgttcggccggcgggttggtcaccaaaatggtgccgtcgatattaatggtgatgaccccgtctgccatactgcttaaaatattggacagctgttctttttcctgatttagcgcgttaatatggaaattgagctgccgtcccatctgattaaaggcaatggccagttccccgatttcatcttgggtcagaatcggaatttttgtatcaaactttcctttcgccaagtcttgggcgccttcccgcattttccgaagaggatatgtcaccctgctggataaaaagaacgcgaaaaacgttgtcaagacgatggcaatgcccgccgcaagaaaaatatagcgtgtcgtatgtttcgtcgtatctttgacggcaagcagcgattgggataaaaagaccatgccttttttgccgtctttttcatacggcactccgacgatcagccgttcgttatccgaaccggcatttttggggaccgcgcgtttgcttactttattgcggtctgtcagcgccttgtgcagatcccggtcatgtttaatctgctctaatgtaatagaggataaatgattatcgtcattgggcgaataccagacatgcttatcatcctgaatgatcgcgatgctcgttaaattgtccgccagttcccacgtgatggatctggcaagcggctggtcttcatgattttctattatgaccgcaattttatcggcaagctgcgttaaatctttttccgcttcttcaacatggtaattttctataaattccagaagcagcaccgttaaaataaataaaacaattaacacgagtgaaagaatggtaaaccaaagctttcctactacgcttttccaaaacttcattcagcgcctacctcaaatttgtatccgactccccagacggtgacgattttttttgccgctcccgggacactttgtttaatttttcacggagccgtttgacatgagtgtccaccgttctgaggtctccgaaaaattcatactgccacacttcttttaaaagcttttccctgtcgtacactttgtccggtgttttcgccaggaagtacagcagttcatattccttcggcgtcaggctcacctccgtgccgtccgcagtcaccctgtgagcatcgtgatcaatggatagatgcgaaaagacgagcacattttttgtcggggtattggctgtcagataagatgtttgggaagcccttcttaaaagcgcctttacccgaagcaccacttctctcgggctgaaaggcttgacgatataatcgtccgtacctgcttcaaatccctggacgcggttggcttcttccccttttgccgtcagcatgataatcggggtcgcttttttttctctgagctgccggcatacttctattccgtccgttcccggcatcattaaatccaagagcaccagatcataatctgatgccagccccattttaatggcctcgtctccgttttccgcttcttcaatcacatagttttcccgttcaaggtacattcttaaaaggcgtcgaattctggcttcatcatctactactaatattttagtttcatttgtttgatccatcgttttccccctgctttccttctgttactttcattttaacaaactgtgcggcagcttgagaactgtatcggctttttgcatctatgcgtacgaatgaagtccggcaagcacaagattcacaaaaattaagttaaacataataatggcgaagccgatgacggcaagccacgcggacttttcgccatgccagcctcttgacagccgcaagtgcaaatacgctgcgtaaaataaaaaggtgatcagcgcccatacttccttcgggtcccagccccaaaaacgcgtccatgcaagctgcgcccaaatcatcgcaaacacaagcgcgccgagtgtgaataccggaaaaccgatggaaacagcgcggtagccgacttcatcgaccaagtccagattcacatttttgacgagcgggcttataagagcgctgattctctttctgaatatcagcctgagcgccccgtataaaacgagacctgcgccaaacgaccagatcaccgtattgacctttctgcccgaaaaaatggccggaagctcaataagcggcttcattgcgccttccgtaagcagttctccgtcatgcggaccgacaagcgcaggcatatcatatatcatcacgcttttagcctcttttttatccacccaattaaattctgctttgtaatccgccagccggaatgccgacgtgacggcgataaatgccacggtcgtcacgagtataaacatgatgacttcaagccagaacgtttttttgcccggtctggattggtcgacatgctttaacaggaaaatgacgccggctacaaaactgatcgcaagaatcgcctgcccgagcgcagccgtcgtgacgtgaatgtacagccaattgctctgcagtgacggaataagcggcgtgatgtctgtcggaaacatgcttgcatatgcgataagcaaaagcgcgatagacaatgtgaacatgcctaatgaaggcagtctgtaaataaagtaaataataataaaagcgagaacaagcatcatgccgaatgacgtcgtaaattcaaacatattgctgacaggcgcatgtccgcttgccgaccatctcgcaatgaaatagccgagatgacaaagaaatccgaaaatggttaacgtgattccgatagccgaccagcggcccttaccgtccttcgcaccttttgttccccggatggcgccgccgaaaaccgggacggcaattaaataaatcaaaaaggcagcataaagaaaatttgcactcagctccgccatgacaccactcctttttcactaggcctgatttttggccaattctttttgatcggccggctcttgaatcccggtcccgctaagaacaaattcgatatcctttttcagaccgaaccagtttttgttcgtatgtcccgccacaagcacttcatgatcacctgttttgatccagatccttctgtgctgccagtacatcccttgaatgacgccgatcataaagatcgcgccgccgacggcaagcacccataaggttaagtcttttctgacagtgagtcctgtaatgtttttcgtttccacatggtcgaattttaatttgtacttgttactttcggaaccttcaacagtctgctgaatcgcaacaaaacttttctcccctttcggcttgtcgggagccgtgattttaaagacaaaagccggattgttaggaaccttcgttttcgtgctcggttctccgtccttgttaaaataaaaatcaggaagataactggcgatctgcactttgtaaccgttaccaagatcgtagtccgtgtcgggatcaagaagattgatcttcagtttgccgaatgactgttttgttttttggtcgatcagctgaaataccatctgatcgagctggttttctttataatccacctgatacacagaataggagtcaaagcgcagcggttcattgacgcggatattgttttctttgactcttttaagcttcggcttttcaccgaatacaatgtcgccttccctcttgtacaaaaccgcgtccgttgtgaaagatttggcgactttgccgtttccggctctgtcaatggcgtcggcgaatacttttttctcagtgtctttgttatatgtctgcatcgtgaaccggttgttttttaagtaatatttgccgtcagtaccggggatctgggcggtttcgccttcacggacccagagcgtttcatcgacatacataccgggtacaaatctcagcatggctccgatcagaaaaatgatcaggccgatatgattgacatagggtccccaccttgaaaaacggcctttttccgccaggatgcttccctcttgttctcgcactctataatgcttttttttcaatcgtgttctgaggccatcagccgtatccccgctcagctcggtttctgtccggctgtatagacgctgcctcttcaaaaagaccggattccgccgtactccttgatttttcagcgccctgtacaaaggaatcacccgatccaggctgcagatgaccagtgatatgccaatggatgcgatcaggagcatataccaccatgagccgtacaggtgatgaaaccccagcaaataatacagttggccgattatgccgtactgctgttcataatatgtatccggctgggcacccggcggcagataagcttcctgcggaaaaaccgtgccgaaagcagacgccgccagagtaatgacgatcagccatattccgacttttacggaagaaaagaagttccataccttatctacgattgttttgttatatgtttgcgaacgccttgcgctgccgtcgtaccgcatatcggcaagcggtgatttttgttcatcaagcggcttcccgcacgactcgcacaaaaccgtcccggctggattcacgtgcccgcattcacatttgacctttttcatgaagacgcctccggcttaattaaattcatatagtcatgaaccatgcgttctgtcatcgtgccggtcaccactttcacgacttttccgtcgggattgatcaaaaatgtcgtcggaataggtgatacgccgtacgcgtccagcacttgccggtcagtatcgagcgcaaccgggaaattgacgccgtatgttttcataaaattatgtactgcaatttttgattcgccgacatttaccgcaaccacctcgacaccgaggtctttaaaatgcttgtattgattctccatgtagggaaattcctgcttgcacggctcacaccacgttccccagaaattcagaaaaacacctttcccttttaactgactcagttctatgagtctgccctctgtatctttcagcgcgaaattcggggctttggacccctcagatatacgctctccgtttgtgtaaacggcattatagatggtatatccgagcgcgcagagtaagatgagaaggatgccggtccgaatgaataaacgccgccgttttttgttcattgtacactgctcccctcccctgtctgcaaatccattcaattatatcatctacacgttttgtaatttttgaaggttatgtgaaaattagaaagcgtttttaccgtgttcagctaaagcccgcagccttttcacctcatgcggcgtcaattctcttgcgtctcctgtgcgcagacctcttaaatctaaaaatgcgtattcttcacgtttgagtttcagcacgtcatgaccgatcgcctcaaacatgcggcggacctgtctgtttcggccttcatgaatcgtcagctgaataatgctcgtctgctttcttttgtccagggaaagcattttcgctctggccggcgctgtcttgccttcttcaagctgaatgccgcgctcaagctttctcagaagttccttggaaggaatccccttcactttggcgacgtacgtcttatcaatttcgtatttcggatgcatgagtttgttggcaaactcgccgtcatttgtcagcaataaaagtccgctcgtatcataatcaagcctgccgatcggataaatgcgctgcggcacttctttgaaaaagtcggtcaccactttccgccctttgtcgtcatcagctgctgagatcactcctctcggtttataaagcagaaagtacacgggttcttcccgctccacctttaatccgtttacttcaatctgatcagaaccggtcacttttacgccgagctctgttattacttttccattcacctttacttttccttcttttatcagctcttctgcctttctgcgtgatgccacgccggcatgagcaataactttttgcagtctttccatgtcgttcacctcaagtataatcttacttttttccccttgaacaaacaagctttttcaaggagagttattctgatatataaaaagcgcctgatttcaggcgcttccaaataataacgtaactatgatgattgatgcaaccaccccgatcagatcagcaagaagaccaacctttaaagcatcccccatttttttgatgccgaccgccccgaaatacaccgtcaggacatacagcgtcgtgtcagtcgatccctgcatgaccgaggccagtctgccgataaatgaatcaggcccgtacacggcgatcagatctgtcgtcatgccgagcgccgccgtccccgaaatcgggcggatcagagcaagcggcacgacttctgcgggaatgccgagcgctgtaaagaaaggcttgcacagccccatgacaaaatccagcgcgcctgaggcccggaatacggtaatcgccaccagcatcccgaccaaatacggaatgatggaaaacgcaatctcaattccttcttttccgccttcaacgaatgattcatacgtcggcacttttttgatcgtgccgtatatcaatataccggcgataataatcggaatcatggctaaagacagccaattcaccatttccattcgcttacctcccttttcttttgcggcggtaccagaagtagcggtcaatgaaaatcgcgccgattcccgaaattaaagtcgctaagatggtcggcccgacgatatcggtcggtgatttcgccgaataagccatgcgcacggcaatgacggttgtcggtatcaatgtaatactcgaagtatttaccgccaaaaaggtgatcatggaacggctggcctcagacttacctccattcagctttttcatctgctccatggctttaataccgagcggtgtcgccgcatttcccagtccgaaaaagtttgccatgagatttgataagatgtatcccatcgccggatgatcagggggaatatcgggaaacagcttagagataaacgggcggcacattctgctgaatatatccaaaaggccggactgctcggctattttcatcaggccgagccagaagacgaggacgctcattaatccgaacgagatcgtaaccgcttctttcgctcctttaaaaacagcttcattcacatcctgcaaggtaccgttaaacatcgcaaagacaagtccgattaccgtcagacatacccagattaaattgaccatgacgaaccgcccgccgcgctcataaacaggctcgtaaacgtctcaatgaaatgctttttcggttttttatggcgctcgttttcataatagacgggaatcttggcgatcactttcccatcatgcataacagtcatccggccgacgacatcaggaatgagagaggcgtcctttttccaggcttttttcggttttattaaggttgtgcggatttttacatcgtcgatttcatcctcttttaataaatatttgacatcccgggcaataaaagcgtgttttccgtaaaacgtctttttcagcttcgggatgccgccttttttagcgacgacataggttttatagtgctcaaagacataattaaacatattcatatggtcatcccagtcatccggatcatttatggtgaccgcgatgagatccgttccgtcttttgaagccgtcgaaacgagcgtccgtttcgcgatttttgtgtaacccgtttttccgcctgtgctgtaacggtagagcccagtcagaagcttgtttttatttttccatacccggtccatcgtttccgccttatacacttttgtgcctgaaacggtccggtattccttgattttcatcgcgtatttagtcaaaagcgccatgtcatacgccgtagaatataaattttcatggtcgtccagcccgtgcggattttgaaattttgtattttccatcccgatttgctcggcttttttgttcatcataaatacaaaaccgtcaaggcttccgccgacatattccgctattgccgcagcggcgtcatttcctgatctcagcataagcccgtaaacgagatctttcagctttactttttgtcccggctgaagataaatggctgagccttccgtttttacggcattcggggaaaccgtcacggtctcttccatcttccctgattcaatcgccagcaccgccgtcatgattttcgtaatgcttgcaatccgccgcttatgatgttcatccttggcgaataacaccctgccagatgctccgtcgataataatcgcgctttttgcgctgacatgtatttgggcatgtgccgtattgccgtctgtaatggaaaaaagaataacaaaagtcaaaagaaatacggcagcttttttgagaaagcgcatgaatgctcacgtccttgttgtgggtttgtacaagtttatgcgcctgtccatgacttatgaataccaattgcatcactttcacataaaaaaactctcccaaaaggaagagtttttatctgactgatgccatatttgagcctgatgcttcatattgcgccaattcttcccgcatgcgcagaaattcactgctgagcgaaagcagaaggctccgcagcgagtccggcacttgctggtagaattcaatcgcgctttggcctgtataagcggcgcggctgttttcgtaccatgtatcctttttcggcatgaaaaactcttccacgcactgatgatacactttatacagcgttttttccgctctcacctcatgaaacggctcctgcattaagagccgccggcaggcttcctgggcgccttcgcaaaagacggtcatcctcctcagcacactgagcacgtcgcggcagtatgcctcatccgcctctccttgagcccgcatctccggcaatgttgtatgatttaaatagctgctgaccatcgtgacaacctcggctaaaaattcaccagtttcttcagtatgggccctcacaatcgaatttcccatttccgtccgtttccttcctctcttgtacgtcgtcatttgcgtcattcatcaatggcctttccctactatcgtatgatgaaaaacggttattatttaatatcctcaaaagtttggttgaagttttcaaagaataaatcggcttcctcctggagaacgtcctcctccgcattttcaggaagcggcgggagctcctccaatgtttttaagccgaattgttcaagaaataccggtgtcgtgccgtataaaatcgcccggccgggaccgtcggcgcggcccacctcacacagcaacgcttttgacacgaggctgtgcagaatccgctcagacttcacgccccggatatcttcaatttccgcccgtgtgatcggctgcttgtacgaaacgatcgccagcacttccaaagaagcctgtgacagcccttttgacggcacttcgattagttttttcaaataaggcacgaattcttttttcgttccaagcatatacgtatccgcatattcggtaagctcgatgcctctgtcgtcttccttgtactgagcggccacttcttccatgattccggccagttccgcttcttctatttcaagcaccgtcaccaattgctttttggtcagcccttcatcacccgccgcatacagcagggcttccacaatcgctttccaattcacgatatcaagcgccatgaatggattcactccccgtaatgtatatatctgaaaagttttcttcctgttcaatgataatctgctgatttttcatcagttccaggactgctaaaaacgtcacgacgagatggtctttttgccgagaaggaaaaagctccgtgaagtttattcttctccccgccgtttttaagcttttaacgatttcgttcattctgtcttcaatcggtatttcctgtcttgtaatggtcgtttctttcggccgcgtgatttttttacgctgaagcaccttttgaaacgcgccgatcatgtcataaacggtcaccgacagtttctgctcggtctgtttgatttcttttgcatactcacttaaatcactcggcggctttgtaaatgacttttgtctttcttcttcccgctcttttaaatccttcgcagcggttttatactttctatactcaatcagcttttcaatcagctcgtcccgagggtcttcttcttcaagcatttcgtcttcaaacagctcttcctcttgtttcggaagcagcattctgcttttaatgctgagaagcgtcgccgccatgaccagatattcactggcgacatcaagttcaagctcttgcattgtatgtacatataataaatattgttcagtaatggttgccacgggtatgtcgtatatgtcgatttcaagacggttaatcagatgaagcagcaggtccagtgggccttcaaacgtatcaattttcacttgatattctaccattatctcaccattttcagtatcactctcattgccggaaaaactggctaccctttagtataatccaccgaaatgctctcgtccaatacttttatacacgtcctccgttatttagaaaatactgaaaaagaagatatacgcctatacctttaaaggcggatgcacatatgatagccgtgtaaacttgaaacaaagggaggctgatttcacatgagcggagcttgtttcggcggaggttttgcattaattgtcgttctgtttattttgctcgttgtcgtaggagcatcttacatctgctagttcctcaggcttcagacaccaagccgctctttttccttttcatagcgctgtggtacactggttttagcataaaaggaggaagcggcttgtatcctaaagcttatatcggctttttggccgaatttcacgcatcaagagattattttgagtgtcatgaactgttagaggaacattggaaagaaagcccggctgaaaagcggagcattcattgggtcggcctgattcagcttgccgtcgctctgtatcaccagcgcaggggaaatgaagccggggcgaaacggctgattgccaacagcttacgtattctgcggtctgaaaagcaggcggtctgttctctcgggctcagccatccgaagctgattgagctgatagaaacgctgtcagacgatatagaagcgggcctgccttacagaagtgttatgcttccgattacagatgaagccctgaaagaagcatgtcttgccgaatgccgccaaaagggttatacatgggggcaagacggcgtatcagatacctttcttattcataaacaccgcctgcgggacaggacggatgtcattaaggaacgcgaacgggaaatggagagaagaaaaaaaagcagaggctgacggtcagccctgctttttctatatcaaaacagctcccgaaaccgtgaagattccgggagcatttgtcagttattatatgagatatcctgatctttttgatgttgacagcgttcaaaaaagctttgcgttaattcattcggaacgagtgcctccgttttgaacagacgttttaaggcgtccatcatttgctttccgattccttgatggcggtgagaaggattcacgctgatatgccggatttcaacctctgagtcctttttttcgactccgatcgctccgacgatatcttcatcctctttccaaagaaagagctggcggccagtatccgtttcatagtcctttattgtctgctgaagctgcttgagatctttttcattcggcataaatgacagaagacccatcgcaatcttttcaaacgattttttataacgaattaacataaaaacccctctatatccaaaatgtccattcatgtcctatcaaacggatacataaaggcgatccgttttctcacattatatcattttcgccgcggttttaaacgcttttcaacaaattattcaaatgagcggtttaaatttgccatttcaatggcagatactgcgcaatctgctcccttatttccagcttttgttccggctcgttcgatggcctgctcaatggtttcagtcgtcacgatgccgaagataaccgggacgcccgtcgccgttcccgcctgggcgatgccttttgccgcttcattgcagacatagtcataatgcgttgtcgctcctctgataaccgtgccgagcgtaatgacggcatcgtattttttcgtttccgccattttctttgccgcaaacgggatttcaaacgctcccggcacccaagcgacgtcaatgtcgtttgattctacaccgtggcgaagcagcgtgtcttccgctccgcttaacagcttgctcgttataaattcattaaatctgccgacgacgattccgattttaagtcctgttcctactaggtttccttgtatgatattcatatgttatccatccttttttgtgagatttgtttttagaaatgaagcagatgtccaagttttttcattttggtctgtaaatactgtttgttatgcttactcgcttccatttgaagcggcacccgttctgaaatgctgagaccgtatccttcgaggccggcgattttccgggggttattggttaaaagtttcatatgctgaacccctaagtcgcggagaatctgggcgccgatgccgtagttgcgcagatcaggcagaaagccgagcgcttcgttcgcttcaaccgtgtcgtacccttgttcctgcaatcggtacgccttcagcttattgattaaaccgattcctctgccttcctggcgcaaatacaatagaacgccgcggccttcttcagcaatttgcgcaagcgcggcatgaagctgaggtccgcaatcacagcgatgggatgcaaacacatcgcccgtcaggcattctgagtgcactctgacaagaacgggttcgctgttaaacgggacatcccccatgacaaaggcgagatgttcttttccgtcaacctcgtttgtatatccgtaaactctaaacgtgccgaagtcagtcggcagcgtaatatcaacttctctgttcacaagtgtcgtaatgttgtaacggtactctattaagtcttttatcgtaatcattttcagctggtggcgttcggcgatttcggctaactccggcactctggccattgtgccgtcttcattcataatttcacaaatgacgcccgctccctgagaaccgcaggcttttgcaaggtcaacggctgcttccgtatggcccgcccgcttcaggacgcctcctttttttgcgattaaggggaaaatgtggcccggacgctgaaaatcgtcagacacagattcctcgttcaacagcgcctgaatcgtaaaagaacgttcttgagcgctgatgcctgtttttgtcagcctgtggtcaatactgaccgtaaacgcggtctcatgtgagtccgtattatgatcgaccatcgggtgaagatccagccggccggcgatgtcttcagacagcggcgtgcagatcagacctctcccatgggtcgccataaaattcaccacttcaggcgtggcatgctcagccagcgctacgaaatctccttcgttttctctgtcttcatcatcgacaacaatgatgacttcaccttttttcagcgcctctaacgcctcttctatcggatgaaacatatcgatcttcctttctaaaagccgttctcgcttaaaaaggcttccgtgatagtttgattgcttttcttttgttctgttttgtgcaaaaagcggtataagtatttgccgatcatgtcacactcaatatttacggtcgatccgactgttttcgtgtgaaaaatcgtttctgagatggtatgcggaatgatggataccgtcacgctttcgtctgatagaccgaaaatcgtcaggctcacgccgtctaccgtaattgaacctttcaatacgagcgtttttgtcaattccggcgaaagttttaaatcgtaatagaccgcgttgctttttttctcgatccgcgtaatttccgccgttccgtccacatgccctgatacaaagtggccgccgaaccgtccgttggcggacatcgctctttccaggtttactttactgccttttgacaagccgttcagcgaagtggctttcactgtttccggcataacatcaaccgtaaattgattgtcagaaaatccggttacggtcaggcagatgccgtttaccgcaatgctgtcgccaagtttcacatcacttgtcacttttgaagcggtgatggttaatgccatggaaaggcctgtctttttgattgcttggatcgtgcctgtttcttcaacgattcctgtaaacatcgtcaccatcctttccatctttaggtatggccgtcagttttatatccggcccgatttgggtgatttgtgtgaattgcaaatgggggacatctttcattgattgaaaaccttcaccggagatcaagctgggagcaagcgttcctccgattaatttaggggcgaaatagaaatgaagctcttggaaacagccttccttgacaaaacttccgtgtacggatgctccgccttccacataaacggacattattccgttttcagcgagaatactgagcacctcggggatgtgaatgcggtctgtttccagcggaaaaacttttattccgagtgcggtcagccggtctttcttttgcacgtctgcacctttggccgtaaatatccatgtcggcgcagcgccgtcagtgagcacatttgccgtttcaggaatggtcagctttgtatcgagaatcactctgaccggctgcttcaccgcatcaggaagcctgcaggtcaggctcggattatcggctttgactgtgcctgctccgacaagaatgctttggtgcgatttcctgtattgctgggcatcaagccttgccgcctctgatgtaatccatttgctttcaccggtttcggtcgctgttttcccgtcaaggctcgcggccgctttcaaggtgacatacggaagtccggtccgcatgaagtgaagaaacattttattcagctcttctgcctgctgcctgagaagtccggttttcacttcgatgcccgctgcttccagcattccgatgccttttccggctacaagcggattcggatctttcacagcaatgaacaccctttttatccccgactttattatcagttcggcgcatggcggtgtttttccgtaatggctgcaaggctccagcgtcacatacaaatcggcgccttttgcgtgtctgccggccatattaatcgcgtgaacctcggcatgcgcttctccgtattgcaaatgggcgcccattccgacgatctgtccgtttttgacgacgacagcgcctacaagaggattggactgtgtctgtccttcaccgcgtctggcaagttctattgccgtattcatataatattcatccatcgttatccctcccttcttccacgcaatttggcgtcaaaaaagccccgaatgtttacacagttcggggctttgccagttttaatccataggaaataagactatacagcaagtttattttttgcatagcttctctcatccttctcccatccagactttcactgtcggcttcagcttttcactgaatccaccgtatacagatgcatacgggtcacgggctgtaaagcgcaaagcgccttattaccgccggtcgggattttcacccagccccgaaggatacaatcaatatttttttgtccttatccgctattataacatcctttgcggcaggcgcaatgaatttgcacctcattattcagaaaaataaaaagcgcccttttcccataaaaggcgtctttatttattcgttcactttgacgaccttcaataagccgtcaatccggtttgatttgctgaaatacgctttaatcttatcaccttttttcacatcggagagatcctgcttcagcttgtcgccgttaaaaataatttttgtgccgttcgctgccgtaccgtgatactcagttccttcgattttcgtaattttatatgttttgactgtatattcttctttttcctgggacagggtttgtccgattgcagtcggcacgtctttcagttcaatatcgtttatgaccatataaccgcccgctaataacagcagcagtacaagtaaaatggctgcttttgttttaattcttcccatttttctacctccagcccgtatcaatctattcattactatgtcatattcctttttttcatgaatagaaaaccgttcttccctgcgtgagttattcatataacgtttcataaagggaagatgtttcatgtatctgtaaaactttctatctattaaatagatatacgaatttatgttctgtttttgagggtggagagataaatttatataaaaaaagcagttttctcatgaagaaaactgcctgtacggtttatttcgtcttgcgaatttcgttaaacgggaagaagacgaattttgatgtgcccgctatttgttttttcgtaaaaagaccgaggccgttgcggctgtccatagattctctgcggttatcacccatgacgaaatatttgtcgtccggcactttcaccgggccgaagtcttctgtcagccggtcatagccgtcttgcttcgccttgttcttgtttgccgctaaatacggttcggacacttttttgccgttgatatacagctgatcgtttttcatttgcaccgtgtcgccgggaagtccgataatccgtttgacatagtgctcattttctccgttcagcacgacgatctggccgcgtttgaagtcgcttatgtatttgaccgtcatattcacaaagattctctcgcggtcatgcagcgtcggatccattgatcttccatcaacgagataaggggcaaataaaaagtttcggatgagcagtgccagaacgacagcgatgataatggctttcgcccaatcaagtacggtgctttttttagaagttttttctttttctgatttcaagtgatttcctcccattagccatggtcgtttttattttaccatgaatccctgcacagagggcaaataagccccgcaccccatccatttttttcattttataagccggatctgctgattttacggtatttcacgaagcttccgatccgccaaatgcacaaatacacaaaagcaagctccattgttaaaacggcgaattccgccgcgtcaatgtttttgaaatattggctgagcgcgatacggatcgcaataatcgcgataatgacatatttaaagtttttattccgcttggagtagacaaagccgtcttcccggatttcataggcggtttgcgacagcatgatgacaccgaataccgcgcctaacagtccggcgatggcgagctcccaaagagcgggaaaatgaaacggctttcccgggatattcatgagctggctgatactgaatgtgaaaatgacggcgataatcaaaagcgggagaatgatgccgaagccgccgcctttaatcggcctgtttccctttttcaccctgaaccaaatcataagtgcgagaatgataatgacaaataaaacggttgccaattgaaccaacgtttctacctcttttcattgttgtaatcggtctttttcactataccagaatgatcaccgatgttcatatatgtattttttcatgatttacacatgagaattttcatatacataaaaaaacccgcctgaaaaaggcgggttttccgtcattatccttctacacggatttctttcattttgtctccgttagacatgtttttcgcatgctctaaaccgcttgtcacttttccgaatacagtatgaacgccgtttaaatgcggctgcggttcgtgtacgatgaagaattggcttgaacccgtgtctttaccggcatgcgccattgataaagaaccggcttcgtgtttatgcggattgccttctgtttcacatttgatcgtttttccgcttccgcccatgcctgtcccagtcggatctccgccttggctgacaaagcccggaatcacgcggtggaaaataacgccgtcataaaagcccgtattcgccagattttcaaagttagcgactgtattaggcgcttcattcggataaagttcaaattcgattctgctgccgttttccatttcgatgtaaccagttttcattctcattcctacttccgtattgttttttgtcaaagccttcttcaatatgaatttcaattgtaagccggctttctttttgatattcttttgaaggaagaggcctctgctcttcttttcgcggctattataccacaccttcagccggaaaacgaatctccccgcttccgcagaaagaaaatgaaaccagaacagcttcacagccgtctatgtatcggaactgcttcacgcaggtcctcacaaaccgcttcaaaacggcatttgtgaaaagaaggaggttaaccgctttgaaaaaaatgtggattggattgctggcggcggccgttgtattgtgcacaataccgaaaatcagcctggccgatgccgcagtcggagatgtcatcgtcacactgggggcggatctgtcgaacgaaaaccgtcagaaagtgcttgacgaattaaatgtccctgataacgcgacaaaagtgacggtcacaaataaagaagaacatgaatatctgggaaaatatatatcgaacgcccaaatcggcacaagagccatctcttcgtcatccatcacggtggctaagaaagggtccgggcttgacgttaagacccataatatcgattccattacggatgaaatgtacttaaacgccctgatgacagcaggagtgaaagatgcgaaagtatacgtgacggcgccgtttgaggtatcaggcaccgcagcattaacgggaatcatcaaggcatatgaagtctcatcagacaaagcaatttcagaagatgtaaaacaggtcgccaaccaagagcttgtcaccacttcaaatctcggggataaaatcggggataaaaacgcctccgcacttatcgcaaacattaaagatgatttcgcgaaaaacggtgtgcccgatacaaaagaaggaatcgagaaaaaggtcgatgatgcggcttcaaaccttaatattacactgactgacgctcaaaaagaccagcttgtttcattgtttaataaaatgaaaaatgcaaagattgattggggccaagtcggcagccagctcgataaggcaaaagacaaaatcacgaagttcattcaatccgatgaaggcaaaagctttattcaaaaagttattgatttcttcgcttcgatttggaatgcgatcgtgtctgtatttacaggagacagcggatcaagttctgacagctgaacgcaaaaagagaccggacgccattgttccggtctctttttcatttattgtttgacccccgtcttaaacggcagatccagttttacaatgtcttcataagtttctcttctaatgacaagatgcgcttcgccgtcttccacaaaaacgacggcgggacgcggaatgcggttgtagttgttagccatgctgtacccgtatgctcccgtgcagaaaacggcgagaagatcgccttctttcacttccggaaggtctatatcccaaatgagcatatccccgctttcacagcacttacccgcgatggataccgttttgtcgtggtgttctccgattctgtttgccgatacggcttcatatttcgcctgatacagcgcaggacggatattatcgctcatgcccccgtcaaccgctgcatatttacgggtgccgggcacttctttttgcgaaccgatggtataaagcgtcgttccggcgtctccgacgagcgagcgtcccggttcaatccagatctccggaatgtcaaaagcgtgcagctctgcgttttcttttaccgcttcgataattttttccacataaacggcgggatgaaggggttcatcctcttccgtgtagcggatgccgaagccgccccctaaattcagcacttcagagacaaagccgaatgattctctccattcattcagttttgcgaagattttttctgcggccagcacaaagcccgccgtatcaaaaatttgcgatccgatgtggcagtgaacgccgagaagccggatatggtctgactgcaatacttgttcaatcgccttttctatttgcccgttatgcagatcaaaaccgaatttggaatcttcctgtcccgtcgtaatataatcatgcgtatgcgcctctacccccggagtgatccgcagaagcacatccattgtgcgccctgatttgcggcacagttccgcgagtaaggatatttcataaaaattatcaacgacgatgcagccgatttgatgatcgagcgccattttcaactcttctttgcttttgttgttgccgtgaaaatgaatcctgtcagccggaaaaccagccgcaaccgccgtaaacagctctccgccggatacaacgtccaatgagagcccctcctgctcagcaagctgtatcatcgcaacggaagaaaacgccttgctcgcgtacgcgacctgcgcctttaaatccgcgtcaatgaatgcctgtttaaagcttttagcgcgctcacgtattaaagccacatcgtaaacataaagaggcgtgccgtaatgctccgctaaatacagcgcgtccacacctccgatttccaaatgacctagtttgttttgtctgcttgtgccatgtaagaacaatgctcattccctctttctgatccgcctatgggtgaaaaggacagcttcttttgagctgtccttatacaagtcccgtataagttaagacatacaatatcataatcttctgtcggtttcaatgcgattatgaaccgcttggctgtctttgacggtctttcgggtgaacaatgctcggtctgactttcgctcccggcactgtcgtccggacgagcacctgccacagcgccttgccgttaaacggtaaaaacggccataaatacggcgtatgaaacgagcggatattcgccattatgatcagcagcaatgtaaagcctatcacaaagcctttcacttggaaaatggccacgagcaccattaagatgaggcgtatcattttattggcgaggctgagctcatagctcggcgtggtaaatgatccgatggcggcgatcgatacgtacagaatcacttctgctgaaaacagccccaccgctatggcgatttgaccgatcagcaccgccgcaatcagacccatggcggtggataaagcggtcggcgtatggatcgcggccatcctgagaaactcaatccccaaatcggccaaaaagatttgcagaatgatcgggatatgcgtatttttatttaaaccgataaaatccaatctttcaggcagaagagacggttcaagaacaaagaggaaccagatcggaagcagaaccgttgaagcgataataccgaaaaacctgatccatcttaaaaatgttcccactgaaggcgcctgcctgtattcttccgcatgctgaacatggtgaaaaatcgttgtcggcgttatgatcacgctcggtgacgtatcaacgacaatgatgacgtgcccttccaaaatgtgattggcggccacatccggccgctccgtgtatctgaccatcggaaacgggttgtagccctgtttgacgataaattcttccaccgttttatcagacatcgtcaatccgtcaatgtcaatcgcattcacttcgttttcgacgatgctgacaaggtccgggtccgcgatgtcttctatatacacaatggcaagatcggtcttagagcgctcgccgactttcgtaattttgacgcggagcctttcgtccctgattcttcttctgatcaatgctgtattaatgacaatattttcgataaaaccgtctcttgccccgcggacgaccttttccgtatccggttcttcaggtgtgcgtccggggtaacttctgacgtcaacgataaaggcgaagcccgcgtcttcaacgataacggccacaagtccggaaagcacttgatctgttgcttcgtcgagcgttttgactttttggacctgctgattgacaagcctgttttcaacaacgtcaatcgcttcatccgcattctcgtcataattattaacgtcgacgagctgttccattaaatgaatgataaacaaagtatcggttaatccgttgacaaagtaaatctggacttcccggtctaatactcgaactttgcggacgccgacatcatagctcgttcccataccgacgcggtctttaaaaaattgttcattttttctaggatcccggtataccttgatcatattttccggtttttccggcatggctttcgctcctttctaaaatgaattcgaccgccttcatcgtaatcggcgagcctttggatatgtcatcttttctccccatctttcctatgtcgccgatgcccacaatgaggggaacgtccaatttatccagacaatacaccgtatctccgttcattctgtgctcgtccatttctctcattccggttttatcgacgccgtactccgtcacttctccatcacggtcaatggagacatcgactttcgtccattcagcctgatgggtcttagaagcgaccgcaatcacccccagcacttcaatgtcctgatgtgaggcgacatatttcagcgccgtttcgcccggcccttccccttgcaggcctgaatcgtcaaacatgacaaacaccgggtcattcggcgcggctttaatcagctgaacaagttcggggccgcttctggttgacggattgccctttgattgggaaatacaccgtccgcctgctttttccgcggcatattcaattgttttggcggcgtatacgtccccgtctgtcacaagaatgaccttccgtttcgtcatcaggcattatcctttcggtttaaaaataatggctacaagaaatgcgaataaaatcgctgaagatataccggcggaagtaagttcaaaaatccccatggcgatcccgataaatccatgctcgtgagcttgatgcatggcgccgtgcaataagctgtgaccgaagctgacgatgggaaccgtcgcgcccgcacctgcaaattcgataaatttgtcatatattccgaacccatccaacaaggcgccgatgacgacaaaagttgtcatcacatgggcgggtgtcagtttaaaaatgtcaagcagcagctgaccgataatgcatatgattcccccgcaaacaaaagccaacagatattccatttatgatgcacctcccgcccgctcaaataccacaccgtgcgcgatggtcggaatggtttctttctgctggatcattgtcggacttaaaagcgctcctgtcgcgacaacgagcaccctgttcagagcccctgattttaattgattaaaaatatgtgtgtacgtaacaagcgcggagcaggcgcagccgcttccgcccgcaaacacctgctggtccggcgtatagatgagaagaccgcagtcatcgtgtttcgttccgacgggatagccttcttctttgagcaaatctttcacgatcggcgagccgacgcctgaaaggtctcccgttaaaatcagatcataatcatccgccgtgcggtttaagtcctgcaggtgctgtttgattgtgtcggcggcagctggcgccatggcggatcccatatcgaacggatctgttattccgaggtcgcttacttttcccactgttgcgcttgtaatcttgatatcagaagggttttggctgatgatgaccgccccgccccccgtgaccgtcgaagtggcggtatccggtttttgcccgccatattccgtcggattgcgaaattgccgttctgcggtcgcgttatggctgctcgtggctgcgatcgcccggttcgcaaaaccgccgtcaatgagcgcggatgcgacggcaatcgtttccattgatgtcgaacaggcgccgaacagacagaggaacgggattttcagatgtctggcgacgtagttggcggtcacattttgatttaaaagatcccccgcgagtaacaaatcaatatcgctctttttcaaattctgtttttgcaaagctgagttgatggcatcttccattaactgacgttccgccatttcccagtttttctgattgcaatgcatttcatcgtatgtcttatcaaacagcgaaccgagcgggccgtctttttctttcggtccggctgccgtccccgccgcatttacaaataacgggttttcaaacacccaggtttgctttccggttaatttcattttttctcctcctacgaaaacagtttttcacaagcaaaccgtatcaggcctacgatataggctgccacgacgccgaatacaatgacgtttcccgccaatttaaacatgtttgtcgctactccgagcacgagtccttcacttctgtgttccagagccgcgcttgtcatactgtttgcaaaacccgtcaccggcacggctgaacccgctccggcaaactgcccgagtctgtcataaatgccgaatccggtcaaaagagcggaaattaaaataagagtggcggccgtcgggttgcccgctgttttttcattaaaattaaaaaagtggatgtaaaagtcttgaagagcctgcccgatcagacagatcaaaccgccgatcagaaaggctttgacgcaattccaaacatatggcggtttcggctgatagtctttcacttttgttttgtaattttcttttaagtttgtcacgtcggttcctccttatgaatgatggataaaatacagccaatgaaataaagagccggctattttgccgaacacaatggccatcagcaatatgatgattttgctgccgaagccgatccgtttggcaagaatgggaagcacattcagcacttctgtaagcgctgcggccagcatgccgataaacatgccggccaaaagcccgaccggaacggccagccattcagataaaaaaaaatgatttatatttaaggtttcccagccgccgaacacagctcctgaaataacagctccttcgtaggcctgtacaaagcgcattgtttttgtcagctgcataaggcgggggacgattcccataacggttaaaaaagccacaaagcccgcgcccacggtcagccctccgccaagcccgacaaatataacgaaaagaatgctaacgatcatgcagatctttcatcgtctcttcattttcgtgcattgcgacataatgatcgagatcaatctgataattaaacatctcgacttccagcgggcttggctcttcattcaggcgttttttgaagatgtgattaaaaaagacgatcataccgagaccgaggccgatgctgtatggaatctgaagcagatacgggtattcattccgttcgcccgttatgatttcatataaggcgatatgaacttctctcatactgacatcttcatgaaaattcataatggcaagacatgaaccgataaaaagcaggagccagacaccgacgaataaaacggctgacagctgctttttctggtaatggatttccactatcgtttcagcgccgccgacggtctgtacatcaagcgcgggaaaagcggtatgaatggttttcagcacttttatgatgtccagcacgacgatatttttgtcttttttcgtgaccttatacagcggcagtgccgacagtttttttttcagcttttgctgtcccgcaatctgcgcggcgtcgccgactgtgatgatatctccggtatgagccttcacgcggtggcgaagtctgagaaatattcgtctttccatcttgcatcaccatctttcgggtggttatatatgtagtatgtggttcacttttgttctcattcatcagcggcaaaagaccataaattaccaccggtgcacaaataaaaaaagccggcccgtaaaaggtcagctttccgtatgatccatctgcactttaatctgctttaatatttttttctccagcctcgatacctgaacttgggaaatcccgagccgttcggctacttccgactgtgtctgatctttataatatctcagatagacaatgagtttttcccgttcttccaaatcactgatcgcttccttgagggcgattttgtcaaaccacttctcttctgaatgatcagcgatctgatcaagcagggtgatcgggtctccgtcattttcatacacggtctcatgaatggatgaaggcgcccgcaccgcttcctgcgcaagcaccacatcctccgcatcaatttctaaatgatccgcaatttcctgaacggtcggcactcttccgtatgtttttgacagttcatctttcgcccggcgtattttattgccgagctcttttaaagatcttgatactttgacggttccgtcatcgcggatgaagcgctggatttctccgataatcatcggcacggcataagttgaaaaacggacatcataggacaaatcgaatttatcaacggattttaataatccgatacagccgatctgaaacagatcgtccggctcatagcctctgtttaaaaacctttgaacgacggaccacacaagacgcatgtttttttctatgaggaggtctcttgcctgctggtcgccctcttggctctttttgattaattctttgacttcatggtccttgagctgcgcgtttttgctgtttttcttaacctccacatccataacaaatctccttaattacaaagcgctttgctttttgataggtgttttgttaagcgtatcgtcgttcccatctccggcgaagaatcaatcgtgacatcatccatgaagttttccataatggtaaagcccataccggagcgctcaagctcgggttttgtcgtaaagagcggctggcgcgcttcctcaagatccgtgatcccgaggccttcgtcacgtatggtcagatagacgacatgatcctccagcgtaacggagatgtacacctttccgtcgcagttttcttcatagccgtggatgattgcgtttgttaccgcttctgatacgacggtcttgatttccgtaagctcatccatcgtcgggtcgagctgcgcgataaaagaagcaactgttacgcgcgcaaacgattcgttctgactgagggctgaaaattcaagatgcatctcgtttttcatgatgccacccccaacgttaaaagcgctttttgttccgattgttcgaacctgatgattttaaacaggccggacatgtcaaacaggcgtctcaccgcgggcgaaatcgcgcacacgaccatttctccgccgagctgtttaatttgtttataacgccctaaaatcacgccgaggccggagctgtccatgaaggtaagatcttcaaggttcagcacaatgtgacggatgccgtcagcctccagcgattcagtaaccctttgttttaatgattctgccgtatgatggtcgagttcacctgttaatcgaatacaaagcacggattctttgacatgaaagtcaattccaaggctcatgctcattcctccttgatatgatcggataatgagtgtttcgatttttgggaaagcaattccttcactatgacaaaactagtgcccgttcgccacgattatttaaattttgtccaatctcccatcgtccgcttcagaaaagtgagaaaacccgctttttccatgtcgtcttttgccgtgaccgggctttcaacgagcacctttccatcttttttcagaacgaggctgccgagcacctctccttttttaaccggagccgttacattgccgttgattttcacttctttttttactttgtccatgttctctccctttttggccagaagagagatcggctcagatgtggtcagcttgatcagtttctgttttccttttttcacttttaccgttccgacgatttgattccgtttgtacagcgggtgtgttttgaactggctgaaggcgtaatcaagcattttggtcacttgggcgtttctttctttcggggtgctggctccgaaaacgacagcgatgaccctcatatttccttttttagcggtggcggttaaacaatacttcgcttcgcctgtaaagcccgtcttcacgccgtctacacccggataaaatttgatcagccggtttgtattgacgagccagaactttttgtctgtattttctcttaaataatcctcatacgttcccgtaaattgagtgattttatcgtactttaataattccttcgccattttcgccatgtcataagcagagctgtaatggtctttttcaggcagtcccgtcgggtttttgaaggaggtatctttcaatcccaattcttttgcttttttgttcatccggctgacgaaatcctcttctgaaccggcgatatactccgccattgcgacagatgcgtcatttccggaagctatcgcaattcctttgagcatttcttttaccgtcatttcttctccgggttcaaggaaaatctgtgatccgcccatagacgcggcgtgttcactcgtcttgactttatcgctcatctttattttccctttgtcaagcgcttccatgattaaaagcatggtcatgatttttgtcatgcttgccggcgccagacgctcccggctgttcttgttataaagaatgcttcccgtatcgcgttcaatcagcacggcgcttttggcttcatgagcgagctccgatgtatgttttccgtccggctttgcaaaagcggacggtgctgatgccgttaataaaatgccaatcaacaaagtggatataagacgtttcatctccaaagccctccatttcataatcctttttattttttccaaatccggtggttttatacgcctcatctggaaaatgtttcgtgttgagggcacaaaaaaacagctgcttccgaagaaacagctgacttatgctgacttatttttgagatcgtgcgactacggctttgacaagcttcaaaaagccgccttttactttttccgtcatttccattacttcttcatgggataacggctggtcaagaatacccgccgccgcgttggaaatgcatgagatgccgagcacgcgcatccccgcgtggttggcgacgatgacttccggcacggtcgacatgccgacagcgtcagaccccatcgttcttaaaaaccgaacctcagcaggcgtttcgtaagacggccccgtaacagctgtatacacacctttttgaacaggaatgcccagctcatcggccgttttttcagccaagcttgacagctctttgtcataggcttctgacatgtccgggaatctcgctccgaattcagcttcgttcggcccgattaacgggttggtgcctgtaaagttgatatggtctgtaataatcatcagatcgccggcgcggaattcagtgttgataccgccggctgcattcgtcacgacgagagattcaacgccgagcgctttcatcacgcggactgggaatgtgacctgatccattgagtagccttcatagtaatgaaagcggccctgcatcgcgatgacctgcacgccttcaagcgttcccatcacaagctggccggcatggccttctaccgttgagaccggaaaatcagggatcgtttcatatgtaagcttgacagctccctcaatttcatcggccaatacgccgagccctgatcctaaaatcagaccgatctttggtgtttctttcacgtgttctttaataaatgcagcagcacgttcgatcttttgtttcaaaaaaaagtccccctactgtaatcttgataaaaagctttttccatattccggcttttccgttttgaaattatccgcaatggttgcgccgatatcggcaaatgtatccgcaagcggcagctgttcagtgtgtttgtgctttttgctgtaaacaagaagcggcacatactcccgcgtgtgatccgtgccgtgatggacaggatcattgccgtgatccgcagtgatgatcagcagatcgtcttctttcattttttcaaacacttccggaagcctcgcgtcgaattcctcgagcgcttttccgtacccttccggatcgcggcggtgtccgtacagcgcgtcaaaatcaacgaggttggcaaagctcaggcccgtaaactcttcaccgagcgtttcaatcactttgtccatgccatccatattagataccgtgcggcgggaagatgtaatgccttctccgtcataaatatcagaaattttgccgatggaaatgacgtctaatccgctgtctttcattccgttcattaccgtgcggccgaacggtttgagcgcataatcatgacggttcggcgtgcgtttgaagctgcccggttctccgacgaacggtcttgcgataatccggccgaccatgtacttcggatcaagcgtcagttctctggccgtttcacagatgctgtacagctcttccagcggaacgacatcttcgtgagccgcaatctgcagcacggaatctgctgatgtataaacgatcagcgcacccgtttccatatgttcttttccgagctcgtccagaatcgccgtgcctgaagccggcttatttccgatgattttccgtcctgaacgccgctcaagttcctgaagaagttcatccggaaatccttccgggaacactttaaacggtttttcaatgtagaggcccataatctcccagtgccccgtcatcgtatctttcccgtttgacgcctcctgcatttttccgtagtacgcaagagggtgctccgttttttccacgcccttaatgtctccgatcagtccgagaccgagctgcgccatatggggcatatgtaagccgttcatgtgctctgcgatgtgtccgagcgtatttgcgcctatatcattaaaatcggcagcgtccggcgcttcaccgattccgacagaatccattacgatcaaaaatacccggttatatttgtattcagacatcataaaagcctccttttcttccatctgtccattgtagcttacagaggtcagacaactcaagtataaaccgtttacattcttgttgacaatgccgattcaaataattagaaccttctctgtattccgccaatccggcaaaaaaagccgcggcccctccggcagcggctcctaagcgcgcggatgatactgtttgtacacgtccttcagccttgttttcgtcacatgcgtataaatttgcgtcgtggaaatatcggcatgtccgagcatctcctgcacggcgcgcagatccgcgccgttttcaagcaggtgcgttgcaaaagagtgccggagcgtatgcggtgtcagctcttttttaatccccgcttcaagggcgatttttttcaggtttttccagaacccctgacggctgatctgcctgccgtgatgattcagaaaaagcgcttcggttacgtttttctttaataatttccctctggctttttcaatgtatgcttctatcgcatgggaagcggcttcaccaatcggcacaatccgctctttccgcccttttccgaagcagcggacgaatcccatcgtcaaatggacgtcggataatttcagctcgatcatctcgctgacccggatgccggttgcgtacagcagttcaagcatggctttatccctgagaccgaacgggctgtcaagcttaggcgtgtccaataaccgctcaacttcgtgaagcgccaatactttcggaagcgtccgctctgttttttgtgtttcaatatgtaccgaaggatctttatccgcggctttttcccttaacagaaattgatgaaaagaccggatcgacgccaaatgcctggcagacgtcttgccggatttcccggagtcctttatatgctttaaatattgaataatatgaagacgggtcacatcattccatgaagtgatctgaagggtttcagttaagaagagagaataacttttcagatcacgctcataggacatcatcgtattttgggacagccctctttcaaccctcacataatggatgaaatccttaatttgatccttcactcttgatctactccccgttttggtaaaaaaagatcaatcggccgaaccagccgtctttctcctcatgttccgttttggccactttgacggcggagccttccggtttatcgtaccgatgatagttttcatactctgaattcacccatatcatagcataatagaacagcgcggtaaaacctgtgaacagaataaacactttgatcgtatccgcggctgttttcaggaatctgcccatctttcgatcgaccctttctttggcggctgttagtacaccttatgccaatttcaaaggcttttatacataaaaacagcaaaaaaccctttcctggcagaaaaggttcataggcttttactctgtttcatccccgcggcagcggtggcagattccgtgaaaagtcaatctatgatctttaattttaaatttccaatcacgttcaatcacttcttcaacgtcttcaagcagatcttcttcaatttcatcgacggctccgcactccatgcacaccaaatggtgatgaaagtgagccgcgccttctttgcgaaggtcgtagcgggatacgccgtccccgaagttaattttatcaacgacttttaattctgttaataattctaatgtacgatatactgtagcgagaccaatttcaggagatttctcttttacgaggaggtatacatcttctgcgcttaaatggtcttcttcgttttcaagcagcactcttaccgttgcttcccgctgtggcgtaagcttgtagcttgacgagtgcagctgctttttaattcgatcaatacggttttccatgtctttccctcctacgccgcattccatgactcattataacaaaatacgcgcagagttccaactataattattataaactgataaataaaagtattattttgtgataattattctaaaatatgcgtgaagacagcttttccataaacatcggagacacgtacgcttcgagcagtgaagcgatgaccgagaagaaaacgatgagaatcagtacgaaggcgtagcgtccgaaccattggatcggcgcgtcatgaaggctgcgtttgacaaacagctgccggatcagcttcagtgaaaaagcgatggagcatgtccccatgataagatatgccggaatgagaacgatgttttgcggcagaaccgaaataaatgacaggaaaaacccgttcatccccatttgattcactaaaaaaccgaccgtgaagccgacgacgattccttttaaaaacaccataatgaaaataaccggaagaccgatcacggaaataccgagaatccacatcagccccaaatattttacatcatgaaagacggcctgccaaaacatttctgaagcgccggcatgttttccgtcagacagctgtccgaaaaacttgcttaaatagtaatacaaatcttctttctgcgtgatggtcatgctgttgacgatgatcgccccgaaaatgacccccatcaaaaacaagacgaacacaaatatataaagtgacagatgatcctttacatggcgaaaaaacagttctttgtacgattgttttctcataccgctttcctcccgctaatctattgacttgatttagtagattgtatgaaagaaaagagaaaacatgacagagaaatcatagaaaggcgcgagattcgggcataaaaaaagaacccccgtcatcactccggtgatcataggggttcctttttttatgctttattctttcaagcctgtcttttttggttttcgtcactctttcatgggtgctgaaagacggcgccgtcccccttgacaagactgcgtcacgcatcccgtttcttctgagatgctcccgcatttttttcgttttgctcttcgccacgtgccaatcgctcctttttttgcctctttttatcataacaaaaaaatcccgatgtcttcaagaatacggctcatgtttcgaccggtaagcgcgcagagacgttttggcagatgaatagctccccatagcggcgtatccgtaaaaaaaccccatgaaaatccccgcatacacgtgttcatggtgaccgaaaacgatagacacaacatttccggcagcaagggcaatcgtgggaacgaatatgcccggaacccggcagaacactttgatcagctgtgtaacgcataagacgaccggcacgccgatcacagcatcccaaatatttgtatggatcagcggaaaataatccacattgacacctctttattccgtcttttgctatctgttagcctgcctaagaattccgcttcctattcatgataaaaaaacagcaccggcacatgtccggtactgtaagagttgtttattttcctgccgcggcccgttctacggctgctgatacggcctgatgcacgtccgcatccaaaggctgaggcacgagatcgccgtgttttgtgcaagaggcgatggcttctgcggccgccacaagcatttcatggtcgattttcttgcttttggcgttcagcgcgccgcggaaaatccccgggaagccgagaacattattgaccgagcggccgtcggctgcataagcggctccggcttgtaatgcgtcttccggttcaatctccggcttcggattagataaggccagaatgacatgtccttttctgacatcctcttttttaatgagacccggaactccggtggtgctgatcacaatgtcacacgtgtccattaaatctttgatgcttccaagcggctgacctccgtactgagcgaggcggttcattgcgtcttctgacttgtccgttccgcagaccgctttgactccgtatgccataaacatgcggcagatggcgacgcctgccgcgccgagaccgatctgtccgaccttcgcttcttttaaatcaagagcggcgcttttacaagcggaaatggcggcggcgagcgtgacgaccgccgtgccgtgctggtcatcgtgcataaccggaatatccagttcttctttcaggcggtcttcaatatcaaagcagtgaggcgaaccgatatcttcaagcagtattccgctgaaccccggagaaatgtgttttaccgtgcgaataatttcttccggatcagaggtatcaagcaaaatcggaattccgctgatacccgccagctggtcaaaaagcgcggctttcccttccattacaggcattccggcgacagaaccgatattgccgaggcctagaatcgccgtgccgtcggtgacaatggcgacagaattgctgattgtcgtatagatggacgctttttcaggctcgttttcaatcagtcggcacacatcggcgacgcccggtgtataaacacggccaagctcagccaatgtccggatcggcattttgcttttcatttgaattttgccgccttcatgagcagagagcacttcatctgaaactgtatgaagccggatgccttccccgagagcttcaatggcttgaatgatttcctgcagctgctcttcattttcggcctgcaccgtgatgttgcgcattgtgtagttcgggccgactttaacggtttcaacttccccgatatctccgcccatcactccgatggcggttgccacttttccgagatttccgggaacagtcggcgtttcaatcattaacgtccgaatcatatgctttgtaatcatgaaatgaacctcctaacccaatttttgagattgcaaggatttttctttcgtgtaccaaatgaatttccccgtgtatccgtacaatattgccagtccgatagatacaaaactgagccacatgaacggcagatatgaaaatgtggatacgccgagaatgccggccatatagatgccgttatcagaccacggcaccatccctgaagtaagcgttccgcccacctctgcgttccgggataaaactcttctgtcaagtttcagtttatcataactgttctccatgattttcggcgtcaggatcaatgacacgtacatcgcacagccgaaaatgtttcctaaaagggcgacgatcaatgtcgaaagcgtcacatttcccggtgtggtcagctttttctcaaaagttgagacaatcacttttaatacgccgagcttctcaagaattcccccaaaaccgagaccgaacagaataacgactaacgtatccagcataccggtaatgcctccgcggtttaacaggccgtttaaaaattcgacgtccgttttaatagaaaaaccattataagcagtcgcaatggcatcggcaaaattcattccctgaaagacggaagcccagattgcgccaagcaaagcaccgatgacgataacgggcatagacggctttttcaaaatcagaaggacaacgacgacaacagccggaatgagcatccatatatgaatatcaaacgttttctgcaatgaagactttaaaaattccactttgtcgagatcaatattttttccgccgtatataaatcccgttacggtaaatagaatggccgtaataatataggacggaattgacagatacatcatcgctctgacgtgcgacagcacatccaccttagaaagcgtggaggcaagcaccgtactgtcagacagcggtgaaagcttgtctccgaagtaagcgccggacaaaacggctcccgctacgatcggaagcggtatacccattccctctccgatggcaatcatggcgatccccgcggttcccacggttccccacgacgttccggtcgcaacggacataacggaacagataaccagtgtagccagaaggaaaatatgaggattaataaactctaaaccataataaattaacgtcggcacaacgccgccggcaatccatgtcccgatgagcgcaccgaccgaaacaagaatcaacaccgcttcaagaccgtttgatatcccggtgacaatcgaatcctgcaagtctttatatgaatatcccagcctgactccgagaataatagcgaaaaaccaagatattaatagagctagctggatcggcaggtctaaaaacactgtgaacgataagacaagtgctaaaaacccgaataataagataataatttccaataaatttggcaatctgacctctttcacaagaaaatccccctagaagaaaaaagctaaaacgctttcatcaaatgatataacaaattatactatactgcctcatccctttgtatggcaaccgcctattcactgaaaaacgtgaaaaggcggctgttgttactttaaaatttatttttctaatagatcttttccggcaatccccggttttgtcatttcatacggattcaaaatgatatccaattcttcttctgtcagtacatcattttgaaggcaaagatctcttacagattgccccgtcatgatggcttcacgggcaattcgcgcagccgcttcatacccgaggtgcggattgaccgctgtaatgacgccgacgctcttttccacgtattgcttcagacgtttttcgttggcttcaattcccgccagacaatgatcggtaaatgaacggaacccgttattcatgatgctgatggattgaagcaggttaaatacgagtaccggctccattacgttaagctccagctggcccgcttctgaagcgaggcagatcgtattgtcattcccgatgacctggaaggcgatttggttgatcagctctgccattacagggttgaccttcccaggcataatggatgatcccggctgacgggcgggcagtgaaatttccgcaagtcccgcgcgcggacctgaagccattaagcgcagatcgttggcgattttagacatgttcatcatgcatactttcaatgcggctgaaacttccgtatacgcatcagtgttttgtgtggcgtcaaccaaatggccggcaccgacaagcggcagtccgctgatgtcagccaggtgctttacaacctgttctatgtagcgcggatcggcgttaagtcccgtacctacggccgttgcccccatgttgacttcatacagatgctggcgggattgtttaattcgctttatgtcacgctcgagcacgcggctgtatgcttcaaattcctgtccgagacggatcggcacagcgtcctgaaggtgtgtgcgccccattttaatgacagaatcaaattgtttcgctttatccttaaagacactcagcatatgcgccatcgtatcaaggagcttatccaaaagttttaaggtggaaatatggattgccgtcgggaacacgtcgttcgtcgattgtgacatgttgacgtgtgtgttcgggctgaggtgaatgtattcaccttttttatggcccatgatttcaagggccctgttgccgattacttcgttggcattcatgttcatggacgttccggctcccccttggatcggatcgacgatgaattggtcatgccatttcccctcgagaatttcatctgcggcctggacaatcgcatttccgattccttcatacagccgttttacatccatattggcaagcgccgccgcttttttgacgatggcgagcgcattaatcatttcttcgtggatgcggtatccggtaatcggaaagttttctttcgcgcgcagcgtttgtattccgtaatacacatcagcttcaatttgtttttctccgaggaaatctttttcctgacgatattctttttgcgcgtttgtcatgctaaaaccctactttctctttgtggtagtcatgtttttacagtacaacgtcgtctgcgatcggtgtctccataatgtttttgacttcagccaagttgtgagactggccgagcgcccacattaatttcggcacgatggcttccgtgttcatatttctggagcggataatgagatcttgattgactcttcggccgacttcatagacgctcatgtcctctccttcttcaagacattgtgtcgtaatgacgacgacaatgccgctttcaatcatttcattgactttggcgagaatgtctcttccttcaaacggcacgccgccgctgccgtagctttcaatgacgattcctttgtacatgccctttaatgcgtcaaacatttccggtttcagccccgggtggagcttgagcaggcacacgtccgtgcaaagtgatgtattgaccgtaaaggcatcgtcttttggcatgtgcacttgtttgttgtattcaattccgttttcggtaataaacgcgatatacggatagttaatgctctcaaatgcatcatagcttttcgttcttaatttaatggcgcgtgtgccttgaatgactctgccgtcaaatacgacgtatacgccgcccaccccttcacatgcgaagcggatcgcgtccgtgatattttttttggcatcggttttttgaaatgtaatcgggatttgcgaacccgtaatgacgatcggtttatcagcatgctgaagcatataagacagtgccgctgatgtatacgccattgtgtctgtcccgtgcgtaatgacgaacccgtcatatgcgtcatatttttctttgacagcatttgcgatttcggcccagtattcaggctgcatatttgtgctgtcgatgttcattaacgaatgggtttccatcgtgtaatcgttatcaagttttgatacgtaggttaacaattcgtctgctttcaccccgggtgcaagcccgttttctccttcgactgaggcgattgttcctccggttgttaacagcaataattttttcataccctgcacctcttcatccatttctcaagatgtgttaagcattcgcttttcgcatacttttaatcaaattatagacagacgattgaaattaatcaagtgattattattcaattcgcgtacacttttgcatatcgatatgatataatttgctcaagtgaaaaggagcggttttgaatatgaatttagatcgtttaactgaactgagaaaaaagaaaaattggtctcttcaatatacggctgaccgtctcggcatcgccaaaagcacgtacgccgggtatgaatcaggataccggcgtccgtcattcgaggcgctgggcacgcttgccgatctgtttgacacgacgtgcgacgatttactggggcgcactgaaaaaaaggcggagccgtttacccagaccatcgaattaacaaacgccgcacaaggccgcggcacactgaccgttgacggacagccgctgaatcaggatgaaatcatcgaattgattgcgtttgtccgcacgaaaaagaaggtgcaggaggagctccgctaaaatccggcttttacggcttgattctgccgtacgtccctccgcccccggcctcaaggacgagctgcccggtgcgcgctttatgaatgacagccgctattttaggctggacgacacgcgccaattcctcttcttgcgcctgatgaagaatcgccatctccgtcccgaaagcccgcttcagtttgtctaacgttttcggcccgacccccggaatgaactgcagcgggatttgatgaatatacggcggccgcggcacgcggctttttttcggtccgctcagttcctccagccgttcactgaccccttttgtcattgttttccccccgcactccggacaggcggaagctcctttttccactgggccgccgcagcggtcgcaagccgtccggtaatacttcccgagcttcgggttcagcccgtaattcgccgtgatttttcttccgtccttcccttttaaagccagcgaaaattccgtgaaattcgcttctttaagaagcatttcattatattctctgccgatttttcctaaggaatgcgcatcagaatttgttaaaaatgtatacggatcaagttccgttacccgcgaagccatgtcggtgtcacagcttaacccgagttccgccgcgtcaatgagcgccgggtcgaaaacttctgtcaaagaagatatgaccccttttccgtacaggcttttatgcggggtgaacatatgggcgggaataaacagcccgcccaattcctttgttttcctttgaagattcaaaccggtttcataaatacgctgggaactgagatggatatttttaagcctttttgcgagccactcagaaaacatcttcatttcggcaagagacggcataaagacgagaacgtgaatcggcccgcggcatgtgtgatcatagatttcaagctcactgcccaacagaagcgtcgtattccgataccggatgccgccttctttcagctcacggtatctgccttcatcaattccgcgctcgatttcttctatgacttccggggaatggcagtcgatgatgcccaatagttcaattcccttcccctcactggcctcttctaaaatccgatgcagcgtcaacgttttggccccggtgattttgaccggttttcccgtataggtgcggccgatatgaatatgcagatccgcatagatggttttcatcatttttccttcagcgcttctttcagctggagatactgaatcgcgtacgccgtttttgcgtcatacaccctgcgggattcaatcagcttcacggcctcttcaagcgtgacctgcatgacttcgacaaattcatcctcatccagttcgcgcttttcttccagcggcgaaagcccttccgcaagaaagagatgcacgatttcatcagcaaacccgggtgatgtataaaaagcggtgattttcgtcaaggtttccgccgtatatcccgtttcttcctcgagctctcttaacgccgtatgttccggctcttcccccttttcaagcttaccggccggaatttcaacgattgtccgttccagcggctttctgaactggttcaccaaaatgatttttccttcctcggtcaccgcaagtacggccaccgctcccggatgtttgacgatttcccgcttgcttgtttttccgttcgggagctctacatcctctaagtaaagatctatgactttcccgtcatacagcttttttttcgcaagtgttttttcttctaaatgtttcatcatgtcatctcccgttctgtctctctattatgcctcatatattttatcatacatgcatgagagggaggtgcttttcgattgaaggtgtatcggaaggataaaagtatcgtattggtcggaaaggcgtgggaagtgcgggctaaactgaaagaatacggacggacattccgctatgtcggagattggatcaccgggccttaacagttgaaaacttcgcgcctttatattacggtcaataaaagactataaaaaggagcgaaacgatgagaaaacgcacactgggacattctgatttagaaataagcgaaatcgggctcggctgtatgtcgctgggcacagataaagctgaagcgctgtctattttggatgaagcgatcgagcttggaatcaattatttagataccgctgatctttatgatttcggcagaaatgaggaaattgtcggggaggccgtcaaaaaccgcaggcacgacatcattttagccacgaaagccggaaaccgctggaatgatgataaagacggctggcattgggatgcttccaaaggatacataaaagaagcggtcaaaaacagtctgcgccggctgaaaacggactatatcgacctttatcagctgcatggcggcacgatggaagatcatattgacaaaacgatcgaagcgtttgaggacttaaaacaggaaggcgtcatccggtattacggcatttcctcgattcgtccgaatgtcattaaagaatatgtgaaaaaatcaaatatcaccagcgttatgatgcaatacagcctgctggaccggcgtcccgaggagtggcttccccttttagaggagaacggaatcagcgttgtcgccagagggcctgtcgctaaagggcttcttacgaaaaaaccgcttgatcaagcagccgcaagcgtaaaagagaacggctatttaacatattcttttgcggaactggaagaaaccaaaaaagcgatcagcgctgccgcacctgacttgagcatgacggagctttcccttcaatacttactgtcacagccggccgtcgcttctgtcatcaccggagccagctcacttgagcagctgagagaaaactgttcggctgcagaggcccggcgtttaagcagccaggaaatcaaagccctgcaataccatacaaaacgggacgtatacgaagcccatcgttcttaaacaataaaaccggcaccttgtcagatgccggtttatttatatttgtgccaatcgagactgctttcattcagcagctcttcaaagcttttatttttttctttttcttttcgttttctgatttgttccgctttttgctgcgcctgttttttctcgtcttcttccttcagctcacttttcatttgcaaaagcctggccttcagatcttcccccagatcgtcttttaagctgtgtttttctttaggcagctgctttttcatcattacgccccccgtatctgaatatggtgaagcaagtgtaccacggagcgccggaggccggcaacgttcacggtcctgaaaagccggaggaaggatttttcatatgaaaggagggtgcctgtgtgaaaaaatggctggcggtgttcggttcggcttgcgcagtctttttggctgccggattcgcttttacgaatctgattatgtttatgaagaaaaagacggatgaagatatcatgaaaaaagaaacggccgacgggcatgatagatttgattcctttcaggccatggaaaaagaagaggccgtcatcctgtcacgccacgggtatgagatcaaaggcttttacgtcgccccgcatcatacggcaaacaccatgattatttgtcacggcgttaccgtaaattcgttcaattcattgaaatacatggatttatttttagatttaggctggaatgtgctcgtatatgaccaccgcgggcacggaaaaagcggcggcagaacgacgagctacggctattttgaaaaagatgatttggaagaagcggtgaattgggtgagacacaaaacgggagacggcggtcaaatcggcatccacggggaatcgatgggagcggtgacggccttattatacgcgggcgggcatcaggatgaaaacggcgctgatttttatattgcggactgtccgttcgcaagctttcgcgatcagctcgcctacaggctgaagcgggagttccggctgcctccgtggccgcttctgcctttggctgatttctttttgcggatgagagaaggataccgtatccgtgatgtatcgcctttatcggttatcagccgaatccggcagcccgtgctgtttattcacagtaaggaagatgattatatacctcccgcttcttccgaattgctgcaccgcagaaaacgcggcccgaagatgctctatctggccgaatcgggcgggcatgccatgtcgtacaccaaaaatccggagagctaccgcaaagccgttcaaacctttttagataccatgacgcaaacgtaaaaaagcgaaagaacgtatgctggttctttcgctttcccgtcataaaacgtcggtaatcccgtccatattttctccgatccagtcaatggcgaggtcgattgtcgtaaactcctgcgctttgaaggtcatctcatcctgaagcagccagacatccttctgaacggattcagcgcctccgatggaccagtgcagcagactgtacgggtggttgttgttcagaaaggatacccacgttttatgctgtgccgtctgtttaatggctttcagcttttgattcactttccgtttctccctgctttactaatatgctcattctcgggctcagcatctctgccgggctttttaagacgagcgtttttgccttttcattgtaatcgattgtcatttcctcgtcaaaaaacactttttgtgaggtctggatgtaaagcggaagtccgttggtttcaatggcctcgcattgtcccgttaattcgtccgccagccagatggtcggcacgccgctcaccgcgcacccgcagccttctgcgtcatagcggagctgcgctttttttcccgggttggcgtccatcgcctgctgaagtgtgtgtttcgccgcatccgtcacatgtatttgcatagatgatcctccgtttttcattttcgccattgtagcataccggagccgctgtatgcattgtttctgctttctttacagcagcctgctctcccagtcctttgcctcttgttcagccgccttgatccagtcatttttcccttcactatacttttccatatcgtatgggtatgcctttgcgagccgccgtttcagttccatgtattgaaccgctttttcaggctttgcagtgaggtaatcccggaacagcagatgacgcttcacatccggatggcctgtttcgtatatgtggatgtggtgtgtgcgcttgctgccgcctttttgaaagaaacgccggccctctatcccgttttctcctttcgcctcatagccgagtgcttccagctgcggactgaatcggtcagcgtccgaaatatctttaacctccgccagtatatcaatgacgggttttgcggccattcccgggatggaggtgctgccgatatggctgacagaatgaagagcggggccgaagattcggatcaagtccgccttctctctttcaaacatctctttccattccggcttgtacggaacaacttccgctttcctcttcggataaagatgaaaaaacgagagggtcagcccttccggcgtctctgtctgtccggcttctgtgaacccggtttttaaatagagagagactgccggaacgttttgactggcggtagccgcctctattttttgggcgtcccggttttgatctatcacaaattgaataagtgcccgtccgattcctttccgaaaggcggacgggtgcaccgtcagcctgcatatgacaaggtcatacccctttttttcatacgaaatgacgcctgcaagccgatctttttccttgaaaccggcaaacgtctcccgtgacctctgtatgtcaccgggtgtttcatgcagggctggaatgccgaaaaagccgatcagctcggcttctttttgataagagcaacgttgaaccgccgcaatttcccgcgccgtctgttcttgtgtatgccgtaaaaatgtaatcaatcttccgccccttttgacgcaaacattcgctgtgactccgtcttcgtaatgcggaccgcgtacgcttcataccaggcgctttttcctttttgttttgccgcccggtggtcagtatggtctttccaccttttaatcgcctccaggctgtcccagtaggaaaccgtgatgccgcagccgttttcctcccgaacgctttccgcgcctaaaaagcccggctgtccgcctgccaaattcatcatgcgctctgccgtatgctcatattcctcatcatattttccctttattgatgaaaaaatgaccgcataatagggcggtttgggcgtgtcagctaaaaaacccatattcatccccctctacatatatttcacaaacagaatccggtcttctcccggaccgtcataattcgcaaaaacagggattccgtttacggttttggttcctttttcaacttcaaagcctaattttgtatgataagcgattgatactttattgacaggcgccgtcacgcaattgacttttgtgcagcccctttttttcaccgtctccataaatcgatcgtagagctgttttccaatttgcatttttctgaaatccggatgcacaccggaaaaatgaatgtaggctgtctcagggtctgattgtgactgaaaaccgattaaaaaaccggtcattccctccggcccgtacgtgataaagcttgtgtcctgaaaatgttcaaaaaacaagcgcggcagtttgtctttcatctgcctgccgccccaccattcattcaaaacagacgtaaccatttcatagtcttcagaggtaattgttcgaatatccattatcgattgactctccttttcgtccggcaaaatgaatgtcagctcttctcattggaatataaaaaattatatgtgggttgtttgcaattgtaaatgatttcttttcaagcaaacgaatcagcacgtcttccagccggggaatgatttaccagtataaacgtgatcattgttcgggtacaatgaaaaaaagaacaaatgttcccggaggtttttttatggctgatattcttcttgttgatatgcaatcgttttatgcgtctgtagaaaaagcggaagcgcctcatctcaaaagccggcccgtgattgtctcgggagatcccgaaagacgcagcggcgtcgtgcttgcggcttgtccgctcgccaaacgatacggcgtaaaaaatgccgaacggctgtgggaagcgcaggccaaatgtcccgacgccgttattgtccgtccgcggatgcagcggtatattgatgtatccgtcatgattaccgaactgtttgaacgatataccgatcttgtagaaccctactccatcgatgagcagtttctcgacgtgaccggaagcaggcggctgttcggtgatccttttacaattgccgaaagcattcagcaagcgattttgcgtgaattcggaatttatgcccgtgtcggcatcggaccgaataaggcgctcgcgaaaatggcttgcgaccattttgccaaaaaaaacgcatccggcatctacagattggatatgtcaaatatcagggaggatctgtggccgctgccggtcggaaaattattcggcatcggaaaacggatggagcatcatttaagacggatgggcatcagcacaatcggcgggcttgccgggcaccccgccgaactgctgaaaaaacgctggggcattaacggcgaattgcttcagcggacagcccgcggcatcgatccctctccggtcaccgtcaacacgcacagccggcaaaaagcgatcggccataacatgaccctcccgagagactacagccgctttgaggatatcaaagtcgtgctgctggagttaagcgaagaagtggcccgccgcgcccgtttcaaacaatacatcggccatacggtttcggtcagcatcagaggcgctgattttgaattcccttcaggttttcacagacagagaaagctggtctctccgactaatttcggaatggatatttttaaagcggcggtcaagctcttcaaagagcattggaacggtgagcccgtccgcagcgccggcgtctccctttcccagctggagccctgtgattatgttcagctgagcctgtttgatgctcaggaaaaaaagatcagtctcggcaaagtattggatgatattcatgagcggtacggtcctgcgtcgctcctccatgccgcttcactgacagaggccggccaagcctttcaccgggctgaaaaaatcggcgggcattacaaataattgaggtgatatacatgaatccgaacaaattaacacccgggtataatgtcatgtgggaatcaagccggatgatgctgcccgaacatcgggagcagctgcttgcaaaaaaacgaaaagaacgggaattccggcctccggaactgagcgaagagcaactgaacgacatgaaccgcatcattgcggcgtcgattgaagaagacagagccatctcggtcacctatgcttcagcacacggcccccgccgcttttggggatgggtaaaacaagtgaggcatgacgaaaaacgtttaaaaatcataaacgatgaagatgcgttaacgctgccgtttcatcttattctctcggctgaactggaataagagcctaaatcgtcctgacagaaaatatgatagaagagtgggaggatcacatgatatttagtagaataaagatgaatgacaagaataggagaatatatgatggatcaatttatagaaaaaatgctgggacaagccctccgccagtatggacggaatgtgtcgacagatccgctgagcccctatgaaaaacagagtttaaaaaaagctttagaagaaagaaggaatgaagaacccgatgaggatctccatgcccatgtagaagatattatctacgattacgtcaccaatcaggggcagttttcctgacacggacgtttatgcactgggcgataagggaaacgtccgagagtaaacccttaaagattgcgtggtgcaggatatgcctgtcgggccttatttcaagatcggttatgccgttcttctgttatttctcatcatttatctcggaacattaatagactttttgttccagcctgttgtgattacggttaaaaccttgtttccgcccattgtattatcgggcgtcctttactatttgtgccgcccgctcgtcagagtgctgcatgcgaaattaaagctgcccgaaggaatcgcgattttagcgatttatgcgggaacagccggccttcttgtcctcttcctttatacggcgggccctgccgttcaaaaacagtttacagccttcacagaacatattccggagctttccgcaaaagctgaaaattggatcgggcatcttcaggacagcaaatggttttcccggcttcagcatggggattcctttaaaaaattagcggacaaagccgcaaattattccggttcaatcactgattctctcagcagcctggccggtacggctgccaatgccgccatcaccgcagccattattccgtttgcgctgtattacatgttaaaagaaggaaataaagcccccggcgactgctgcggcttcttccggaaaaacatcaaaaagaaggaaaacaaatccttcgggacatggatgaagctctcagttcatacatacaaggacagctgctcgtcagtttctgtgtcggcgttctcgtcacaatcggctattttatcatcgggctcgattatccgctcgttctgggcgcgttcgccatggtgacaaatctgattccgtttatcgggccttggatcggcacatttcccggagtcattgtcggattgttcgattcaccgaccgaggcggtgctggtgattacggtcgtcgtcattgtccagcagcttgaaagccagctgatttccccgcaaattatgggacggaagctggacattcacccgctgaccattatttttcttctgcttgccgccggcaaattctcaggaattgccgggatgctgctggccattccgggatatgcggccgcaaaagtggtcataagccatatgcagaaactattcattctcagaaaaaaacaaagctaggagagaaatgattcatcccccatgtcttcacatcggttaaaatgaaaaaacggcgggctgaagaagcccgccgcacacggaggtaaaaaagatgaacatcggtgatgtcatttttcaattgatctcatttattgcagccgcatttttcctgtttgccgtgatatacgtattcagaagcttgaagcagcgccgcatacaattggacagaatcgaaaagaaactcgacgcgctgcgcgaagaaaaaaacgagaagttatagttcattcagaggcaggcgcagccagctccacctttatccgatccgggtcctccgtgtatacggcgtaatgcgtgcttccgcctgcatatggatggcggtccctgtaaagcacggggcatcctctggcaagcagcttttccgtcatctcgtcaacctgctctcttgatgcagcatgaaaagccagatggttcagcccgacccggcatctgtggtactccggtgttaaaaaacgctcctctgtctgtacaagcacaacataaaatcctgcgtttttccagctgatgccggagtcccaattttgaaactccctataaccgagctcacctaaaaaccatccccaaaaccgggcggaggctttcaagtcagatacatacaattcaatatgatgcatcataatattcgcttcctcctcatatcacacccgccttaccagcacctcttcaactttatggccgtcaccttttctcaaaatcaaatccgatctgaattttgtcggcaggatattttcatacagattcggacggttgacgctctcccaaatggaggcggccatggtatccgcttctgcatcagacaaatccttaaatttatgaaaataagaagccggatcctgaaaagcggtttctcttaagaggcggaaacgctccaaataccacgtgaaaatccggctttcttcggcatccacatagatcgaaaaatcaaagaaatccgatacaaaaatccgcggatcttccctgtcgtcctctaaggtcggcgactgcaggacattgattccttcgataataacgatatccgcaccttcgacaacctcgacggcgccctcttccctgtcataggtaagatgggagtataccggcgcctccactctctctttccctgactttatatcgttcagaaactcaagcagcgctttcacgtcgtaactttccgggaatccctttctggacagaaggtttttcctttttaattccgccgtcggatacaagaaaccgtcggttgtcaccaggctcaccttcggcctgtccggcagacgggaaagaagcttttgcaaaattctcgccgtcgtgcttttgccgacggcgacgctgcccgcgattccgatgataaacgggattttcgctgaatgcggatgtttcagaaacacgttgacatgctgattccgtcttgcggcagacgtgacatgaagatggagcaggcgcacaagcggaatgtaaatcgtttctacttcttccaccgataggtagtcattcagcccctctacggccttggcttcttcctctgaaacggcaatggaaagatggccgccgaatccggcccacgactcgcggctgtgctgcgtatacaatgtatgtaagttcaattctttacttttcacaattcacaccaatctctctgtatggctttccgattaaaaaacaaacgcttacaaagattgtaacggaaaaccgcctcactgtctgcccatttttttcacaaatgaggaaccgatccggctgtactcttccatttcctccttgggaaccatgcttccgccggtgctccacacaaggtgcacggcatttttcatctcaagcccccgctcttttatataacggttaccggcttcggtctgaacgaacttgacggctccggccataccggcgagtgcagagggttcaaggctcttattctcggccgctcttaattgataaagcagcgaaaaaagcgtgccgtcatcagcggtataacagccgctgagtataggctccatcagagggccggccagtccggacggccttcctaccgcaagtccgtcggcggctgtttgattatcaaggccgatatcctgcacgctgattccgtcatgcaagccggaaaacagtcctaacagcatacacggtgaatgcgtcggctcaccgaaaaaaatatggacatgcccgccatagatcagctttagcgcaagcgcgacgccgcccgggcctcctccgaccccgcacggcaaataaacgaaaagcggttcatctgcaccaggctttatgttcatttgatcgagctgctttttcacacggcttcccgcaacggcataccccaaaaacagatcccgggaatgctcatcatcaataaaataacaataagggtcctgcttcgcctgcatgcgcccctctttgacagccagactgtagtctgcttcatattcgatgacgcgaacccccttttcccggagcagctcctttttccactgctttgcgtcactggacatatgaacggtcacacaaaagccgagcttcgcgccgattatgccgatactcagacctaaattgcccgtagaaccgacggctatagagtattttgagaaaaaagcggtaaaccgttcctcagtcaatatgctgtaatcatcgtctgttgagagcattcccgcttttaccgcgaggtcttcggcatgcttcagcacttcgtaaatcccgccgcgcgctttaatggaaccggaaatcggaagttcgtcgtcgcatttcaaaagcagacgcccggggaaagcctgagcagcgctttgttccagacgctttttcatttcattgatgaagacaagcggagactcaatgaggcctcccgccgcttccgtctccggaaaagccgacgcgatataaggcgcaaaccggcgcagcctttcttccgcttcggcaatctcctttttccattcagcgccattctttactggatcatcggttttatgcgggttgatccaaaatacttcacgcgcctccgccatttgcctgactaaaggctctgccatcaatgccttgtgtatatcccggtcggacattcctttctcccccttgttactttttctttaatgcgcggccggccagtttttctgtaaacgaagggaaaagctgatacagcttcgtcccgaggctcatccatcgcggaagattcatttcccgtttatccgtcagaattacggatgtaatacgctctgccacatggtcggcatcaagcatccatctgccgacgcttttcacataaccgccctctttatctgcaattgtaaagaagtctgttttgatcggaccgggattaaccgttgtcacagctacacccgtaccggccagttcaagccgcagcgcattggaataccctaaaacggcgtgtttcgttgcggaataaaggcttgatttcggcgtcgccaatttgccggcctgtgaggcgatattgataatatggccgcttttcgcatgaagcatcaccggaagacaggccttcgtacaggcgattaatccgaagacgttgacttcaaacattgccttcatatcatccaaagatgaatcagcggccgtttcaaaaatgccgaagccggcgttgttgattaatacgtcaacatgaccgatcaaacgccttacgttttcagcctcttctgcatgccggacgtcaaacggaatgacatcacactgtccgccgcgcgcggtaatcgtttttttcacttcctgcaagcggtcctcccgcctggcggataaaaaaacatgagccccttctgccgcgcaggaatatgcaagccgttctccgagtccgccggatgctccggtgatccaaatccgcttatccgttaatctgcccatttccttcaccccttcacagctttaaacatcagagtgcttcccgactgaaaggattcggccttcccttttgcagccagtacgtcaagatggccgatcgtttctgacatcgttaaaaataattcattttcgtacacagccggaaacagccgccggcatacctggaaagccgtcagcgtttcctctgacaacaggcgcagcacatattccgaccgatttctctgtttttcaagccgcctgtcaaaagcaggctttacgtctgtcagcagatcgccgtgtcccggatataaaaaggacgggtttacgtcatacagccgcttcattgagttcaagtagtcgagcatcggggccgcgcgcacgccccccttttccggagcttccagaatcggattggtggagctgttggacaaaagcagatcgccgctgaacatttcaccgcttttttcatggtagagcgcaatgtgagaagcggcatgacccgggatttcgagcaccgtccagccgttaagcccgtcgattttcccgccttcttccactgttttcgttaacggacggtttgctgaaaataagtatgacagcttaactgttttatgtatgtcttcaggcgtcaggggaacgcccatttcagtcataagcgacagaaaaaagtcctcctgccgggcgatatacgactgatcctgagtaatgtacctgtcattcagcggatgcccgatcacttccgtatcctcggaaaaaaggtgcagcagacctgaatgatctgcgtgatgatgagtgagcaccacctgttctatatccgccgcagaaacgccgtgttccttaagctgaaatgagagcgattcagccgcttcctttgtattcggtccgcaatcaataagggttaaggcttcatcttttattaaataaacgataacgtcgccgactgcaaacggagtcggcacacgtatcggaatgatctttctcgctgccatgtttacgctccttcgttcttttcattcctgaataatcatattttagcgttttcttttcactgtgtcattattgccgcatatcggaaaaaaagattgacatcccgctctttcgcatagcataatgaacaacaaactagaaaacacggaacgcgatgacgaggaactagtatataaacaacggcagcagagagcaatgtccccggctgaaagacattgcggccctcttgtttacagaacctgccctcagagcggttaggaaaacctaaacgtatcccctcgttacgggatttgagctgagcacggctgattcgtgctaatgtaaggtggtaccgcgaaaccttttcgtcctttttgacgggaaggtttttttgtgttttagaagaaggaggatttatatgaagaaaatcggttttatcggggccggatcaatggcggaagcaatggtgaacggactgctgcaaagcggaatgacagcccccggacatatatatatgacaaaccggtcaaatgacagccggcttgaagagctccaaaaaacgtacggagtgaaaccgtgccgggataaagaagagtttttcagcaataccgacattattgttctcgcctttaaaccgaaagatgcggcagaaagcattgagaacattcgcgaatacgtgaaagatcagcttgtgatttctgtcatcgcggggctgacgattcacacgattcagcaatatttcggcagaaagctcaccatcatccgggcgatgccgaatacatccgcggccattcagcaatcggcgaccggtttttccgcaagctccgaggcgagtgaagctgaaatccggacggcaaaagagcttctggaaacaatcggagaagcgacgctctttgaagaaaaacaccttgatgccgtcacagccattgccggaagcggtcccgcctatgtgtaccggtatgtcgaagcgatggaaaaggccgcccttcaagccggcctgccggaagaaacggcaaaagagctgattttacaaaccatggccggggcgacggaaatgctcagaacaagcagcaaacggcctgaacgcctgcgcaaggaaatcacaagccccggcggcacgactgaagcaggccttcgcgcattagacgagcgccgctttgaagaagccatcatgcactgcatcgcagaaaccgcagcccggagcgccgaaattaaagaacaattcgcaggctccgttctgcaaaagacagaccagtcataaagcatggggcatcccatgcttttttcattctgtttaactgccgtataaacggctgattctctcttttacttcaggaagatggaatgtggcttcgtgcatgtttacctcttcctcaaccgcttttgccagctctcttttgatccgtgcggtcacattggttttcagcgcaaccagtgaggctctcggtttatccgccagcagccgggccaattcgcggcctctttgaaggacgtcttttttcggcagcacttcaaacggaacaccccgtttttccagagcggcgccgctgaagttcgcggccgtaaacagcatttcttccccgaggacaattcccagtttttcaggcacaatatacgtcgcgcccattcccggtgtaaatccgtacttcatataattacaagaataaaaactctctctgcttaaaatcacgaaatccgagctcagaccgatcgtaaagccggctccgatcgcatgcccctgcatgacggaaatcacagggatcctgcaatccaataaaagactgtgaagctttaaatctgtaaattgaagctttccgctctgaatggtcaaaagcccctcctgcgttcctcccgtgcagaaataatttccgtaacccgtcagaagaacggttttataggacggatgggcattgatgtcttggaatacccggtgcagctctcttacaaactcttctgacagcccgtttttcccggccgtatcctgcattgtgacctgcacaatgcccggttctgtttcctgtacatcaatcattggattcatgtttattctccgtttctttaaaaatactcaagtctttccggctcttatactaggtcgtccattcatactttctgtgaaactcttttatttcagtcagcactaatcgcgtttttccttgatgcgcattcgggatgtctgctgcgggcgcggcatttcttgtgccgaattttacgatgccgctgtcttggagcagccggtcataatcagccatcgataaacggacgcgttcatccaaatgccggctgatctgaaattgattctgccgggcacggctttgcggcataacgacaccgctgtaaaattcagagcagcagcccgaaccgtatgaaaaacagccgacgcgtttcggcgtttcaaaagagccgttatcaatcgtgctggcaagagataaaaatacggtggcccccatgatgttgccgacgcgctgacagtattgaatcccaggcagcacgcgttgctgaaaatccgcttcaatgtcctgcggcttagcctttgccaattttctcatcatcgtccgatgcgctccttttaccattccgccaaacggagtatgaaaagaaaggtattgaaatgtattcttataatccgccccgctcacacgctttcggtattcctgaaatgaatgttcacagcaatccaaataagacatgagcgacagatcagcatcccccgcttcactatccggaatcgggcggcaggtatccatgacttcatacccgtaatacccgcttgcgccttgatcaagcaaaaagacatgaggggtgctgctgactaaaagcgcgacagctcccgcccccgcactcggttcggcataggaccattcctccgtcaacgcatcaccgccttcagccactaaaaagcgggaaatatccgttccgatgatgagcgctttcgctcccggcgatgtttgcgacaagatgaaattcacgcccatttggaacccggccgttaaggaatagcaagcctgtttcacttcaaataaccggcaattccgcttcagctgcaaataatcatggacatatgtactgatggatttgccaaaatcaatcccggattccgtacaggtgatcaccatttcaatctgattccgttcttcttctgacagagaatcgataatcggttttgcggcatttacggcgaacgtaatcggatcttcaaacggaagcgccaccactttttctttcatcagcaggttctcaaacctttttttatccaggttccgatgttccgcaagctccatgacgtctacatacgcggttccgccaaacacgttcattgcttcgattcctacattcatttctccaagcccccagagtaaagaggcttcccgtgaagcctcttttattttttcgttcaaaactcaacaagcagccggtcaacgccgtgaaatacagggctcggaaccagattcggctcttgatcctcagtaaaacgccatgcgggcatctgttcaaaaaagtgggaaagcgcgattttcgcttcaagccgggccagcggcgctcctaagcaataatggctgccctgaccgaatgacagatgctgattcggctttcgtcccaagtcaatctgatcggcattttcaaacttcttttcatctctgttcgccgatccaatccacgcatatactttttctccggccggaatcgtttttccgccaatctcgctctcaaccgcggtgtagcgggttacccgctgaatggaaggtctgaggcggatgacttcctcaataaagtcaggaaggagcgccttattttcaagcagccggggcagaatatgcggaaactccttgagactgagaaatgaatttccgatcacattttccgtcgttacgtgccccgcgacgatcaacaagccgcaaaaaccgattaattgcttgtctgacagcggctctccgtctaaatcagctgcaattaaatggctgattaaatcattttgcggctgttttctccgctgtaaaataaactgcatgaagtatccgatcatctgcttttgcacttcattcattttcttttcatcttttacattctggctttggtcgacccagcttttaaagatatccctgtctttcggaggaaatcctaaaagctctgcgatcacgataatcggaagcggaaatgcgtaatcttcgataatgtccatcctgccttttgaacggacggcctgaagcaggtcatcagcgatagcggctatacgcggtgcaagagactcaaccgatttcggcatgaaaggctgattgaccaattttctgaagacggtgtgttcaggcgggtccattttcaaaaggctgtctttgttaatatgccggatcattttttcctgcttgtccgcacttaagtatttatgatcggaagaaaaatgactgtagtcagaaatcacccgcttcacttcatcataggtgaagatttcccagcaatcttccttttcattgtaatgaacgggagaggtttctctcatcgtttggtaccatttgtacggctgctgctgtctgatttttgttaaactggtcattttcattcctccaagatgtgttcaagatttgaaatgacccgccaaagcttacgagtaaacccggcgggcggatatgtgaatttacggtcttgttttggcgggctgcttcagcatctcaccatgcacattcagtatcttttcctgcagctgcagaaagctgtgttctgtcattccgtctgccgaatataaaacgccgcaaaattcagaaatcgtttcggctgcgctgtcttcagccaataacgtcatatggttggataccgccacatccatgatggcgatgtttgtcatatgctcttgccactggctccagtagttgacgaaatcagcggataaaatatcggccctgatcgtaaaatacggatcaagctcacccaagaaaataccgtttttatttcggaaataatagcatgtcaccccgttcggatccggaagcggcaggagttcgtaatcagtgatttcgtaagcgtcctgaacgtttatattctgcctgatcagatttttcaccaacgcgtccgtcttcgttaacccccgctgtttggcttttgctattaattgctctaaaaatatgtcttcatgaagatcggcatctagttcatcacggtgaatcaaggtttcagaaatgcgttccggatgttgatagattggtgcaaataaagccatgttcaccgtctgcagcatcatatttttatcaaataattcatcaggaatgtttatttcccgcgcacccgccgagtcaaaggagtcgagcatgacgattgactcaacggtttctccagccagctgcaattgccgggtgacttcataagcgagcatgccccctaatgaatagccgcctacatcgtaaggaccccggggctgcacggtacgtatgagcttaacgtaatattccgccatgtttttaatgccgcggatcggttcccggtctgtcatccatcctcttgcctgaattccgtaaaaaggacgcccagtccgttcggcaacaggctggtacagctccactgcccccagcgcggaatgaaaccagaaaatcggtcttccctttcccccgggttaagacagatcagttcgggcggttcttgatcatctgtctcttctgatatatcgttttgtttcgtatgttcctcatgtacttcctcagtgtctttttggacagaaccggtcagatacccggctaattttgcgattgtcggatattcatagaccagatttgccgtaatagacgcttgatacgttttattaatggactgaacccattccacaccgataatagaatccagccccatgtcaatgaatgcctcatgctcatcaatatcttccggcttcagaaacaggatgtccgcaaggctttctttgagctctttgcgcaaagtgccgtcagagatgccggcaaggggagtttctgcttccgggatttgcggacgtaccgctgtttcctccgcttcagcatactcgggtttcgttatttgccccgctatatattccgcaagctcctcaagcgtcgggtgttcatacaccttattggcagtaatctcagtgtggtacgttttatttactgtttgtatccattcaaccccgataatggagtcaagccccatgtcgatgaaaggctcatcagcatcaatatcttccggtgacaaaaataaaatatctgccaggcttatcctcaattcttcaagcaatgttctattgtcttcggaaactgcgttttccggctgatggacagaaacagtacaatccaaaggctgtaacacgatcggtttttgcaatgtctccgattcaaacgctgtcatttcgatctcagttaaaggactcagagaaatcagaccttcatgttcaggctgcggcgaagacgggggaacggtttgcgtttcagactttttcatggcttggcctggtaaagaactgtttacatcagccgcccaatacctttcttttaaaaacgggtaggcaggcagcggcgttttataatattgccctgcgtcaaaaagccgtgtgaaaggaagatcatatcctctgcaaaaaaggtcagcgatatgtgccaggctttctctgtactgcgcgggcgaagccgccgagcggcactgttcaatgcattccattccgaatgttttcattccggcttcgtctgccggcttctgatccttcaaattggacacaaacacacccggaagctctctttttacaagccactccgataatacccgcttcagttcgtccgcactgcttacgatacaggcaaaccggtgatgcagatgctttctgccgagcaggagcgtataacttatatttcccagatcgctgtctttgttcttgctgagtgaatccagcaggcgttctgcctgaatttccagctgacgctccgtccgcgcagataaaggaatgaggcaggccggttttgccggtgaccggcgcacggtttgcggcgcctcttcaatcacaagatgggcatttgttccgctgaatccgaatgaactgatggcggctctgcgcggtgcatccgaattccgttcccacggtatcagcttttcattcacaaaaaacgggctgtccgcaaattgaatatgctgattggcttgatgaaaatgcagggaagccggaatctgccgatgcttcagcgacagcaggattttaaacagtccggccatccccgcggccgcagcggcatgtccgagattggttttcacagagccgatggcgcaatatccttttttatccgtataacggcggaaagcgcgcgttaaggcgctgaattcgatcgggtcgcccagtgcagtgcccgttccgtgagcttccaccatttgaatggtttccggattaatgtgaaaagtatcatagacatgccgttccaatcgttcttgagaaagcgcgcttggagcggttattccgtttgtagcgccgtcctgattcattgcagagccttttatgacgccgtacacatgatctccgtcactgacggcgtcgctaagacgtttcagcaccacggctcccacgccttcacccggcacgaagccgtccgcgctttgatcaaacgtatggcagcgcccggtcggcgacagcatattcgccttatttgacgactgataaaaagcgggagtggattgaatgaaaaccccgcccgccaccgccatttccgtttctttcgtccagagcccctgacatgccaaatgaatggctgtcagcgaactggaacatgctgtatcaacagtgatcgccggaccttgtaaattaaggtgataggcgatccttgccggagtgacggaattatgattgccccaaaaagcctgcgcgggcccctgctgtttaaaaatagcctggtaatctccgccgcaggagccggcatacacgccgcattcccggcctcttaccgagtctcccgcatatcccgcatcttcaagcgctttccatgattcttccaaaaacagcctctgctgcgggtccatataggtcgcttcacgtcctgatatatgaaagaaaacggggtcaaaacattcaatgccctctataaaactgccatactggcattggctgtcagagacatcccatctgtctgcttttttaatcagatcccgtccggcggctaagttttcccaaaactcatggacattctccgattcagcaaaccgcccgctcatcccgataatcgcgatcggttctttttcaggtaacacagctgctgattttaccgtttcggccggatccttttgttcggggcggtacgtcatttgatacggctcagaaacgctgatgacgattttcccgatatttccgcggtcatccagacagtgatacgcttcttttatgtcttcaaaggaaaagatttttgagatgacaggctgaatgactccctcttccgccagccgctgcagttccaattgatagtccttgacctgatccggattttgaagagacagcttccgcaaatccacgctgtgaaacgattgattgttatgaaggacggacaagtcgactgatttagcggatttcagcgcagtcatggcaatttcgatatatcttccgcccggcgccaggcaattcattcctttttgcatggcatcaccggccagggtattaatgacaacatccaccccacggccgccggtcattcgcatgatttccgtttcaaaatcttcttccaaatagcaaatggtattgtggatcccgagcgaatgcagatactcaatttttttctgtgatccggccgttgcatatatttccgcgccgatatgccgggccatttgcaccgcgatcagccccgttcctcccgtcgcggtctgaattaatattttttcgccttttttaagtccggctttccggaaggcgtctatcattgtcaccgccacggtaggaagagcgcatgcttcttcaaaggtcagccgggccggtttatgatagacttgatgttctttacatgtgatgagattcgcctgagagccaaaatcctctcccatgccgacaatcacttcatcacccggaatgacggatgttacatgcctccccgtcttgatcacgacgccgcttgcttcgaatcccggagtgaacggataaggcggcattgtcggatacagccctctgacacaaagcaagtctccgaagtttaaagaaaaggcgcggacggctatttgaacttcgtcatcttttgtctcgggcacttcactgcgggcaatcgtcagatcttcaatgccgcccggacggtcaatcacaacccggaatattcccgagtcatcggactttgcgaaagaagacggcatacgttcttgtttcggtttctgataaccgttttcctttctttccgtctgcaaaggtttttcagcaggccgttcttcctgaagcgccgggcggattttcgctctttcggtctccagagatgaggctatgatggtttcgtattcttccgagatataaccggtcagcagtttcacatgatagtaatcaaataaaatcgttgtctgcagtgtaagattcaatcgcttattaatctcgttaatcacattgacggccaaaatggaatcaatgccgtattcagagaaattcagttcttcctgaatatcctcttctttcatttttaatacatcggcaatacttgttttgatgacagagcggacatgggaagcgaccgattccccatcagccttaacagcttgatgctcctctggcgcgcggctgcgggaaacaggctgtgcgggctttcggaaaacttcggccggcgcggcgtatggctttctgccgtctctgattccttggatccggacgagtccgtcactctcagctgcgataatctgctgacctaaatcatgagccgtttcagcagggaaacaaaccgatctgtatccttccgaatgcagcacacgctcccacgattttggatataagccgggacttcccggaatccgaagctcagcatcctcataggaccaccagccgtcaagcagcccgaaggttaaatgggtaaaaacagaacgatcgctgatttcatttatcagaatcattccgttgtatttcaggagcgctttcagacggcgcagtgtcaaaccgatattttttgtggcgtgaagcacattggcggcgatgacaatatcgtaaacacccgttttgatattttgtgattcgcaaggctcctccgcattaaacaaggctgttgtcaaatacggcacatcaggtccgtattcctgttcggcatgcattaaaaaagctttagaaacatccgtataacaatattccgcaatctgttttgcgaatggtttcagttttgtaaacagcatggcgctcgttccgcccgtcccggcccctacttctatcagcctgatacgggcatcgggatgttctgtaagataggctttcaggtaagcggccgcggaatctgctaacacttcattaaaataatccgcaacgggattatgcttataaacaccttcaacgagccgcattgatgaatcgggaaatacgatatccgtagccggacgttctccttttaaaattgaaggcatcgcttttatcgtcgcctcggccaattcagcttgcgcaagctcccccttgggaagcaggcgtttatgggcattccactcattccagactgtgcggccgtccgggcgctgatccgcgagaagagtgatcgtgtatccgtcatacgcgatatatccgttttcttttaatagattcaggctttcttccagccatctgccgtatgtgccgatcacgccggcgctccccatggatgctgcaggtgtggtgacaggctcgctgaaaaacccgattgactgtaattggtaaaagagcagtttgcaaagaaggctgttcatatgcgcaactccatttctcgttttaaagtctcaagccgttcattccgatccggattttgccgcttgacgctttccataaatgaaggctccgggccggatacaaccgatattgcatcttgatccgtcagtgcggctaagccgtgcggagcagctttgatgaatgccgcttggctgaacggttctgatagtaagacttccagcgcctccattgcttcatcgggttcaatagaaccgatccctgacgcctccatccgttttctgtaagacgggtctgatacaacgcccagactgccccaatatccccaattcatgactttcacttcacaatcaagcaaggaagcgatatggcgggcaaaggcgtcttgaaatgtacaccctgccgcatagttgctttgcccggcattttttgtgaaagaattaacggatgagaaaaacagcacaaaatcaagcggctctcccttaaaagcttcgatcattcggacgctcgtattcaccttagctgaaaaagcgtttctgaaagaagcttcatccatattcgccatacttttgtcggcaagcgttatcgcggaatggatgactcccgttatattgccgtattgctcttttacggaacggacggccgctttaagcgctgcggcatcttgagcatcagcctgtatataatgcggcgcggggcctgatagcgccagcctgtctattttgctctgaatctcctgatccttcggccgcctgccgatccatatcatccgtgccttgtaacgggtgatcatgtatttgctccatgcttctccgatgccgcccgctccgccgatgacagcataaacgccgccttctctgtacgacatacgcggagcggaacttgtcagcacccggactgttttttgcttatgccaagctccgttacggtacgcggcagcatttccgtccggatctggaggaaggcgccagatgtttttcatctcagacgaatcactgccttcttctgcatcaatcagcctgatgtcccagttcggatattcttttgccaatgagccgatcaaaccgtgtacgcctgcatgctcaggctgcggcagatcacccggatacacggactgtgtctgccgggtgaccgctgtaaagctgatgtttcggtttccatacccgagtgacagcagcgctttgatgaaacggaaacattgaatcaccccattctcctgctcatcaagcatttcctgactgacggatgcgggtgcgaaacgatccggcgcaatccataagaaatggcggatatcttgatacccggctgtcaattcacgtaatgtttgctcgcttgaatgatccggcgtctccgccagatgggcgcggggccacatttttgccgcggcctttatggtatttcccggctttccgatgatcagcaattgttcctgatcaaccgctcgattttcttccagggaaaagaaagttttgtcccaaacaggggctagcatcgccgtctgaacttcctgccgtttgctttcggtttggtttgtctgccggacagcccggcaggagaaccctgtcaatctcatacaaacagcgccgttttcatcacataaatcaatatccagcgtcagcgctccgttatctgaccgatcgctctgtttgcggacaagcgcccacatcgttttctgagtcggctgaaatatttctgcctgccgcagggaaaacggcagcatcggagtgtctccggcagtatctgaaccggcccccagtgacgcctgaaacgcggcatccagaaggctcggatggatgacaaactgatcggcggtactgtctgccgtttccggcagcgacagccgggctgcagcccccctctctccggtcatcagctgatcaatgccttgatggctcggcccgtagatcatacccgcatgccggaaaacctgataaacctcatcagacgtcataaccgattggctgcagccggacagccagccctctaaatgaacagacggagccgctgctatctctcccgataccgcggtgcctttactgtataaaatccgttctccccaggttcttccgatagactgtaaatcgtaaattcaatgtcttcattttccttaagaataaggctgatatggacttctacatccgtccctttatgaatgacaggcctcatccatatgatatctttcaaatacattcctttacgtccgtccggcacagcgtatgcggcacgctcaacggccgctctggccatttcgatcacggcggctcccgggagcaccttctgtccattgactgagtgatcagtgaaaaagaattcccgtccggtaaaaacagaggtgaatttcagctcccaaagatcggatgtgttttcatggagcagcggatggatcaccgttttgccgtcatccctttttgaaaccgcctcggcttcatcttgaatccagcatctgacttttgcaaacggataggcgggaagactgattctccggggtttttgtcccgaatataacaagttccagtccacatcgactccctgcacccacattttcagcaaatgaccgtactttctctttttcagccatttaaccatggcttcctgcagatcttcatcagattcaaacacagccactgtctcatgatttcgcttcgcccgtcccctgtaaagatgcggtgcgttttcattttccaagtacgatctgagcttgtcctccagctccttaagggagcccgcaataagagccagccgctcatccatcgcttcccgccccgcttgtaaagtgtacgcgacatcaaataagtccggcttatcaatatgcttcttttgaagaaaagcaagaaggcgctccgcatattctgtcagacgctccccattttttgcagacagcagaatgaccgccggctcttggctgctgattgcttgtttgacaggagcctcatattcttcaataatgatatgcgcgttagaaccgcccgcaccaaagctgctgatccccgccctgagcggctgttcttctccgtctgctgaaatccgtttccaatctgttaattcacggcagacggaaaacggcccttcatcaaattggatattcggatttaaaacatctgcatgcaaggatggggcgatttgtctgtgcttcatctgcagcagcacttttgtgacagcggcgatgcctgctgccgattccccatgtccgatatttgatttgacagacccgacaagacatgtttcagaaacatcaccgaatgcctcggttaaagcccggatttcaatcggatcgcctaatttcgtccccgtcccgtgcgcttccacatagctgatctggcccggagatacccccgcttcctgtaaagcttgagaaatgacttcgctttgcgccttggggttcggtacggtgtaaccgctcgctctcccgccgtgattaatggcagctcctttaatgacgccgtaaatccgatctccgtcttgtacggcgtcttctaaacgtttaagaagcagcaccccgaccccttctgccggaatatagccgtcacccccggcgccgaaactcccgcagtgtcctttagatgagatgaactgcccctggctcagcatgaagtacttgttaggatgaacggtgagattcactccgccggcaagcgccgcgcgaatccgatgatcccgcagatcccggcacgccatgtacaatgaagtcagcgaacccgaacacatcgtatcgaccgaaatgctcggcccttgaaagtcacaaaaataggagacacggttagcaatggatgaaatcccgccggggagcccgatatgccgtcctttcactcccgcttcagccgcgaatagcgggtattcctgatacatgacaccggcatacacgcctacctgacggcccagttcaggtgatgtcctcgtatatcccgcatcctccatggccatccaagcatgcattaaaaacagccgctcctggggatcaaggtgttccgcttcccggggggaaatcttaaaaaactcaggatcaaaatcggcgatcccgtcaatgaatccgccccatttgctgtagatcgctcccggcgccgtacggtcctcggaaaagtaatgttcccatttccagcggtctttcggaatttcggtaatacaatcctttccttgtttgagattatcccaaaacgcatcgatatcatcggcctgcggatacttgccggaaatcccgacaacggcaatatccagcggttttcctttcgttttctgacggctttgattcccggacggggcaaaagacgcattttcaagccgatttggctgaaagacttctttcacagacgcatttttcaattccgccagctgttccccggtatgactgaggactgcggcatcaaatgagagaaacccgtcttttttatgtttgattgtattcaccacatagacggtatcagacatgacaggtccgtaaagcgtcagcctctcaatcatgagcgggacgtgaatccgctttttcagctgcaattcttcttcaccgagcgacatataacatgaattcaatataagcgggtcaaatgcaaagtgatgcagatcgcctttttctttttttcctgataagtccagctgcaataaaaaggaactctcactcattttgtatcccgccgttaccgttttcagcatcgggcctatcgtgaagtcggcaaccgaatcgtacagacgggaaatgacatccggccccaccttttgtgcatgcgactttatttgttcaacgtcatatgatttttttatgggtgcctctgtatatctgcttatttctccttcggcacatgtctttcggctttctttaccggagacagtccagcttgcggtaaagcgttcggcactcttttctgccgcaaatgaaatgtcaatctgtgcggcctctcccggctccagcgtgacgggcccgcccgtaaagcggatatctttcagctcggcgggatacgtgccggaacgagatgctccggatgcttcaagcaccagacacggatacactacacccatcagtgccggtttgccgaaaaccagatgatcctgaaggaatgcttcatgttcatagaaagtaaatgtctgactgcctgattgcgtttcagagaccggtgctgcatccgcgacaaggccggaagattcatctgttccttttgtttttatgtcttcaagcagttcggatatgctgctgcactcaaataaaagagtcggattcagacgcagatcaaacgccccttcgatgtctttaataatggccagaagctgtgacgattcaagacctaattcaaaaaacacggtgtgcgcatcatttcttgtgacaggacggcctacgtatgtcgagaaaatgcggtataaggtttcctccatctgctgaacgcctggtatcagctgctgatctgtccgcacctttttggctgtcaggccgagcagtgaagcaatatgcgcaccgctgaggttgtaaaagtcaatatccattttcaccatttcagaaggcgtgccggactttttcgaaatcaccgtgtaacagcgctccgtaacagtctcagcggcaataaacgactcataataaatcggtaaaaataactcggcgcctgcagctgtctgcaatacgccggaggccatggcggcaccgtccatcagcgcgggatgaaagagcgcgccggggagattttcccggcatgaatcagactgccgaatatcaaggaaacattcctcttcataagcatagatctctccctccggcttcatcagcccgtcatgcgacagtccgcggcttctcgcgtcttcgtaaaccgcatgcaaggagactgatggaagtgcggcttgttgttttttctcccctgcgtcaagacgcctgtctgatgagaagactccttcatgcatctccgcggataagaaaaccgtcccggaatccgccccgcaaatcgaggcagtccagaactccttttctttactgaatatgacactcacatcaagccgctctgaccgcttcactgataaaggatgataaatggtcacccgtttcagacagatggaacggaatgaaagatcaaggctttgctttgccagctgatacagcatatcaatataggccagaccgggcatgacagattctccgtgaacaagatggtttttcataatgggatgttctgccgtcaggcgcagattcactgtttttttcatggttagtccccttttaaaaacgtcacgttgtcacctgccaaaacgagtctgcaggtgcagtgcttgtctctgcttttttctcatatttctttaaaagatccgcaatgtccgttttttcattacttgttttttccggttcactttccgtgctgttccagccgcccaaaagcgggtagtgtttttttctgaattccggcggctgaggcgaccggtgatgttcccgctgccttgcacctctgtattcttcaacgaggatatgagcatttgtcccgccgtcaggaaatgaactctgagctgcgacgcggggtttcttctctgaatgccaatcaacgggttcacgattaaaatgaatacgcgacgcttcaaagtcataatgttcaaatggctcacgcgctgataagaaaggcggaatccgcttatgatagacgctcagcacacatcggatgaagcccgcaagacctgaagacagaagcaaatgccctacattcggtttcactgatccgatccggcagggcagaagcgttttccggttcagctgatagacatctgagagcgccttgatttccaccgaatcaacgattggggaaccgcctccgttcacttctatatatccgatgtcttcgggcgacttttccgccatattaagcgcagtttgaatgacgtctctctgcgcccttatattcggtgaaccgggaccgagcgtccggccgtcattgtttaccgagacggcttttatgacgccgtaaatacggtctccgtcccgcaccgcatcgctcaatcgcttgataaaaaccgcccccgctccttctccgagcacttctcccgctgattcacggtcgaatatatgaaacacaccgttctcattcaaaatatggcgcgctccgaataaccggtgcgcggatggagataagagcagactcaccgaaccgactaaggccgcgtcaatccttccggccaaaagggcgtcttttgcaaaggacagcccgatcagccctgaggaacatgctgtatccacgacaaggctcggccctgtgacattcaaaaatcgtgaaatgttggccgccaaatagttttgccccgcccccaaaatcggattaggcgcctgcaggatatgttccataccggctgaaggctgcgccctgccgccgatgtatacgccgactttccggcccgacaaatccttttgtccgtacccggcatcataaacggaatgaaccgcttcttctaatatgatccgcgcctgcgggtccataattgccgcgtctttttcagagatgccgaaaaagcccgcatcaaacatgtcgatatcatcaatccaccccgcataatcctttgcatgtgctgttgcatgccagcgcgatgcggggacaggccggatggcggtgttccctttcatcagcagctcccaaaaagcatccgttccgcccgcccccggaaaacggcaggacatgccgacgacggcaatatcgtcttcggtatccgctttcggcttcatggatgttctctcttcagcggcggcggttacatcaggctggacgtccatgtcttgaacgaaaccattttcttttgtcataaaatcggtttcatgatgcgctgcgaaatagtcaaccatttctgtaatcgtttgatattgaagcattaaggacggtgttaactttatgctgatccgtttttgcaatgattgaaccaattccgcaaagagtattgagtcaatcccgtattcatcaaacggcatatcatcttttatctgctcatccgtcattttcagttcttcgctgaaaacggtgcgcacccattgacgaatcatatccttcaccttttggtcaccggcactgctttttttcatgggagcttcagttttcttcaccttcagaagatcaccaaaatcagccttactgtcttcgggaacacaaggaattccgcagctttgtccgtttaatatgatgtaatctaaaaacttcagtccgtcttcggcagacagcctggaaagtcctgatttttgataagcaggtgtttccggcaggccttcagccatgccggtttctttccagacgggccattgaacggctttaacaaacacgtttcctttacctgcctgatgatttgcaaaagagtccataaatgaattagccatcgcgtagtcactttgccccgcagcaagcgaagggatcagaccagaaacggatgagaacaaaataaaaaacgacagcggctcattctgaacggcttcatagagaccgccaagccctgttactttcggcgtgcaaacgctttcgatctcagtttcggttttgttataaaaagcggggtgttctcccattgcacccgcgcaatgaaaaacgccggtaatcggtcccaacgtgccgcggatgctgtccgtcatgttccggagccccttttgatccgtaaaggaaacgctgtaataacggatctccgcgccccgctcggctaacctctgcatccgctcggctttttccgggagaatgccgtcctttttcatgtctgcccactctgaggaatcgggaagcggctcccgccccatgatgaccagtttcctgcatccgcgtgaaacggcatgatccgccgcaattgcgccgatcccgcgcgatccgcccgttattaacagcacatcatcagacgaataggaaagctcaggcgccgccgaaacatgcataccctgcttcagaaacggcacataacggcgattcagcctgtagcagcattcactgccgcttttggcccgcggctgtaaaaattcagtctcaatctgtctgcttaattcttctgtatgctcaatcgcacaatcgctatctattgtaaaagaatgaatgttggcatactcagcgcccagcatccggtacagccccgccgttttcgccccctgcatcagaggtttactttccttgaaaggctggaggcggtgtgtcacttggctgaacacagcgccgctatgacggaatgattccagagcctgctgtaaaaaggcaagctttccgtattctatctcttcccgccgttcatattccgcatcatatgcggttatgtcgacgaccccgagtatctgtttgttttgaagagactcccgcactctgccgtaaaggtttcgccccgatgcggcagcgtaataatcggcgccgtcttttgcctgatggatgaaacagatcgtttcaatatggtcgtttcctttaaatagagcatcggccaatcggctcgtcttatcagttgcaagtatcattactgttcctgataatgcttcagactccgccggatcttgctgcttccagtctttttgaagaatgatcttttggttttccgccggttcgtctgtctgtttccggatatccgcaggcacaggcacccaataccgctccttcgcgaacggatatacaggaaggctgacccgtttcggcttctctccttcgtataacaggctccagtcaacggcggctccttttgcccactccgtgagcaatctggaatattgcttgtttttcaaaagttcggccattccccttgatgaaatatcatcttgagcacgtccgcggaaacacccttcaatttccgttttccgttcaagcacatccttcagtttcgcttgcaggccgcaaacggatgtaacgatcaatgccagccgttcaggcatcgcttctctgccagcttgaagcgtgtaggccaggtctttaaggttgacttctttttcccgtaaaaagcgggcataccgtttgacatattccaatagccgttcttcattttttgccgaaagcagaaacagaaccggctcgtcttcccgtatattcaccgatttcttttcagcctgcggcggcagatattcttctatgacaaaatgggcattgctcccgctggcgccaaaagaacttaaacccgctcttctcggctggtcaggatgtgacggccgttcccattcttccagccggtccgccacataaaacggcgtatccggaaatggaatatggggattcagcgtgtccgcgtgcaatgacggaaagatttctccatgcttcagctgcaaaagcacctttgttaatccggcgattccggcggctccttctaaatggccgatatttgatttggcagagccgatggcgcaaaaccgcttcttgtttgtccatttgcggaaagcgcggctcagcccttcaatttcaatcggatcacccagagacgtacccgttccgtgagcttcaatataactcaatgtctccggatcaatgccggcactctgaaaggaatctgtaatgacttccgcctgtgatgccggatcaggcacggtcaaaccggatgtttttccgacatggtttaaagcggagccttttatgacgccatatatcggacagcccatcttttccgcttcttgaacggttgtcagcaacaccgcgccgacgccttctcccggcacatagccgtcaccgccgtcggcgaagcttttgcagacgccttctgaagacagaaatccggcattcgccaaaaacgcatatttatgcggatgtgtgaccgcattaacaccgccggcaatggcgaattcgcactcccccttttaatgctttcacatgccaaatgtatggatgtgagcgaagaagagcacatcgtatcaacagccattgacggccctgtaaagttcaggcagtgagacacgatattcggaacagaggcaggcgtcacgcccatagacagcagtgtgccccgctgtgtgatttcagcgccgaacagctcataatggctccaaaacacacctgcgaataccccgacgcgttttcttttttgtgaagatggcccgcgcgccgttctgtcctgataaaaaccggcatcttcacaagcttcccaagccgtctctaaaaacagccgcgcctgcgggtccatcatttcagcctggcgcggagtcagattgaaaaacagcggatcaaagctgtctatgcgatctaaaaatcctccgtaacggtagaactgatctgcttcatatgagaaaggataacctttccatctgtctttcggcattgttgtgatgcagtctttacctgagcgcagattttggtaaaattcatcgatgcttcccgactgcggatatcttcccgccaatccgattaccgcaatatcgtgctcttctgtgtgtctctcttgttttcggcttcttctcttgacagctgcatgggataatgaagagcggttcttgtctgccatcggaaccaatcgggccatgctttcagttacagcaggctccttcccgtataaaataacggattgcagcttgccgagacgcagcatatattcaagtgaagccatcccttccccggccggaagcgggctggtgccggttgcatcattcatgatctctttcatcaagctgtcaacctgcatgccgccatcttcccaaagcggccagttgatcgtcatagaagcccctgtccgttcgcctttttccgctttgcaatcgcgatatttcatatattcatccataaaagcgttcgctgcggcataatctgtctggcccgcatttccggtcagcgccgagaatgaggaaaatgcggcgaaaaattcaagcggttcatgccgtgaagcttcgtccgcatgaatcaggccgctgattttcggcaggaacacccgcttcaagtcagaactgtctttttggatgataaattgatcttttaaaacaccggcgcaatgaaaaatgcccgtcagccggccgaaagtttctgtaatctgagcaaatgcccgctctgtttcggctttgctgccgatgtccgcttgaacataaagaacttctgctcccaatgctttcagtctgctgatcttctcagactgttccggcgaacggccgatgagtgcgagcttcaccttttctttttctgcaaggtgacgggcaagcagaaatccaagaccgccgaggcctcctgtaatgacatatacgccgttttgtttccaaggagactgtgtctgtccgtccggtttctcaatacgttcgaacaatctgatctgccgcatatcgtctttataccgaatgtctgtgcagcctgcacgagagcagtctgcttctgttctaatgattgcggccgtctcacttagcaatctctcattcttgtcacaaaaggtgatcacctgagtgtgaagagccggattttccagatgggccgttttcagcatagccccgagagcggaagacaatgccgctccattctcaacggcgcatacaagctgaatcaatgtatgttctttcggatggtctgtcagttcccgtttgagcatacaaaatatgcgctcggcatctgctccaaactgctcatctgcaacctcatgctcccttttcagttctatcacttccgcttccgggcaatatgtgccgagttcaccggtgagacgggctcctgcatcggcagcgataatgagatgacgggtgtgtttttgcccgttctgcaccgccgtttccagcggatgatctttccaggcgggttcaaaaaacagaacctcatcagcaatgtcagcgtctgatgtatgccgttcttcggccgaatctttcagcacacagcccgcttcattgataaggtaatccgcaaggcggcggacagatgaatattcaaatagcagtgtcggataaaactgctgctgaaaagtctgctctaatatctttacaagcttcagcaaatgcgccgagtcaagccccatatcataaaagcctttccgcacatcaatagcctgtgccggacgattgatcagcctggcgatttccgactttatgtaagtcaccatgttttgttccggcgtttgctgttcagacacgtcttctgcggccacaggactttcgggctctccacggccgcttctgttctgctgaggcggcttctctttgtctatcagatgggtaatcatattcgcttgtctgaccctttttactgtcagtttctcacattcggccaatacgttccccgccctgtcgtaaatcgtgaagtcggccgaataaaaatcaggttcgctatctgatgcgccgctttcagtgcggctgtttttcgcagaataagtgtaaatcgttttcggaaacggctgatatatgcaaaaacgattaatcataaaaggaatataaggtgtgtcattctgcttttgggccgacaatgcaaaggaagagccggcaagggtggacgcatctaaaaaagccggatgcgccttaaatttctcccggaatccttcagccaaatcactcagagtgagctccattaattcttctttatcctgaagctgataaacagccccttcatttttcataaactcgccatgctcaatatggcttcttcttgcaattccgtaaatgtcatgcatgtcccattttcggcttgcgtttttcatgaatgcttcaatattcagttcttttgcccggggcgtgtctttttgcaaataaagctgacattccatattctcatcccgttttccgccaagcggtgtgccgttttttgctttttcgcttgtgatctcaactttccagctgtcactcgccggcgtaaaggtgacatacaggtgtttatcaaactcttcagatgttacaacaggctgcttaaaaataatctgtcttaattctataggcctttcaccgagatacccggcggcgagccgatacagcatatctattaaagtcacgcccgggaggacgcggatttgatgaacgcgatgatcccggacgatataattcgaatggctgattttctgcaggaacgttttgacttgatcggtggcaactgccaatctatcacacctcgcttatttcaaacattgcttctgtgcccgcctcattttcttccgcttcggacaactgtgctttttcaggccaataccgctgttttcggtatactgtctgaccgcctttcggttccatggtcgcttttcgttctttcggaattccttcgttgctgacaatgatatgggcgttattcccgcccaaaccgaacgcgctgaccccggccctgagtatctctttttttccgtcccaccgcttcagctcaagcacaggataaagcggcgaatcatgaaattgaaagcgggggttcggtttatggcaatgcaaagtcggcgggagttcttcattggcaatcgccagcaaaactttgatgattcccgccgcgcccgccgcactcagcaagtggccgatattgcttttgacgctccctacaccgcaaaattgtttttcatcggaataagcagacaagacattggttaatccttttaattcaatcgggtcgccgatcaaagtaccggttccgtgagtctctacgtatgtcatggtgtccggctcgatttccgctgattgaaccgcctgctcaatcaagtcctgctgcgcccggggattcggcgtcgtcacccccattgtgctgccgtcattatttatcgcagagccgtcaataacgccgtatattttatcttcgtcttctatcgctttttcgagcggcttcagcatcagcacaccgcagccctctccgattcctgttccgtccgcatcggcatcgaaagattttgaacggccatttggcgataagattctcgccgcgctcattgtgagaaaaggtttttcatcaagcaaaatgtcaaccccgcccgcaaaggccgcctccgcttctccattttgaatagcctgcacagccaaatgaattgccgtaagcgaactggagcaggccgtatccacgaccaggttgggccctgtaaagttataaatgtgcgccatatgtgcggtaataaaattttgccccgcgccaataatcgcgtctttttgcaaatattgaaatttctgatgaaacgcacctgcccttgcaccggcaaaaacgccgatacggcggccccagagatcctctttttgataacccgcatcggccaaagcttccgcgctcacttcgagccactgcctttgcagcgggtctatcatcggtgccagcgtttctgaaatattaaaatactccgggtcaaaatgatcaatatcgtgaataaaaccgccccatttactgatgctttttccttcttgatattcacccggctgatagtgttctccggcgttccatctgtccggcggaacttcagtgacggcatccgttccgctgcggagattcttccaaaattcttttatatcccccgctttcggaaaatgacaggccatgccgatgatcgcaacctttccccgtttcccgggcttatctgccgtttttttgctctgtttcggcgtcttctgcaaagggatcttctccgcgggaaccgctgcatctgccgaaaaagcttccggacaatgtgcggctaaataatccgcgagctgttctatggtagggtgttccagaaggacagtcggatcaattgaaacggacggcagtttttgatcgatctttgtcagcacctgcgccagaaagatagaatccattccgtattcctgaaaaggcacatcgatatccatatgcgtttcatcgatactcagctcttttgccaaaagcgacttcagccaagattgaatatcagtccggttatggacccgtttttttgtttcaggaggtttggaagctgttctcattcctttatgggcggctggcttggcgttttcaagcgctttgatgtcccaatcatgtttcacttgtgccggcagcacgacggttccgggtctttctcttaaaatgtaatcaagcatcttgagaccttccgcgtcagagtgacgcagcaatcccgtttgctgatacatcccgctttttgtatccctgctcatgcccgtctcatcccatgccggccattgtatgctcatgatgccgctctcattgttttctgcaaaatagtccatataagaattagccatcgcataatcgctctgtcccgccgcaagaatcgggacggctgccgagacagatgaaaacaggacgaaaaatgccggcgcatcatcctttacactctcatacagactgtgaaggccgtctgctttcggggcgagcacccgcgcgatactgtctttggatttgcggagaaaagcagggttttcacggtccgcaattcccgcgcaatgcagaatgcctccgacaggtccgagcgttgtggttacctcttttataagccgtccgacagcctgcttatccgtcagatcaactgtagagacgcacacttttacgccttgtgattccagctttcggataagctgtattttttccgaaacgacagggtctgtttgctcaagatcccactcggttttcggcggcagctcctttctgcctgtcagaagcagtttcttcacaccgtatgcggaaacgaaatgcttggcgcataaagcgccgagtccgcgcgttcctccggttatcatcaggacggcgtcttttggaaacacagtccggtctgtttgcacggcttctggttcaatctgatcagtctgccgaagaacatagctgaagcgcatgccgtccctgtagcaaacagcagattccgttaagtctgattcaatttcttgtttaataaaagcggctgtctgctccagcggctcttcaggatcaatatcggcgtgacaggtgagaatatggctgtattcatgccgcagcatgcgataaagccccgctttttcaataccatgcatagcggccgccttatttttgaaggattcaaggccttttgtaagataaagcattttcatgttttcttgtccgcggccgtattcaatcagctgctgcagcgatgccacccagctgatgtcctgccgcttttgccgggaaccgcagccggtgaagtcaataaacccgaaatagatggccgcattcggatcctgtaagaaagagatgagctgattttcctgcacaatgtcagcatcatttagctgttttttcacctcggcggcaaggtcttttgtatcctcggagacgatgagcgctattttgctgaatggctcggatgaagacactgcctcgcaaggctcccatgttttctgcaatactactgttttttgattcgaaagcggcagctgctcccgtttcggcacccaatagcggtcggctctgaacggataggagggcaggctgatgcggcgcggcttactgtccgtatacagctgctcccaatctgtgtcaaatccgtttacccagagccgcagcactttcttgtatttctttttctcaatccaggcgctgacgaggtcagcagcgtcttcatcgtctgagaacatggaggtcgtgttattctcgcgttttttgcgcccgctgatgatatcttcgctgttttttcccatcagaaacgcgttcagtttttcagtcagttcctctgcggagcctgcaatgattcccagcctcgcttccattgcgtcccgtccggtctgcagtgtgtatgcaacatctgcaagatcgatatggcgggatgatccgttttggataaaatcccgaaggagacgcgctctttctttcagccgctcttcatttttagccgacaaaacaaaaagagatgacgctttctcacgggtttccggctgttccgtttcacttttgcccatgtattcttcaataacgatatgcgcattgacgcctccgaaaccgaatgagcttacacccgcccggcggggcaggacccggccgttttcatcacgcagcgcttcccactcctttgtttctgtcacaatgtaaaacgggctgtccttcaatttgatatggggattgatgttctcgcaatgcagacttttggcgagcgtccgatgtttcagctgcatcaatactttgataacgcccgcaatgcctgctgcgagctccaaatgtccgatatttgtcttcactgagcctatcccgcaatatccgcccggagccccgtctgtttggaaagcttttttcaatgcattgatttcaatcggatctccgagcgccgtacctgttccgtgcgcttctatataagtaatcgttgacgggtgaataccggctttttgataagcgcttttcagcacatccgtctgagcctgcggattcggcgcggtaagtgacgctgagcgtccgccgtgattttccgctgtaccgcggatgaggccgtagatgtgatccctgtcatgctcagcctctgaaagctttttcaagacaatcatgccggcaccctctcctctgacataaccgtcagcctgatcagaaaatgttttgcagcgtccgtcttcactgagcatgcctgctttttgaaaaccgatatggccttcaggcgtgacgatcgtgttgacgccccctgcgaccgccatatcacaatctcccgtttcaatggcttttaccgcgcggtgaatggcgactaaagagcttgaacaagcggtttctaccggctcgctcggcccgtggatatcaagaaaataactcatccggttcggtccgacggacggcacgattccggtcatcgtatacccctcgacaggaagacccgccttattgattaaggtttgatatccgcttcccaatgtgccggtgaaaatgccggtttttgttccggcaatccgttttgctgagtaccccgcgtcttcaatggctttccacacatacatcattaatagacgctgctgaggatccatcatttcagcttctttcggagatatcccgaaaaacagcgggtcaaacccggcgattccatctataaaaccgccccatttaattgacgttttatttgcagccgctgccggatcgccgtaatattcgcgccaatcccagcgatcccggggaatttctgtgatgcaatgctctccttttgataaacgtgtccagaattcatctatgtctttcgcttgcggaaaaataccgctgattccgataatggctatcggttcggttttttcttctgattttccttttacggatacgggcgtttcccgtttgacatgaacggccgccggagtttcagcttttctttttccggcttttggagcggttttaaaacgctctctttctaagccgctgaatgcttctttccattcagatatcaaatggccgctcagtttgcgcaatgtcggaaattcaaagaagatagtcgggctgagctcaagctgataagaccgatttaatagatttgtaaattcagtgaagatgatcgaatcaaatccgtattccgtcagttcgctgtcagcctcaatatctttcatgcttacctttaaaagatctgatacatgcctctttagtttctcttgaacccgatctttcagatctgttgcatctgtctctgccggagcttgtccggcggcgctttgttcttcgcccagatcgaaaatatggctgcgaatccgtttctcgtcgccttctgccaccatgacctggtgtgctccggaggcaaaagcggcataaagcgcctggatgcctgatgccgatcgcatggctttcattccggtctgttcatacatcagccgttcggtctctttgtccacacgcataccgccttcttcccaaagcggccagttgacggacagggtctgcccgctccgcttgttgtcccgcacgagacgatttcggcgggctgcataaacatccataaatgcgttggctgccgcataaccggcctgtcccggatttcccatgcctcccgccaaggaagaaaacagaatgaaaaagtccagccgcacatctttcgctgcttcatcaagattgataagccctttcaccttcggcgccatgacggtcttccgttcgttttctgtctggttcagaatgtagttgtcggcgatcacgccggcgccgtgaatgatcccgtcgagtgttccgtgctcctcctgtatgccgcggacgagggcgatgaccgccgccctgtctgtcacgtcaaccggtttatacagtacgcgggcacccgtcgcttccaagcaccgtaagcgggcggagcggtctttatcaagcgcttccgcccttcccgttaatatgaggacggcgtttttgacgcgggaggctatttcttcagcgaaaatcagcccgatgccgcccgctcccccggtaaggaggtaaaccccttcgtctttccacggaacggcgccgctttgagaggccggcaggtgacgccagtttctgacgaaacgtttgccgccttcataacggatttccgcttgttcaggatgcgcccggttttctttcagcttggcaagaagcgctgatgctgactcgtccggatcggcttggatgacttggccgtacagcttcggatgttcaaggtgagccgttttcagaaaagcggccagccccgccaatacattgtcttcccccctgtcggggacaagaagctggatcagcgtttttcccttctgtttttctttgataagacgcttgacgatcgctgacagctccgccgcacaggcgtcataacggtcttcaatcggaccttcgccgtcagccgcacatacggcgccgcttatctcctcagcgttcattccgccatacagcgtcacgtatctgaaagactcttcttgtccgccgccttcatccggcggtgattcctgccactttggctgaagcaagagcggttttccctccgtttcctcttccagaaaacgggcggtgagccccgtcaatcggacacatacctcgccgttttcatcacacagctcaatatgataggcgccgtccgctgaggaaagcaccgcccacatcgtctcacggcatgcagaaaacacctgcatatcctggagggcaaacggcagaaacggccgtccggacgcggaaccgtctgagagcacgagaccgatagaagcctgaagggcggcgtccagcatgctcggatgcaggatgaacggctccttttcttcgcgggcggacggcggaagagtgagcttcgcgagcacttctccgcttcctgcatagacggcgtcaatcgcctgatgagacggtccgtaggtgatgccgagactgtcgaatgcttcatagcactcagcctttgacatgcgccggccgccgcagcgcgcctgaaccgcctccacatcgagtaccggagcacgctccgtctcttcgagcacggcctttccctggaaaaagacaagcggctcttccccttcggcatacgcttcaaaagcgatgtctccgttttcttccggctgaagctttacatgaagcgtcactccctcagaaagcaccgtcaccggacggagccaaacgatctgtttgagccggacacccgctttcccgcccggcaagtcttcagcggcaagcgtaacggcggcccgggccatttctaaagcagccgcgcccggaagcaccggttttccattgacgatgtgatcagcaaaaaacggttcatgccctgaaaaaacagaagtaaagcgctgggcggtaaaggtcgatgtattcgcatggagcagcgggtgaagcttttcacgttcagctgaattccggctttcaagctctccctgaagacgatcggacgcccaatacgtctgccttgcaaacgggtagcccggcagattgccgattcgcggcaaaggtccgccataaagcaagtccccttcgatttcataaccttgacaataaaaatctgccagcacgcataacagttcctgatattttctttggtcagaatatgaggcgctgcacttgccgagcacttctattatgtgctcctgaatatgctgtcggcctgcaaagtgctgcggtacttttcccgaaaacacataaggatgatgttcattaagctttgcctgcttccatacatacactgcgtcatcagcatcttgaaccacgatggcggcgcgatggttaaagtgatgccgtccttttagcaacgtatagctgagctgggctagatcattttctttcagtccgccattttccgcccaagtgatcatatcttcgattttttcctgaagggcctcctttgtttttgcagacaaagtcagtaaataagcaggggcatcccgatgaggtgaagcgctgcgcttatagctttccataacgacatgggcgtttgttccgctcatcccgaatgcgctgactgcccccattcggtttttatccggcagagaaggccacggtttacccgttttattcacataaaaaggactcttctcccagttgatatagcggttttccccgctgcaatgcagactggcgggaatcatttcacgggagaatgcctgtaaaagactgatcaaactgacaatgcctgacgcggcaaacgtgtggccgatattggttttaattgatgtgagcgcgcaaaatgcttcttcgtttgtataggcagtaaatgcgtcataaagcgcgttaatttccaccggatcaccgagttttgtccccgtgccgtgtgtgacgatatattcgatatcttcagggttgatacggccccggtcataaacggaagtaagcagccgggtctgcgcgacgccgctcggagcggtaattccgtttgttttcccatcataattgatgccgctcgcccgaatcaccccgtaaatcggatcaccatcttcttccgcctctctcagcggcttcagaacaaccgccgcggcagcttccccgggaaccatgccgtcagcccttttatcaaacgcgaagcatttcccgttttccgacagcattccggctttatctatcgtttcaaaaaagtccggggtattcatgatattcaccccggccgcaacagctgttgtgcactctttattctgcaggcttaataccgcctgatggacagaaacgagccccgaagaacatgctgtatttatcgccatcacaggacctgataaattcaagtgataagccagccgcgccgccaaaataccgttatgatgagacgtgacattgcctttgtcctgtgttaaaaggtgataatctccttcttccgcacccacaaacataccgatcgtctgctgcctgatgtgactggcgccgtagccggcgtcctcaagggccctccacgcttcctgaagaagaagccgctgcttcggatccatcgtttcagcttccctcggcgatatttcaaaaaataaagggtcgaattcgtccgccccggtacagcgccgagtttccattttgaacttgtgaagcctttttttgcgaccggtgcgacaacgtccttttcctgaaacagaatgtcccacagctcgtccgccgtgcgcgcctgaggaaatcggccgctcatgccgataatggcaatggaatcagctgcctgactgccctcggttccggcgttcagcttatttcttcccctctgcttctttcgcttttccgtttctgccttttcaaagacagattgatctgcggattcagatttcttttcttcatagacatgctccatgacggacttgtgttccgtcagaaaatagcggacgaccttctccagtgtggaatgtccgaaaaacagggccggggtcacttcaattccgtagtgagcggacaaagaagaggcgaattccgccaaactgatagaatcaaagccgaaatcagccagattgtcagcatccgtcagtctgttcttgtctattttcaaaagccccgccgccagttccttcacatcccagcttacgcattcttccagtgtaaagcctttcatttcactccgccttcctgaaaacgggacgttcctgtttacagaacccgaattcggcctttcgccttgatctatctgcaggaagcgtttggccctcgacggaaaaccggccagcacgagatactggctggacggctggactaacaatgtttcaaaagcttcgagtccttcctctgtgtataaataacgctgtccgctggattttaaatacatatcggtgctttccgccgtgccgacatgcatccccccttctttccaaagcggccaattgatggcaagtgacttaccgcttctgagtccgaggctcacaagtttatcccgatgacggacaaaagccatttggaagcggttccccattgcgtagtcacaagaaccgaagtctcctaaaatcgctgaagaagaagagaaacaacagaagaagtcaagcggctcccgtgacagaacccgatctaacaccgcggtgccgtccgcttttggcgataagacttgctgaaaggtttgcagatctttctccagaatgctttcagtgccttgaagacctgcagcgtgaatgacaccgtgaatcggcccgcatcctttctctttcgcttcttgcaaacctttctccatctgagcctgatctgcggcatccgcctgcacgtaaaacaccttggcgcctgattcttccaatctctttatcttgttcagcaccgggccgcctgccgctgatctccccgtcaaaatgagcgtaaccggtcctttttcagcaaaatatccggcgaataataagcctaaacctccgcatccgccggtaatcaagtacgtttttccgctttttatcacacgcttctcaacatgggcaatatccgtctgcttcatttccatgacgtgacggatttccccactgtacatgacactgcggaacgactcgctgtgaagctcttcacatacgttacggatcagcttttcaaacggtcctttttgtccaaaataaaccgcggccgtatccgtctccggcaggatcagtttcagcgaccgttccagcccgatccatgactcggcgtaattgatatcggcatcggtcccgcactgagcggaaagaagaattcgcctcggtttagaacgtaaagaagccgctgcgcggatcacatgatacagaatggaatagtctttcacggccttttcatcttcaagcggccatccatacaaaacggcatccgccttgcctgcagccgtttcaatatgccgaaacgtttcttgatatgcttgtccgtcagtgattttaatttgataatgcgtgtttgaaagcttttgagtttcctcaccctgtgaaataaaaaacacgccggctcccggataaagggattgtaaagaccgataagcatgttttctggcagcttctcccgtaagaaaacagatgaccgttttcagctcttcatgaatggatttcttcagaggctgctgcgtccacctttcttcaaatatcatcatctcggagtgttcctcttgcccgtgatcctgctgagacggctgtctcattctcacccctttgatttctgcgcatacaatgccggtttcgtcacaaaattgaatgtcacagccggtttgattctttttattcatatacatccacatgccggatgagcacggacgcatgacgcgcagttcttcaaccgcttcaggcacgatatggactgacggctccgtttttgccaggacatgaaaagctgcgtccagaaattccggcggtagatgatatcccggattacggccgctttcatctgtaagagcaagcttcgcccaaaccgtattttctcccgtataaagcttttcaacggtgcggaactccttactgatcgttacacctgatgtgcctggtgtttcataatcgaatgacagcgggcggcagtctttttgtaaggaggcaatatcaagcatgcgggacggctgtatgttcccttgaccgatgattccataatgatgcagcttctcttcatcactgtatatttcataatggatgccttcctcgtcttcagacagaagggagagattgacgcccgcaccgtgatgtccgccggtaatcgggtcagtccatgccgctgttcggatccatatctctttttcttcagagctgtctgccgcatgatgataagccgcaagcgccatttctaaataaacggctgccgacagaacccgctcccctctcacatcgtggaaaacgtgttcccggcctgtaaaagatgtatgatagctttgctccgccaaggttgacgtattttcatgcaggaaaggatgcacatattcagttgttcctgtttttggttcttcccgcttcatccagtagctttcttttgcaaatggataagacggcagactgatacgatgcggcagcgcgcctttatataaagatgcccaatcgacggacgtcccgtgaacccaggcattcaaaagactgtcaaattgacgtttttccatccaatcaccgactgtgccttccgtcgctgtgacagcactatcactccggcccgtaaacaccccgcttacggaaccggcattattcagaaaagcagtcagcttctgttccaattcagaaacagagtccgctgtcatcgccagccgttcttccatcgggaccctgccgacttgaagggtaaatgccgcgtcaagcagatttacatctgtaattgttccgtttccggcggcatccgacagcaacagagcccgctcgcgcaagcggtctttatcttttgccgataaaacaaaaagcgccggacggccggagtccgccgaagtcatttcagccggttcatactcttctataagcaggtgggcatttgccccgcccgctccgaaagaagatgtacccgcgattctcggatattcccgtgttactccttcagattctatgaccggccgtctccattccgccgtttcctgctgcacgataaaaggagaagtttcaaaatcaatttccgggttcagctgctttgaatgcagcgacggcaccagatatccgtgtttcatctgaagaagaattttggtgacggcagcaatgcccgccgcactttccaggtgtccgatattggatttaacagaaccgatggaacaaaattgctttgcatccgtatagcggcggaaagccttggttaaccccgcgatttcaatcgggtctcccaaggaagtgccggtgccgtgggcttccagatagctgattgctctcgggtcaatccctgcccgctccattgcgtctgcgatcacttccccttgtgcattcgggttcggaacggtgaacccgttcgttttgccgccggcattcagagcgcttcctttaatgacaccgtatatatgatcatgatcttcaacagccttcttcaacggctttaacacgatacagccgacgccctctccgtcaacaaacccgtcagccttatcaccgaacgctttgcacgcgtttgacggcgacagcattctcatagaagaaagtccgatataatgaaccggatctgtaatcaggtttacgccgccggcaatcgcgcattcagatgcacctgttctgatgctttctgcggcgagatgaatggcggttaaggatgaggagcatgcggtatcgaccgcgatgctcggaccgtgaaaatcaaacacataggatacgcggttcgggataaagtggtagtgggcccctgtcggatagttgccattcatgacacctgcaaagacaccaacctttttaccggcgcatagtgaatcaggggtatatccggcatcctcaagggccgcataagcggtttccagaaacagtctctcctgcgggtccatgcgctccgcttctttcggggagattttaaaaaacagcggatcaaatttatcaatgtctgttaaaaagccgccccactttgtatacatccggccttccttaccttttgtctcatcatagtagtcccgccaatcccagcggtctttcggaatttcggtgattccgtgttcaccggtctttaaccgttcccagaactcattaacattttcagctccgggatacttcccggcaagaccgacaattgccacttcaaggtgttttgagggcggttcggaagcgggcggcgctttttcagaaaaagatgccgcttggcgcttcgtcaatccggcgctttttttgcggctttgctttttctgtagagtgtgcggcaccttttcggcttctttatttgtcttgaaaatcccagccatatcttcctgtcttgagctgacgagatattccgctaatccgccgattgtcggatactcgaagaacaatgtgctgctgatatcagggacgtcttcccgcacgcggttggtcagctgtacgattaagatggaatcgattccgtattcttcaaggggcgtatgggcttgaacgtcctcaatcggcatctttaagatgacgctgacgatctgtttcagatactctgtgcttttttcaagcaaagagccggatgataccgcttcagtatgagggagttcttctgaaaatcgcgcatgcagttcgcgctccttcgtttcagccaagtatgcggcaagctcttctatcgtccggtattcaaaaaacagcgtgctgctgatatcagggacgagatcccgcagctcattcgtcagctgaacgatcagaatagagtcaatgccgtattcatccagaggagccagcgggtttatctcttctgccggcatttttaatacttttgccgcagcccttatcagaaaagccgctgtcttttccgaaagcccctctcccgcttgtttgatggggagctgacgatcagaggatgttcgcggtacgtttgattggcgcttttgcgcggtgtaagcttccctgctctgcctgatgactccgttgcttttcgctgtgataatctgctgggtgtgcagacgttcgttttcagccggaaattgaatggaatgaaagccttcagccattaaaacggatttccatgtttccggataaagaccggggcaccccggaatccgcagcacctcatcttcgtacagccaccagccctctaataagccgaatgtaacatgtgtaaacggcgtatgcccgcccagttcattaacgagcagcaaaccgtcttttttcaatacggcttttgccgtccgtaaggttttccggatatttttggtagcatgcagcacgtttgcggcgatagcgatatcgtaggttctcagatgtaatccctggcccgccgcaggcttctccacattaaacagctgatacgtcaaaaacggattgtccgcgccgtattccttttcggcatgcattaaaaaagcttttgacaagtcggtataacagtattcctgaatatggttttgataggggcggagctttttaaacagtgtgctgctcgttccgccggtgcccgctccgatctccagcagacggatgtttgcctcaggattgtatttaattacattttccacataaatacacgcttcatttgccagcacatcgttgtaataatcagcgagaatgttatgcttatagattccttcaacaagctccattgaagaatcgggaaacatcacgtcagtggcttttattttgcctgttaaaatgtcaggcaaagcttgaatgacggtatccgccagcagagcctgcgctttcatatccggatctttcagccattcgtttttcttcttatgccactcttcccacaccgcggccgtttcaccgcttttaaaatcgctgtctaaaagacgtatgctttcttccagccagcgctcatataaaggcagacaggaagctgccggcgcttcgccggtcagacccattgaacgcagcgtcacccgcagcacttgcagcaaaagccgattcaattctttcatttgattgcttatttctgttcttaaggataactgtgtacggtctttttgtttgtctcccttacccaaaaccttatcctcctaagaaaattaaatttgctccgtcattttgacaggcaatcagatagtcacaaattcatgagggttcattccctcgatcggaatcggcttggtcagcttcatcagccccatgcgggagatcggctgcgtcagcagagtttccagcgcctgcatcccatccgcccggctgatcagtccgagaccgattgcactcagtctgtcaaactcttcagaaatgtgattgtcagcccgctcccaatacccccagttcatcactttgaccgggcatgacagccgcccggaaagctcatgggcaaatgcgtctttaaatgcgcaccccgccgcataatgactttgattcggattcttaatatatgaaataaccgaagagaaaaagagaataaagtccaaagactctttcgcaaatacttcggcaatgttgacggaaatatccactttcgccgcaaggccggcgtgaaactgtgattcttccatatcttttacgctttcattcgcaaataccatcgctgaatgaacgacgccgctgatggtgccgtatgtgtttttaatctgttcatagacgcgctgaagcgatggaagatcagaagcatctgcggctatatattcgggagccgagcctgatggccggtaccggtctattttttggcgtatccggctgtccagcggccgcctcccgatccagacgactcgggctttatacgtcgtcaccatataatctgtccaaacctcgccgatgcctcccgcaccgccgatgatgacatatacgcctccatatcggtaaggaacactttcagacggcccgctttggaccggaagcaattgaggccggtgccattcctgatgtctgcgcacccatgctttacccgtacggtcgcggggcaggctgaatatgtcttctgtggggaaatcccccccgtcttcaagatcgaccagacggatgtgccagctcggatgttcttttgcaagagacccgacgaaaccatgcacactggaatgagcgggacgcacctcatcatattgggtgataggctgtgcttggtgcgtaatcaccgtcatcccgagctgctcttttccatacccgagaccgataagagctttggccgctctgaaaatttgcagcaccccgcttttttgatcatggatgtaagaatcagccggctgaggggcaaaccagatcatatgctgaatctcaccgagacggcggagccgatcggatatcacttcaacggaagcactttggctgctatcaaatcgcacagctttaggaaacaatcgtaaaaccgcgtccgcctgcccgtctgtaccgcctatgatgacagcttttgcttcagaaatggggaagccggtttggttgtctatcggttccgcgtcccatacctgcatcagtttgacggctccggtaaggttacccggcagatcgtattgcttgtcatccgtttcagccggcgcactttcggccatccgggcagaaaatccttttattcttacacacacattgccgcgttcatcacatatatcaatgtccattcttcgcacggccggtgtttcatgcgtcacaaacacggccgcccacatgtttggactgcacggatgaaaaacggtcagttcatgcaattcaaaaggcattaacggctgctccggataacccgctttatcttcattcataacgccgatggccgcctgaaaagcggaatcaatcagactcggatggagcacaaactgttcggcctcatcacaaacggaagcagggagcaccaatttagccaaggctactttttccccgcaataaatgtgatcaattccttgatgtgaaggtccgtatacaatttccgcctttgcaaatgccgcatagcagtcttcttttgacagcacttttttgcggcagcgcgctttcagctgttcaatatgcaaaaccggcgcctcagacagcggctcaatcacagcactgccttcacaataaatgtctgaatcgttttcattgctgtacacttgaaatgaaatattgccgttatcctctaaggaaagacctgtcgtcatacgcagcggctcttttttatgaacggcctggcgtatccagctgatataccgcagcgaaatgccggttttagccgtgtattcagcggctaacggcgcggcagccagttcagccgcggctctcgccatttcaagataagccgccccggggagaacacgcttgtttcggacgatatgatcggctaagaagaattcatctccgttcagtaccgtgctgaatttttgttctaacaaatctgaagtattgcggtgaagcagcgggtgaagcctgctttctgtatttacggaagtgacgggatgatcgggctccggtatccaatagcggtcctttgcaaacgggtacgtcggcagactcatcctgcgcggtttctcctcctgatacagccgcgtccagtctatctcaaatccttttgaccacagctccgcaagttttttgtaagtgccgctgtccgtccattttcggatcagctcctccgtatcctgatcatcattcaggaaacccctgatttccgttccgctatcagaccgcccttgaaagcagccgtcaatctgccgttttcgttctgtaaattcggttaatttcctgatcaggtccgcttgatcgttcactaaaaaaacaagccgttcttccattgccagccgtcccgtttgcagcgtatacgccagtgaccgcagggaaaaaggttcatcagactgcttctctaagccggactgaccgaaaagaccggaaagaatattcttatgtttctcatcgtttgtcagacattctgctaaagtccggacggaagtatgctgtatgagatcagtcatgtctattgccagcccgtattgatccgtcagccgctcagaaaactgtgtcagctgcatgacatccaagccgaattccttccaatcctgttcaccatctaccgagccggcctctacatgcagaacttcggccagagcaccgcgcagcgcattttccagctgattttgcattgtatctattttgtcatgaagcggcccgcttccttcaagcgctttatctttgagaaacatcagcaggcgggcagcgtattccttcagccgctccggatttttcgctgatagaggcacgatatacggtctctcttgattctccgtaatgccggggtttttgggcctgtactcttctaaaatgagatgaacgtttgaacccgtcgccccgaatgaactgatgcctgcgcgtctcggacaggaatgttctctgccgttctctgtatacgccggctttttccatgactcggttttttgctgcacgtaaaatggcgagtcctctaaacggagatacggattaatcgtctctgagtgcaaagaagggacaagcgttttgtgaaacagctgcaaaaccgttttatgaagcccgctgattccggcggctgattccgcatgtccgatattcgatttaacggaaccgatcgcacaaaattgccgatcctccgtaaacgtgcggtaagctttaacaagaccttgtatttcaatcggatctcctaaagaagttccggttccatgcgcttccacataagaaatcgtcctgggatcgatccccgtcttttcaagacattcggctatcatatccccctgcgccacggggctcggcacggtaatcccgctgacggttcccacgtgattgacggcgctgccttttatcaccgcataaatatgatccttatcttcttcggctttgtgaagcggcttcagcagcacggccccgatgccgtcagctgagacatagcctgtgccgccttcgccgaacgtgcggcacagcccgtcactcgaatgcatatccatcaagccgtatgtgatatattttgtcgggtgcaatgataaattgacgcctccggcaagagctgcttcacattcaccgcgtctcagactttccgccgccatatggacggccgtcagagatgacgaacacaccgtgtcaaccgccatgctcggcccgtgaaaattgcagaaatatgaaacccggtttgcgatcggcgcatagttcaagggataaggaaagaccagccctttggccgcagcttcagcgccggcgagagaataatccatatgcatcaccccggcaaacacaccgacgttcattctcttattcggccctttcggctgaacgattgtttccggggtgtagcccgcatcctcaatcgtttcccagcatgtttctaaaaacaatcgttcttgcggatctttagcttctgcctcccgcggagaaatccggaaaaatttcgcatcaaaacaatccggatcgtctataaaaccgccccatttggaaatcggcttgccggacggcgatcgcaaatgctcatatttcctcgtatcccagcgggaacgaggcacttccgttacgctgttttctccattttttaaatttgtccagaattcacgaagatttttggcgccggggtaccgtcccgccatcccgacgatcgcaatatctccattctgcgttccggctgacgccgattttttcacacggatttgggtcgtcctctttttttccctgtgcaaaggttcagcatttgaatgcccgctttgagcatggccgaagccggctccgtaatgttcgcacaaatatcccgccaattccgtgattgtcgtgtattcaaataacagcgtcggcagaagctgcgttccgatttttcgttcaatttcctttaccatgtccaacagccccggagaatccagccccatttcatagtagccgatatccgggtcgatctctttcacaggtttgttcaatcgggcggcaagcaattcttttaaataaaggatgcactgttcagtaaggccggcggaagacgccgcagatcggggctcggaaggcgccggttccgcttgcagagccgggacggcattccgcccgtcaggttctttcttttgccgtttctgattaatcagttccgggtccctcacccgtttattggcgaagtttttcagttcgccgacttttctgccttcctcattgaaaaactccattgtcacgtaaacgagatctttcttacgggtgacggattctttttttatcttggtgatacatgtcgtctgcagcaattcggcgcaataaaacgattcataaaacagcggcagaaataattgcccctcctccctcgtcaaaggagcgagatatacattggagccgatgctgctcgcatctatcaatgcgggatgaaacatcgcctcttctgcatgttccagctgatccttttgcaccgacagatcaatataaatctctttttcagtctggtagacgcttccgcagcctttcatcattcctgaatgaaccagttcttgatccctgcattccgcgtaaatgtcctcaagcggtatttctgccgccgtttgttttacggcatccatccggacgctctcttggaagccggcgggcttgacggaatgcatttgcgccgcggcatatatctttgtctctgctgcttcgtcaccttgtttttgccctttcacctctaccttccattgcccttcgccgttctctgtacagtcaacggaaagcaggattgtttctccctgttcaggagctaaagggtgaaaaatcgataagtgcctgagttcaaggccggcatgaaaaaaaccgttttctctgaaagtctgatagatcaggtcaatataagccagacccggcagcagttcctttccataggctttatgatgtttcagaacgggatgctgattgttaataagaagctgctcttgcatatgaacttcctccatatcgacgttcaattttcagcgcaatcagtaagtcttcatttgtttccaaaacgtattcgggcgggactcatgtgcgttttcatgcaggttttcaactttgtccgaacggatgggccggcgttttaattcctgtctcggcaaaggctttctaaccggggtgtacgcctcctgctcccaggcttccactatgacatgggcattcgtccctccgtcagcgaagctgctgacggcggcaatccgcggtgaatccgtccattcacgcagcgcgtgcgaaaaataaaacggcgaggcggacagatcgtaatgcgtcatcggctctttgcccgaaaggaaaggcacacgcattcggcgcgaaagcataagcactgttttaatgaatccggcaatcccttcagcgcataacgggtgtccgatattcggcttcatcgaccccaattcgcaaggcgcgctgttttgcatacggtacaccgcttcaatcgccctcagttccaaaaggtctgttacttcagagcctgaaccgtttgcttcaatgtagctgatatcctccgcttttctgccgcttttggcaagcgccttggccatcacttctttctgcgcctgtatattcggtgtggcaggccccgcggttctgccgtcattgtttacggaaatgcctttaatgaccgcatgaatccggtccccgtcttttacagcctgggccgctgtttttaaatacaccattccgacgccttctcccaatacgatgccgccggtgcggcggtcaaaaatatgaaacgcaggctcttcgcttaacagattgcgaagttcgaacatccggtgggtttgaccggattccagcagactgactcccccgaccaccgctgagtcgatttcaccgcaagaaagcgcctgtatcgccatattcataccgacaagcgctgaagaacaggccgtatccaaaacaagactcggccccttcaaatcaaaaaactgagaaagattggccgccaagtaattcgggccggcggcgactatcggattttttgcatgcttcagacggttttcgtcaggcatactgccgccgcgtcctcctaaatagacaccggctgacctgcctttcatttcttgtaaagagtaaccgctgtctctgaacagatgaagcgcctcttctaatataagaaaggactggatatccattgccttgatgtcttcttcgggaataaggaaaaactccgggtcaaaatgcgttacattttttaaaaggcccgcataatccgccttctccgttttccagcgttctttcggcaccctttgaatagccgacgtcccttcagacagcagcttccaataagcttcaattgattcagctccaggaaaacggcaggacattccgacaacagcgatgtcttgcgccgctgcagcgccagaaggctgaatgacagcggctgctgtttgtttgggaacgtccgggattacaggctgaaccggttttgaaacggcatctttgatttccggatatgccgtttcaagccatccctccagcgcagcaaccgtagggtattcatacagcaccgccgggtcaaggtcagctttgatcctctttccgatcgctctggacacttgggcaagcatgatggaatcggctccgtaatcttgaaacggtgtatcagattcaaatcttgacggctccagtcttaattcccggcagcaaatgcccgtcagccactcctctacgctttctgtctcaccctgtacatgctgctttgtttcggtaaggccggttgaaagcatcagacggtcgggctcccatttttccgggtgaatgacggccggcataataacagatccgcaatcgcctgccataacggcatcaaacagactcagcccttctctgtcagtgatgctctttaaaccgcttttcagataggcccggctttttgattcgcccatacccgtttctttccagctcggccattggatgctcagcaccggaaaaccttttgcggccgcaaaataatccatataggcgttagccatggcataatcgctttgtcccgctcctaattccggcatcacgccggacactgaagaaaacagcgcaaaaaaccggagaggctccttgtgcagcgcttgatacaaaaggtccagcccgtctgttttaggttcaagcacgggcatcatctgttctctcgttttgcggataaaggctggatgatcgagatctacggctcccgctgcgtgtatcacgcctcctatcggccccatcttctctttcacccggctgacggcctgctcatattcagggccggaagatacagacagcacttccgttcggacacctttttgttcgagctctctgattcttctcactttatcggaaaacggggaattccgtttgatatgatcatcccactccgctttcggaggcattgtttcttttccggtaagcacgagtttcgtgactccgtaacgttcggcaaaatgccgggcgaataaatatccgagtccccgggtccctccggtgatccagagcacatggtctttcggaaatgaaaattctttttcagctaagctgtttgtttcctttaaccgcgcgtgatagcgcacatcgtttcggtaacacacttcgatgtctgcagaatcgcgaaaaaactcctctgcgatctggtttgccagctcgggatcttcggcagtccgttctgcatccatatgccgcgagcggatatccttatactcactttggagcatccggtacaatccggccttttttgcacctgaaagatttatcgtttcatttgcaaaaggttcaagcccctttgtcacacaaagcagctgaagctttcggccgcggtttctgttgtcaatgagacactgcagacgatgaatccagccgtcatcatgcttgatttccgtcccgcaccccgtcacatcaatcagaccgccaaaccgggccgcgtccccggatatttccggtgatgcagcgtcaatgatttcagactcggggaaataacgggacagctcaacggccaaatttcctgtctggtgatcagcagctattccgatgacgccccgcacttccttaaccggaacacggctgctttctgcccagcttttctgtaaaaagcggaattcacgaaatgtttcagaatgtgtttcagcatcacgaacattgtccggcgctgcatcgcccggccaataacgatcctttataaatggataaccaggaaggctgacgcgatgcggcaggctgccgttataaagctctgaccaatcaatcttcagcccttttacccaaagttccagaagctttgcgaatttttttcttttcatccatttacggacggcttcctgcatatcttcatccttaaaaacggctagaatatctttatactgtttgctttttcccctgaagcagccgtctgttccgccgtcaataaaacgctgcagtttttccgctaactgctctgtcgacgtcacgataaacgccgcacgttcttccatcgcttctcttccggtttgaagggtgtaagccgcatcccggaggctgcggtctgtgacgtcattttttctgatcgcttgaagaagctgctgcgcccgctgcttcaggctggcctcctgtttggcggataataaaatgactgcgggatcttcatctgtgaatggctcagaaatctccctatcaggttcaatatattcttctatcaatatgtgggcatttgccccgcccgcgccaaaagaagagattcccgcgattctcggaatctctttctgcgctccgttttcctcaatgaccggccgtttccagtctgccaattcacgctgcaccgcaaacggcgtccggtcaaatgcaatattcggattcaattttcggcaatgtaatgaaggggccagctttcgtttctgaaactggagcagcagttttgttacaccggcgatgcctgccgcggcttccaaatgcccgatattggatttaactgagctgatggcgcaaaagcctttatctgacgttttcatttgaaatgcgcgggtcaaaccgtcaatttcgatcggatctccgagttcagtgcccgtgccgtgggcttcgatacagctgatcatccgcggatgtattcctgatttttcaagcgcgccggaaatcacgtcagcctgggcgctcggactcggcactgtatacccgtttgttctgccgccgtgattgatatgagtgccgcgaatcaccccgtaaatatggtccttatcagccatcgcttttgacagcggctttaacagcacggccccgacgccttccccgggaacaaatccgtccccgccttcaccgaaacttttgcacgttccgtcttttgaaagcattcgataggcgctgagctccgcataagccgaaggatgcgtatacacattcacaccgccggcaatcgccatgtcacattcgccgcgaaggatgttttcacacgcttcatgaattgcagtcagcgaagacgagcacatcgtgtcgaccggcatgctcggccctttcagattaagaaaataggaaactctgttggccgctgaactgaacgacgttttcggctgcagggtgccgccgtttttccagtacattccgtacccgtttttcgtaatgcccgcaaaaacgccgacccggccgttatacagattctcaagctgttccttcgtataaccggcatcctccagcacctgccagcacatttcaataaagagacgctcctgcgggtccatattcaaagcatcacggggtgaaatttgaaaaaacagcggatcaaagaaagcggcatctttcagaaacccgccccgcttactgtaacttttccctgctttcacggccgcttcgggatcagggttgtagtatttctccttttcccagcgctcttcgggaatttccgtcacacagtcttttccggccgctaagttatcccagtactcttcaagtgtttcagcttgcggataacgtccgctgacgccgataatcgcaatcccttcttttgtctgtttctcattggaaaaagcaggccgtttctttcgcttgataaacgacggaagcaccggaaaatcttcatttgccaaaacctgttctgatatgcctgaacggtgctcatcatcatttgtccattttcggcattctttcggataatccgtgacaaagtgagctgccagggagcccagtgtcttatattcgtaaaaaaccgttttggaaaggtcaccgaaaagcagagacaattcgcggttcaatttcgtcacagtgacggagtcgattccgtaagtttccagcggctcttcagtatctatgttggaaacagcaatttttgcagtcaggccaaaaagcgttttgagctgaagaagcgtttgttcatacaaacgttcactgcggtgttcggtattggtttttccggaagcgcccgtcttgatgacaggctgcagcttcaaccccgacagggaagcccatatttttccttcttcatcacataaatcaatataaaagctccccgccttctcttgtatctcggcccataccttgtcaggacaagattcataaaacaaaagctcgtccaatgaaaccggggcgagcgttttatattctttgccgccaagcagcgcgcatgcctctgtcacactttgcatcacacagggagggaggccgaatcgggcggattctttttggtctgtcaacggaattgaaatgtctgccagcatccgtcctgctgaggcgtaaatacgctcaattcctttcatgtgctcactgtattgaacggtatcgttctgagtgatggcttcaatttgctgcttatccatcagggaaccgctgttttccttcaagcggctgatatccagcatgccgggcgcagcatcaactggctgaatcgtcccttggctgtacacatcataatgactggaatcagcagaaaatggattataaatctcaaaccttttggcttcaccctctgcgggtatcagcctgatctcgatatggaacggctcagcctcagtcaaaatgggctttgaccacacgatatgcgtcagccggacagccgcagtctcctttactgtcaaaacagccgcagctctcgccatttccaaaagaagttctccgggcataagctttttatgctgtaaagaaacatcagcgagaaaaaattcccggccgctgaaagctgccgagaatccctgtcccgtttcatcgaaaatatgctgctgagcaagcggatgaagggaatccgcttggcgaagtcccatccgcatatcataatcgcgcaaaatgccgatcgcatcctgttttgtcatttttttatttttgacgtcagaaaaaacccggtgcagaaactctttcatatggtttcctccattacgctaatccctgtaaaaaccgatcgttctttttacagcggcttctatgcttatttcgtttttctccaattcatcaagcaggcgctcataagtctcaagcggggacgtatcagtctcgtaagtctcccggtgccttatatgctgcgcactgggcggtatccagcaatgtgttttcgcaaaaggatagacgggcaggctgacttttttcggtctttcgtccggatataatttattccagtcgacatgtaaaccttgcacccataattttgcaagcattgcatactttcctgcttcaatccattgatctacggccccgctcatttctgcgttgtccgtcatctctgtaaacagctgtttcatcgctttgttccggcctgtaaagaaattctgccccgtctccttgccgctgaggaaatcattcagcgcgttcgtaagctcttcttttgtttcagcaatgacggcaaggcgctcttccatttcatcccggccaagctgaagcgtataagcgatatccgcaagagctccgtcagctgaatgtgacttttccaaatatctgcgcagctgttccgcacgttccttcagctgttccgccgtctttgccgagagaatgaataaggacggctgaagttcaccggccgtccattgtttctcttcaacaggagaaacatattcttcgagcacgacatgagcattgacaccgccaaatccgaacgagctgacacccgctctccgcggcagttcatttccgctatcatcagtcgccgctttccacggctgagtgtcgcggacgaaataaaacgggcttccgtctaggctgatatacggattaacggtttcacaatgcagacttttaacgagcgttttgtgctgcatctgcaaaataatttttaaaagcccggccatgccggcggcaagctctgtgtggccgatattcgttttgacggaaccgaggccgcaatgaggctgctcgggtgccgttactccggctttctgataaagcgctgcaaaagccgctttgagtccgttgatttctatcggatctccgagcgccgttcccgtgccgtgggcttcaatataactcactgtacgggggtcgatgttcgcttgctgatacgcttttatcatgacttctgtctgcgctttcggattcggcgatgtaagggaagccgcccttccgccatgattttccgccgttccgcggataacggcataaatacggtcgccgtcacgttccgcatcggataatgttttcaaaacaatcatgccggcaccttcagctctgacatacccgtccgcttgatcagaaaatgttttgcagcgcccgtcttcactgagcattcctgctttattaaagctgatatgcatatccggcgacacaatagcattgacgcctcctgcaatcgcgatgccgcagtctccggcctgaattgccctgaccgcacggtgaacagcgaccaatgagcttgaacaggcggtttcaatcggttcgctcggcccatgtatattcagaaaatagctcatgcggttcggaccgattgacggaaccgtcccggcggcggaagaaccctcaatctctatatggaactttgaagcttcctgggcgtaaccgctgtttgccgtgcctgcaaaaatgcctgtatttgtacctgacaggcttttggcagagcagccggcatcttcaatcgctttccatacatgcatcattaaaagtctttgctgaggatccatcatttcggcttcatgcggagaaataccgaaaaataatggatcaaattgagcggtttcatcaatgaagccgccccactttacattgctcgcatttttatctttctgcgggtctccgtaatactgtctccagtcccagcgccccggcggtatttcagaaatgcagtctttttctccggctaaattctcccaaaacatttccggattttcagccattggaaatgcacagctgattccgattatcgccacgggctcttcaggtgcagctgcggtttttgttttaggaaggcgggacggaatcgagaatggctccgtcttcatttttttacgctcaaccggtttctccgtttctgtttcttcctgtgagccgaatgtatccggatgttccgtcagcaagtattgggcaaaactaaagactgtcgggtattcaaaaaacacggccggcgtcagttcaagcccatacattttatttagttcatttgcaaactgcgtgaatgaaaccgaatcaaatccataatctctcatctctgattcagcatctatttcttcttctttcaccttcagaatgcctgatatcatatgtttgagttccgtttgtactttatttggcagatggacgcgggtcttccttgacacatgaatgctacgggacggttccggcgcttcaggcatcaggttttttcgaatccgtttctcatcgccctctgccaccatgacctggtgttctccggaggcaaaagcggcgtaaagcgcctggatgcctgaggccgatcgcatggctttcattccggtctgttcatacatcagccgttcggtctctttgtccacgcgcataccgccttcttcccaaagcggccagttgacggacagggtctgcccgctccgcttgttgtcccgcacgagacgatttcggcgggctgcataaacatccataaatgcgttggctgccgcataaccggcctgtcccggatttcccatgcctcccgccaaggaagaaaacagaatgaaaaagtccagccgcacatctttcgctgcttcatcaagattgataagccctttcaccttcggcgccatgacggtcttccgttcgttttctgtctggttcagaatgtagttgtcggcgatcacgccggcgccgtgaatgatcccgtcgagtgttccgtgctcctcctgtatgccgcggacgagggcgatgaccgccgccctgtctgtcacgtcaaccggtttatacagtacgcgggcacccgtcgcttccaagcaccgtaagcgggcggagcggtctttatcaagcgcttccgcccttcccgttaatatgaggacggcgtttttgacgcgggaggctatttcttcagcgaaaatcagcccgatgccgcccgctcccccggtaaggaggtaaaccccttcgtctttccacggaacggcgccgctttgagaggccggcaggtgacgccagtttctgacgaaacgtttgccgccttcataaaggatttccgcttgttcaggatgcgcccggttttctttcagcttggcaagaagcgctgatgctgactcgtccggatcggcttggatgacttggccgtacagcttcggatgttcaaggtgagccgttttcagaaaagcggccagccccgccaatacattgtcttcccccctgtcggggacaagaagctggatcagcgttttttccttctgtttttctttgataagacgcttgacgatcgctgacagctccgccgtgcaggcgtcataacggtcttcaattggaccttcgccgtcagccgcacatacggcgccgcttatgtcttcagcgttcattccgccatacagcgttacgtatctgaaagactcttcttgtccgccgccttcatccggcggtgattcctgccactttggctgaagcaagagcggttttccctccgtttcctcctccagaaaacgggcggtgagccccgtcaatcggacacatacctcgccgttttcatcacacagctcaatatgataggcgccgtccgctgaggaaagcatcgcccacatcgtctcccggcacgcagaaaacacctgcatatcccggagggcaaacggcagaaacggccgtccggacgcggaaccgtctgagagcacgagaccgatagaagcctgaagggcggcgtccagcatgctcggatgcaggatgaacggctccttttcttcgcgggcggacggcggaagagtgagcttcgcgagcacttctccgcttcctgcatagacggcgtcaatcgcctgatgagacggtccgtaggtgatgccgagactgtcgaatgcttcatagcactcagcctttgacatgcgccggccgccgcagcgcgcctgaaccgcctccacatcgagtaccggagcacgctccgtctcttcgagcacggcctttccctggaaaaagacaagcggctcttccccttcggcatacgcttcaaaagcgatgtctccgttttcttccggctgaagctttacatgaagcgtcacgccttcagaaagcgccgtcaccgggcgaagccaaacgatctgtttgagccggacacccgctttcccgcccggcaagtcctcagcggcaagcgtaacggcggcccgggccatttctaaagcagccgcgcccggaagcaccggttttccattgacgatgtgatcggcaaaaaacggttcacgccctgaaaaaacagaagtaaagcgctgggcggtaaagatcgatgtattcgcgtggagcagcgggtgaagtctggctgctttctcactttgcgctgagcctgttttgtcaagtgacacatcagcttttgtgacccaatatcggtctttggcaaaagggtaagccgggagactgatgcggcccgggttgcgctgataaagagctgaccaatcgacgtcaagtcctttaacccaaaggtcaagcagctttccgtatttcccttttttcagccaggcatttatggtaagcgccatatcttcatcagaagtgagcgaagccgccaatgaatgatgtttggctgtcctgccccgccagatatgagcatgttcgatattatgatcgtttgagaaactcctaagcttcattttcagttcttctatcgactcggccgtaaatgcaagccgctcagccatcggttctcttcccgcctgaagcgtgtaagcgatcttggccaaatccccgtcagaacgtttttttcttatgacatcatccagaagctggcgggcgcgctctttcaattgctgctcatttcgtgctgataaaataataacagccggtttttgcggagaaacagacgcgttttccattggtttcaggctgtcagacggcacatattcctgaatgatgacatgcgcgtttgaacctcctgctccaaatgaggaaataccggcaattctcggatattctttcatttcacccgtgatatttaagacaggtcgtttccattccgtttctttttgctgtacgaaaaacggagtgtgctcaaactcaatattcggattcaattccgccgcatgcaatgaaggggcaatcctcttatgtttcaattggagaagcagtttggtgattcccgcaatcccggcagcgctttctaaatgtccgatatttgatttaattgaaccgatggaacaaaactgccggtcttctgttgtcaggcgaaaagctttcgttaacccgtcgatttcaatcggatcaccgagcgcagtgcccgttccgtgggcttccaagtaactgaccgttctcgggtgaatgtctgtccgtttcaacgtctctgcgatcagatcaaactgcgctttcggattcggcaccatataagcgtttgtcctgcctgctgcgttcagcatgcttcctttgataacgccgtaaatatgatcgccgtctttctccgcttgagcaagcggctttaacacaatcgcccctactccttcaccgtcaacaaaaccgtccgccctgtctccgaaagatttgcatttatcaccgggagacagcattgaaaaagcggacagccgctcatagtgagccggatcaacgataagattgactccgccggcaatcgctgtttcactcattccgctccgcaggctttctgcagcgagatggacagctgttaaagaagaagagcaggctgtatccactgccatactcggcccttggaaattgaacaaaaacgatactctgtttgcgatagaccagtcgctgggaactgtcgggtaattgctgttcatcacaccgacaaagactccgattttccggctgtcacatagcgtggccggggtgtaccccgcatcttcaatgcttgaataagcagtctgcagaaacaacctttcctgcgggtccatcctttcagcttccgcgggagatatacggaaaaacagcggatcaaatttatcaatgtcatcgaggaaaccgccccattttgaataaatggacccccattttccgcgttcctcgttataaaacgttttccagtcccagcgatctttcggcacttcagtaatagaatgcctgccggcttttacattttcccacagctcatcaacgtgatcggcgcccggataccggcctgacagaccgatgacagcgatatcctggatatagggatctccgtttgtcctgctgccttcctcgttttgaggaattacattcaggttatctgtgtgatcagacagctgctcctcacgcacacccattgctttcataaatgctccccgctgagaaagaagcaggtaatccgcgatttcttctatcgtctgatattcaaaaaagagggtgctggtcatttggtcaaacacgttacgaaaagcatttgtaagcctgacgaccagaatagaatccaaaccgtatgcggttaaggaaaccgacggatccattctcccgctcggaatcttcagcgtttttcctattaattccgtcagatatgtgatgccccgttcccttacgtttggaatcggcgcggcgctttctgcgggagcctgcacccgttcggcgttttcaggatgagcccgtccattcccgaattgccgctcgagcgcttctttacgggaagacagaaagtaatcagcaagctcatcaatggtttgatattcaaaaaacaaagtgctgctgacagaaccgaagacgtcttttaacgcgttggtcagtctgacgaccagtatggaatccaatccgtatgcggttaaaggttcatgggataaaagacgatgcgccggcactttaagcgcttcaccgattaccttcttcatcagttcaacgcttttttctctcaagctgaaatgcaaggtatcatccgaaagaccatctgcgtcatacggacggcgctccggtttttcttctgacgcctgcgggagggcaagcctgaccgttccgtcactttcagccgctataatctgctggcccaagtcgtgtgcggcttcagccggaaacagaggatggacgaatccttcaagtgaaagcgcttccgcccagccggccggctcaacccccggacagcccggaatccgtaaatcatgatcctcatacagccaccagccttcaagaaggccgaatgtcacatggttaaatatggtgcggctgttgatctcatttataaacaactggccgtttttttgcagcattgctttcgcatggcgcagcgtagagcggatattttttgtcgcatgaagcacattggtcgcgatcactgcgtcatacgtgccgatgtccggcacttctgttgataccggctgctcagcgttgaatattttataagtgacataaggatattccggaccgaatatgtcttctgcatgtaaaagaaatgctttagaaatatccgtgaaacaatattcggcaatatgcgcttcatacggtttcaattttctcatgaccgcggcgctcgtcccgcccgttccggctccgatttctaaaatgcggattttcgcctgcgggtctttttccagacgttcccgcagaactgcaatcaatgtgtcagcaagcttgtcattgaaaaaatcagaaatgatattattgcggtaaataccttccacaagacggaaagaggagtctgggaacatcacttccgttgccggaagcttaccggttaaaatgtctggaagcacacgcaatgtctcttctgccaatctgacatgcgccctcatgtctttctggcgcagccaagtctcttttttccgctcccattcctcccacacctgccctaaatccgttttttccggagcaagcgctaattcagtcaggaagacaaagctctctttcagccatctgctgtattgttccgttatgccggcagccgattgaaataacggcaaagtctcatcaagccttgcgcccatctcataaagggttgatacaagtattttttcaatgagggattccatctctctcatgcagctcatgacatttgatgcttttacccgctcagcttcgtcattctgcgtgatgttaaccgctaattgtccgagtgcggaaggaatcttttccggataaaccgttacttgttctttcagatcatctttcataaaaaccggatctgtcgttttgatcagcgccagctggtcataaggtcccgaaagcagggtttccagcgttttcatcgcttcgggcgcctcaatagaagcgattccgtcccgctccatccgtttccggtattgttctgaagcgacaacgccgacacttccccaaaagccccaattgacaacctttacggcatacggcgctttttgtgagatccgcttagcaaaagcgtctttaaacgtgcacccggcggcataattgctctgtcccggcgctttttgaaacgacatcatcgaagagaaaaacagcaagaaatccagcggttccccttcagctacccgggcaatctgcaagctgacatcagtttttgcagaaagtgaagcgcggaactgctcctcttccatattggcaaaacttcggtctgataacacgatggcggaatgaatgattccgcgcacctttccatgttccttcacaatggtgtcatacgcccgcttgagagaatcataatccgcagcatccgcgctgaaatattgcggtgcggggcctaaagccgcaagtcttttcagctttctttcaatctgtgtatcttttttccgtctcccgatccagacaattttcgcctgataggtctgaatcatatattcagtccatacttctcctattccgcctgctccgccgataatcacataaaccccgccgtgccggtataatgaaggctcacctgcatgaggctggcagacggccaattgctggcggtgccactgacctgcacgaaagacccacggatttccctcggggtccgccggtaaagaaaaaacatcgggaagatgccggtctcccctttgagattccaaatcaagaagccggatgctccaattactgtattcttttgcgagcgaccccgctaatccgtgtatgcttgcatgactcggattgacctcatcatgttcatgaatcggctgtgcttgaaacgtgcagattgtcaatgatagttgttccgtgtcaaaattcagaagcagaagcgattttaccagccggaaaagctgcatgaccccgtgctcctgtccgtcggccgtatccgcatcataaacggatggaatcggatgatccggcgcagcccatatcatgtgttgaaaagagccttgcgctttcagtgtttcagccatttgttccgcgctgtccaaagaagtgatgtccggaaaacggacatcggaatacatctctttcaaagcctgctgaaaatccggcccgcccccgatgacgattattttttcttcacgcatgaaagacatgccggtttccggaatggtgacggtgttccaaaccggtgtcataagcaattccgtttcacggcttttcttcggcgtgacgccggctttttggttaaacccggcgctttcctgcacctcttttatgataaaatctttcactgccgccagcagcacgccgcgctcatcacaaatatgcagatcaaattggtgaacggaggcggcttttacctccgcatgcacaaatacggttttcgctaacggtttaagcagctgtatttctccgaaggaaaacggtacgataagcgcaggctctttttgaaattgcagcacatgcgccattgcggtttgaacagcgccatccattaaggacgggtgcaggatgtactgtttaaaatcggcttccaagtgtgacgggagcgttaatttggccagtgctttcctttctgtataagagaattcgcggatgacctgaaaactgtccttttgcacgattcccgccgcagagaacgagtgatagatgtctttcggctccgttctctgcacaaatggcgccggaagctgaaagaccgaggcctcaaaaggcgctcctttttctttacaaatcacttctccttgcgaaaagagagtgccggccgctcctttttccttaatgacatagcttatacgctctttttccgcttcaaactctatcatgacggatcttgggtctgtccctgtcacaatcggctccatgtaccacacattttggagagagacggccggacgttctccccacaatgccgcgccgtatgccgccatttccagatgacagactccggggagcacatatttttcgttcactaaatgatctttaaagaaatattcatccttggaaaatatcttttgaaacgtccctttccgggcggatgaaacattctcatcaagcagcggatgcagcgcttcacgccttttgatagattggggctttttcgtataccgctttttttgatcggtcagccaggacgtttcctttaaaaacggatacgtaggaagcggaactttctgatacggcgtctccggctttttgaaaccttgaaggcctttgacccacagcgcggcaaatttttcaggatctgaaacggattggcctgaaacgtccggccgcccgggtgacgcttttccgaagtaaatatgcctgccgtcactgtggccgctgacaaagccgtccaatcgctgtttcagctcggaaagagatgacgcaatgacagcaagccggaaggagaaaggctctctgcctgacaatagggtggcagcgatattttccaggctgtatccgccggcagaaggcgagttttccaatcgggcaagaaaggagctcaatttcccggcatattctttcagctgctgttcggaatgtgcgcttagtacgacggcatgcggtttttgctcagtattcccgtccgcttgccgttttggctgataagcacctacgatcagatgggcattagagcctcctgcgccgaacgaactgattgcggcgattctcggtttatctccttcagccggccacgggcggttgtttcggacaacataaaatggcgaatcagaaaaagaaatcttgcggttcagttcctcggcgtgcagactggcgggaagcgtttcatgtttcatgcttaaaagcaccttgattaaaccggcgatccctgcagccgcttccaaatgtccgatattggatttcaccgagccgattccgcagtcatttttctcatcggcctgtttctcaaatgccatagacagaccgcgtatctcaatcggatcgccgagtgccgtgccggtaccgtgagcttcaatgtagctgatatccgccggacttaccgcggctctgtttatagcggataaaatcaggtcccggtgcgcttccggattcggcaccgtatacccggtcgttttgccgccgtggttagtggcggaccccttaatgacaccgtagatgtggtcgttgtccgcaatcgcttttttcaatggttttaacaaaacggctcccgcgccttcgccgggcacgtaaccgtctccgccttcaccgaaactgcggcattttccttcagaagacagaaaatgcgattggcttaaaaacatgtatttttgcggatgtaagctgaggttgacgcctccggccagcgccatttcacagtcgcccgacataatggcctgacaagcctgatggacggcgacaagcgatgaagaacacgccgtatcaacagcgatactcggtccatggagatcaaggaaataagaaacccggttcggaatcccccaatataaggagccggggcctttatactgatctttgaggaaaccttcttcgtgtgcaattaatgaatattcattccaggtcactccggcgaatacaccgatttgatccgtcggcctcgccgccgggttcccgtaaccggcatcctccatcgcttcccagcagcacgtgacatacagtttttgctgagggtccattaaatcagcttcccacggggaaacagaaaaaaacagcgggtcaaatcgatccggacgatcaataaaacctccccatttactgtatgacgcgtattctgccgttttctcttccgagtaataagagctgtcccatctgtcctcagggatttcggagacacaatctttattttccattaaattgtcccaaaaatcatgctggttttccgctttcggaaacatcccgctcattccgataaccgcaatatcagaactcctgtccgttcccggttcgggcaccttttcagccgcctgtacaggaagcacttcttcctgccggcttcccgtatcaggctccgtttctttgaattcaagaacgctttcgggatttcgtttctgcgtacttaaaaactcactcaatttctcaatgttcggatattcaaacagcagcgtttcagaaaggccggtaaattctttatgcaatatggtcatgatttcttcactgatgagagacgtcacgccaagagtaaaaaaagcggttttatcttctgcttcggtcacctcggcacccagcttttccgctattaccgttcttaaaaattcgttaatacatttcatgaggataccatcccttgtacaaaagaatttttctgtgctttaacaagttaatccgccgtctatcgccattgtctgtccggtcataaaggacgattcaggagaaagcaggaaacgaacgagtccggtcatatcgtctgtttcgcctaaacgccccatcggcgtccttctgataatctgcgatttttgtttttccggcatatttttcgtcatatcggtgtccacaaaaccgggcgcaagtgaattgacacggattcctttggacccgagctccctggccagacttcgcgtcaagccgtcaagagccgctttggatgcgctgtagactgaagtgcctttaaatcctcttgaaccgataatggagcttatgttaacgattgatccggaattttgtttcagcatgacccgggaaacgtttcgggtcagcttgatgactgaaccgatattcagattgaggatgcggtcaatgtcttcatcattggtcaggggcagcagctgatcaaggttcaaaccggcgttattgaccaagccgtctattctggaaaacttgcggtatacttgaagaacaaactgtttcatggcggcatcatccgccgcatccgccgcttcccaataaaagcggtcacggtacttttcactctctctcaatgtgttaataaaatcagattcactgcggctgaaagcggctactttgtaattctcatccaaaagcgcctgtacaatcgcttttccgagcccccggctacctccgctgacgaccgctacttttccgttattcatatttgcctcctgttttacacgtttcttatttttttaaatcggtcattagacagtttccgatctgtaacagagatgatctgcggtatctgatatggctgcagcttctgtctgcaatgagctacggcccgctttctgaaagatttgatatcttcctctttttcaagcacggcctctgccgcgacaatctcgcccgtaatcggattttttcggcccgttatgagaacatcccggacattcggtatctccagaaagacgctttccacctctgccggaaacactttctctccgcccacattaataatttcactctttcttccgagaattcttatatattcgccgtctgtttccacctggtcaccggtgtcgtaccagccgtcttcatcgaaaggtgagggtgcgtttaaatagccgagcatcgccgactcagaacggacccaaagcgtgcctccggtaattttggtctctgttccggcaccgcctactttcatccaagtggattggctgtcttttgatttcgttgagaatatacccaattcagttaatccgtatgtttgtttcagccgtacatccggaaacagccggtgaatgccgcgcagcgttgattggggcatcggttctgtgccgtaagtgatcagctggagtgaagacaggttatagccggcatccgccttggacatcagcagcatgtttaaaaaggtcggggtggcggggagcacttggacagcatgtttgtcgaccgcctgataaacggactccggcgttctgctgtctgatgtgacgatcgttcccccgttaaacagaatcgcaaacagcgtattaatgccgcctatatgatccaatttcagaaaaatgagcgtacgcagcggttttctcttcgccgttttgtatttttcaagcagccggccggcgcttaacacggatgctttgcttttgccggaggttcccgatgtgaaaataataatgcctgactcccctctctctcgcaggtcatcaagcagagggtgagaggcgctttcagaaccttcacgaagcgtccagctgtcattttcatttatttcaatgatttgattcactttcgcgtcttcaaacatatcaagatgcttttcccttgattcattgctgagagggacaacgatatttcggtttaacaaaagcgccatcagcaaaaaaatggcgttcggggaataatccccgataagcgccacacattctccttcacgtattccgttttgttcaagttctttctgaaaaaagctgattcgtgtcagcaaatcatcatacgtaaaagtctgccctttaaaaatgagaaactcactgtcctgcgtttccctaagcttatcagtcacccagctgatatctcccctgctttctgttttcatgattgagcactgtccatatatttttgataaatatcacaaatgctgccgacggttgtaatgctggaaatcgtttctccttgggaaaaaggatctactccggtttccatctccatctgtgcgactaattgagcgatatccagtgatgagaagcccagatcctctatgactctcacatcatctcccgcttcgacggcccgatatgactgctgttcttgaatatcctgaatgatttgagcaatgatctgcttcatttccttggtttgttccatttgctttcagctccattctttattttataaacttctgatgacccgtttataatccggaatatgatcttgtgaagaggtcggcaccgccagcagcttatccaccttggaaatggccagcaatgtatgattccttttcatatagacttcaatctgatagctgattttcgccactgagatcataccgagggactcaccgtgaaagtcgggatcgcattcttcaatgtgtcccgtcatataaatatcaagctcttcatctgcaaaacaatttccgtaataatacgtctctctttcaagcaaaaataaatgccgcgcgattgaaaccggaaaacccggcttcgatcggcgcgtcaaccactcaaattccgccgcatccattatcttgctgaatttcgcaaacaccatggcatgccccggcgcagcatcctgatcaacaggaacccgatatgaaacggggtccgctgttttgaggttgcccggcttcataccgaaagcgtccgttctgattttctttgaccgcatcagcgcgtaaggcggcttggctaacttagaaagttccgcaatgcattcagccttaggcgctgagactttgcgggtcgaaccttctgtttgtgtgacgtcgacgactattaaactattggctttcatagaaggaaaccgtccccggtcccactcgcttttatcagagctgaccgctcctttcggcccgaacaaataatcagattctaatatggtttctccaaaccgggagatatcgactccgacggaaacctcgtcccataatcggtactgatcaagaggctgatctgaaggaactttgagatgtgtcataaaataagccggatacaaaatcagcccttggtgatcggccatctgatcaggccggaatcccgttccgtccgttaaatggtgactgtgtgcgttgccgaataacagcagcagcgcgtactcattcaaattccctaatccgacatggctcatcgttaattcatgattttcaatcagcatggtagtcctccgcagaaaaaatgtaatgtctggtcatactcagcctgtaatcgataccagcctttgcgccagaaggccggctgtttcttccatgagctgtttgccgatcaagtcgacatgcctgtttctccaattttcaagcggggttcctttcacccattgattaaacgcgccgagtgcagggccgcaatgaatttggtaatctattttactttcgctttttccttccagagcgagcctcgtcgtatgggaaaaataccatttaaataccatcgccattttgtgtttcggattctgttcggctttggcgatctgttcaggagatttatcacgtttcaactgctcatacacttcctcaaaactgcgctggaaatacttatcttcaattaatgttttcgttttttcatctatttcatctaaagaattgtattgtctgtacaagtcaaagagtttattggctcttgccggaaaaaacaggccttttttcagcacctgcacccttgcccccgcttcaaacatgtctcccgcgggagcgtatgacgtatcctgcacgttcgcttcctgaagcagatctttcactgaatcacttgtcccggcttcgaccgtgcattgattaatagaaccggttccgataaattcggcgccgagcagaaacgcggcagcagccgcttccggagtgccgatgccgcccgctgccccgattcttacttttttcgcatacccgtgcttctccatcatgcggtctctgagtctgatcatggcaggcattaatgtatacggaatcccttggtcggtatgccctcctgaatccgcttcaacgcaaatgtcatcagccatcggaatttcttttgcaagcgccgcttccccggctgtcagccgattgtcagacacaagtctttccagcacatgagccggagccggattcagaaaggcctcagcgacttcaggccgggatactttcgcgatgattctgttttgaactgacaccgacccgtcatgattcctgcttaatccttttgccctgtatatcacgagagccggggttatgcccataaatgccgatgcttcaataagatgaatgccgtttttcaaatataaatctatcattctgacttccttgtcaggtgacatcatatgatgaagaagattcattccgaatgtttccccttgccgcagtgcagaccggatggttccgatggcctgtccgatccgttcgatactcaatccgcccgttccgaaaaagcctagcattcccgcttttgccgctttaatgaccatctgttccgaagcaattcccctgtacatggagcccgtcatgtaagcatattggatgttataatcttttttaaaatcttcgttccctaatctcattcccgccgttttttgtgaatcagctgccgatgctttaacatcagcagtatcagactcttctttcggcattggtaatgggacggcatcttttttaatctgccgcgtcagttttgtcagcacttccccgggcccgacttctgcaatttcattattttcaagccccatcagacggcgtatcgtgtccgtccactttacctgattggtcatttgcaaagtcagatttgttttgatttcatcattcttataaggtgcggcatgaagatttgagatcaccggaaaacgaagaggcaaaaacgccgtttcttctaaataatccgcgaactctttttcagcatctttcatatagcgggaatggaaggcgccgctcacatttaaaggaagatacattctcacgccggctttttcaaagacggggcccgctttttcaatgtcttgtttcgttccggcgatcacaatttgagaaggtgaattgtggttagcgatatcaatgccggtcagatgataatcggatagaacctcttttacttgttcagccgtaaaccccaaaaccgccgccatgcctccgggagctgccttgctcatgagctcccctctttttttcacaagctgcaaaccggtcttaaaatcaaagcagccggccgcaaataacgcattatattctcctaaactgtgccctgcggcgtaatcgggctctctgccggactctttaatcttctttaaataactgagtgcacttaccgtatataacgccggctgggtaaattgcgttttccccagctgatgactcggatcctccagacacaattcttctatagagtagcctaatatgtcatcagcctgacgtgtcagatcttgaaattcatcaaacagcccggctcccattcctttaaattgagaaccctgccccgggaacacaaacgtaagcatcttatcctcatcctttccgcatcgtcaatttgaatatcacatgtggttctcaatgcaaaaacgtctcgctcatttcatatattgactggtgtaaacaccgccataaaaataaaaacacaaacgcgtttgcgattcagcacaggtttaaaaatcgcaaacgcattgtgttttccttttctaacataatttatataaagacatcttgcttgtttacagaatgtttcgcatgacaagctgcagtgccaatatgcccgaaaacagccatgacggcacacttctcccttatcatgtatatgtagatatatacactgcaatcatttttataatccctatttcctcttcaacgtgccgaaacagcgattgaaatttaataggtgctttactttaatttaataaatttaacaaatagttgctatttaaagagaataatatcaatttatagataataatgtcaaggctttatttcgttattttctgacatttattccacagttttatgttcggtggacagtcggcataattgtttcgggataaatgtcagataattccctgaacccttttcatgtcaaagaaaattcatcacctctctgtcaattgggtctatacttatttttcattttcatatattatgtaaaaaaaagacgaattagaaaattttttaatcactttaaatactatccattaaatactttctttgtataataatttcttattattctaaggaggatccagtcatgaaatggtacgcactttttgtagagtcgggaaaagaagaagcagttcaaaaatttctgcgtctgcagtttgatgagcaggctctctactcaatcatacccaagaaaaaagtcacagaacgaaaagccggaatcaaatacgaggcactcaaaaagatgtttccgggatatgttctgtttaaaacaaagatgacagagcggacatttcataaaatcaaagaactccccatttcatgcagaatcgtgaataacggcgcatattattccaaagagcgtaaaacctatttcacgacaattaaggatgaagaaatcctccctattatcaggctgatcggagaaggagacactgtagattattcaaaagtctatattgaaaattcaaaagtaaccgttgcctcagggcctcttaaaggaatggaaggcattattaaaaagatcgataaaagaaaaagacgcgccaaaatctgcctgtcttttatgggactggacaaaatggtcaacgtcggaattgaagtgctctccaaaccctagcatttcaaaaaaagcatcaacagcatgtgccgttgatgccctttttatataaacagacgaaagcccgacatcaaaataaccccgctcaccaccgtcacggtcaaatttttgttttcaaggcatagttgacctgaagccgggctgcgcctatgagacaaaatcacatttaggggaatccattttaatcaagagcggtgaattgacggttgagcttcatgacgaaaaccatgtgctgacttcgggcggtgccgcacaattattttcattcctcggatgaaccggtgacatattttatgctggtctattatcctgaaccggcttaaacgcatatcaggcttcttcagacagaagcctgatggaccgcaacccattcttgtatgcattgaatcagtttctggacagaaggtgtctgcgtctcctttgcatgagctgtcaaaatgccgagctgcctggagacataccggtcgaaccgtttgatgagcacatcacaatcattcaccaaaagctgcggcaggatgctgatccccagattgttccgcaccattgcaattatcgcttcatcccctctgatttgataagcgacccgcggtgtgatcttttcttccttcagcactttcagcacatcaaaatgtgtctccggataaggcacgatacatttgacggattccatgacatgtaacggaaccgtttcacattgcgccaattcatgctgcgggctcatcaccgctacaatcgggtcctcggccaacgggtaaaaatgccacttctcgctgtgggatgtcccgatcgccgcatcaatccggtcatctttcagccattgttccagctcagtagaatttccttcaaacaaatgcaccttaatagaaggatacagctcattaaattccctcaagattttcggcagccattttaccgccacgctcgtaacagtgccgagccggacttcccctctttctaacccattaatattatcaacggtttgagacagtttttcatagtttttttgaatttccttcataatatgtaacactttcaagccatttgcggtgggcctcactccatgccgctgtctgatcaaaagcggaaaaccgtactcttcctctaatttactgatcatttggctgatgttcggctgtgtgtaattcaatatggcagcggcctgggtcaggctgccgctttctaccgttttaataaaggctaaatgcttctttaaatccaaccggcttcatctcccagatatcattacttattatccaatgcattagttatatttagtttacttatacatcaatcaaaaataaaatggcaatgtctccatcattatacttaataacaaacagaaggtgagcgtttcagcatgagttttctcattcaattttttatcggcggcaccgttatggtggccgccgcgtatttaagcaagtcgaaatacttatttttatcaggcgttatcacattgctgccgatcatgacgttactgaatattcacttgcagctgaaaaatatgagccccgacgatttcagagcagctcaaaaaaacggaatattcggtgccttcggcgcagtgatcttcatcagcagtattttcatcctgacaaactggttcaaaggaggccacgcagtcatcggtgcgtttctcatctatatttgctatatgatcggctgtaaatgcctgttatgaagatacggccacgctgtgtataaaaaaatgcccgtccagaacaataagaacgatctgttcagttgtgagcagtttatatgactgaatgatcatgagttgttataatcaatgtctaaaaacattccgggaggcgaaataaatggcgagaaaattattcacaccatggaccgttaaagatgtaacgatcaaaaaccgtattgttatggcaccgatgtgcatgtattcctcacatgagaaggacggaaaactgcagccttttcatatggcgcactacatatcgcgtgcaatcggacaggtcggcctgattatcgtggaagcgacagccgttaatcctcaggggcgcatttccgatcaggatttgggcatttggagcgatgatcatatcgaaggttttgccaaactgacggaacaagtgaaagcgcaaggatctaaaatcggcattcagctggcgcacgccggacgtaaagctgagcttgagggagacatttacgctccgtcagccattccgttcgatgagcagtccaaaacaccggctgaaatgacgacagaacaaattaaagaaaccattcaggaattcaaacaggcagcggcgcgcgcgaaagaagccggctttgacattattgaacttcatgccgcacacggctacttaatgcacgaatttttgtcccctctgtccaatcaccgtacagacgaatacggaggctcacatgaaaatcgctaccgcttcttaggcgagaccattgaagccgtcaaggaagtctgggacggcccgttatttgtccgtatttctgcatcggattatacagacaaagggctggacattgcggatcatatcggttttgcgaagtggatgaaagaacagggagtcgacctcattgattgcagctcaggcgcactcgttcaagctgatattaacgtcttccccggctaccaagtgagcttcgcggagaaaatccgtgaacaggccgaaattgcaacaggcgccgtcggtttgataacgacgggaacaatggcggaagaaattctgcaaaacaaccgcgctgaccttatttttgtcgcgagagaacttctgcgcgatccgcactttgcaaggagtgcagcgaagcagctgaatactgaaataccgtcaccggtccaatacgacagagcatggtgatgaagtgacagccggagtttttcgatccggctgtctctttttttatttttcgagaaacgattgccgaagcttctccgtcttccctatagaaccaattagaggagatgactccaatgaaagcagcatggatggaaaggacatatctgattgacgggtgtccgttttatacgaaacaccgtaaaggcgccggcgaagtgacgatcgtctttgaagccggctacggcacttcttctgaaacatggacatcattactcgctgacatagatgaagaatttggggttttcacatatgacagagccggaatcggcaaaagcggacgaagccgaaacaagagaacggcggaccatatggtacaggaattaaacgctcttcttctgaaggccggcgtcaagcctccttaccttgtcgtctcgcattcatacggcacgattatcagcagactttgggcgagccggaaccgccgggatattctcgggatggtgctgcttgatccggtttctgaggatcaggagacgaaagtgcttccgcttcttcctgaagaaatgaaggccgcctatttgaaacagttcaaattggaaggatcacacgcggaatttttaacgagccttaggcagatccagcatcagcagattcacttcggcgatatgccgctgttgattttatcatcgggagagcgggatgagcgcttaaagcacactcatgaacaatgggtgaaactgcacagaagcatgcttgatgtctcttatcaaagcggatggattcaggccaaaaacagttctcatgccattcaccacgatgaaccgcacatcgtccaccttgccatttatgatgtttggtgcgcggtgcgccagcaaatgaatgctcctgcctatcaggcggtaaactgataaaacaaaagccattgtgcaacggcacaatggcttttgttatcgtgatctattttgtctcacgatgcaaagtatactttttcaaccggggtgaatactttttcatttctaaccggtccggattcgtccgtttgttcttcgtcgtgatataatttctgtcccctgtctctgtacaggccaatgtaacattcacacgcatcattttcaccccttatataaatcgtaattattacgttttattatatctcatcagaaaaaaatgtcaagcgtctattttttaagaccgctccacagtgacctccatgaagtcaaatgcgatcttactgttctcaaataccgctttcgcctcatgttcgagacgctctatcggcgattcaccctgataccttgcgctgatatgagttaagatcagctgtttggcgcctgctttttttgccgtttgcgcagcctgttctgtcgtcgcgtgataataattatgtgcgagctttgcatcttccttggcaaacgtcgcttcatgaacaagcacatccgcattgcgcgcaagctccgttacccgctctgatgccctcgtatccccggaaaaagcgacgattctcccttttttcggggattccagaaaatcccgcccgttaatgattctgccatcgtcaagtgtgaccgtttcgccttttttaagtttctgatagacgggtccgggcgggatattcatttctttcaatctgccggcctgcaatgcgccgggaatatccttttcctgaacccggtagccgaacgcttccacaccgtgaatgacggatgctgcggtaacaatgaattgctcatcttcaaaaaccgtcccctcttcgatttcatgtacggtaagaggatacgtcagatgagtcgccgtcacgttcaggcttgtttcgataaaggctttaatgccttttggcccgtaaatcgtcagctcttcttcaccgccctgaaatgaacggctccccaacagacccggaagaccgtaaacatggtcgccgtgaaggtgggtgatgaaaatcttttcaattttcctcggtttgattgttgtatgtaatatctgatgctgagtggcttctccgcaatcaaacagccatacggaacgcctttcttcaagaagcttcagcgcgacggacgttacgtttctcgtctttgccggcatgccggcccccgtccctaaaaataataattccacaatgcttcctcctagatctttgtactactaaggatacaggatcagactgaaaatgtgaattcacccgggccttctccggcctgattaatttttttccgcaaaccgcaaaaaacaggctgaaatgtttgctttcaacgaattttagatttaaaatgaaggaaatatgcggggttttaaaccatgcttcagataaagtgaggtactctaagtgaaaacaaacgacaaaccaaaagcagtaattgtaatatttggtgccacaggggatttggcaaaacgaaaactttacccatccattcaccgtttatataaaaatggtcaaattggtgaagagtttgcagttgtaggtgttggaagaagaccttggtcaaacgaggacctccgggaaacggttaaaacgtctgtttcttctgccgggcaaaaagacatagacgatttcacatctcatttttattaccatccgtttgatgtaacgaatccgggttcctatcaggagctgaatgtcctgcttgatcagcttgaacatacatatgaaatcccgaacaacagaatgttttacttggcgatggctcctgagtttttcggcacgatcgcaaaatcacttaaaaacgaaggtgtcacagcgacaaatggctggtcccgtctcgtcattgaaaaaccgttcggccatgatctgccgagtgcgaaagagcttaacaaagaaatacgcgaagctttcacggaagatcaaatttaccggatcgaccattacttaggcaaacaaatggttcaaaatatcgaagtcatccggtttgcgaatgcgctgtttgagccgctgtggaataaccgctacatctcaaacatccagattacgtcaagtgaagatctcggcgttgaagaccgtgcgagatattatgaaaaatcaggcgcactccgtgatatggttcaaaaccatattttacaaatggtcgctctcttggcaatggaaccgccgattaaactgaacacggaagaaatccgcagcgaaaaagtgaaggtgctgagagctctccgccctgtcgctccaaacgaagtgagtgacttcttcgtccgcggacaataccaagcgggaaagattgacggaaacgctgtaccgagctatacagatgaacaaaatgtagcaccggattccaatacggaaacattcgtgtccggaaagctgttaatcgataacttccgctgggccggcgttccgttttatatccgcacagggaaacggatgaaagaaaaatcaacgaaaatcgtcgttcaatttaaagacattccgatgaacctttattacggcaatgaaacgaatgtaaatccgaacctgcttgtcatccatattcagccggatgaaggcatcacactatatctgaacgctaaaaaattaggcggagccgctcatgctcagccgattaagctggattactgcagcaactgcagtgatgaaatgaacacaccggaagcctatgaaaaattaatccatgactgtctgctcggtgatgcgacaaactttgcccattgggacgaagtggcgctttcctggaatttcgtcgatgcgatttccgaaacgtgggcagccgacaaaaccctttctccgaattatgaagccgggtcaatgggaccgaaagcttcggacgatcttcttgaaaaagacggcctccactggtggaatatataagaaaaaattaaaaaaccgcggcgccgttcatgacggcccgcggtttttaatatcaggaaaagcccccgcaatcaatgcgggggcttcttcattacttcatccattcagtatggaaaatgccttctttatctgtgcgttcatacgtatgcgcgccgaagtaatcacgctgcgcttgaatcaagtttgcaggaagcactgccgtacggtagctgtcgtaatacgcaagtgcgcttgagaacgaaggtaccggcacgccttgggctacggcaagtgaaatcacttggcgaagggcgccttggtagctttctgcaatgtttttgaagtagctgtctaacagcaggttatcaagctccggttcacggtcatatgcgtctttgatcttttgcaggaacgccgcgcggatgatacagccgccgcggaagatcatcgcgatttcaccgtatttcagatcccagttatattcttcagacgcggctttcatttgggcgaagccttgtgcgtaagaacagattttactcatgaagagcgcttttctgaccgcttcaatcagctcttctttattttcagtgaccggcttaacgtctggtccggacagaaggccgcttgctttcacacgctcttctttcattgcggaaatgaaacgcgcaaaaacagattcagtgataatcggaagcggcacgcctaagtcaagagcgctttggcttgtccatttacccgttcctttttggccagctttatcaaggatgacgtcaacaagcggtttgcccgtttcttcatcttttttagtgaaaatatcagccgtgatttcgatcagatagctgtcaagctctcctttgttccactcagcgaatacttcgtgaagctcttcggcagacaatccgagcacctgtttcagaatgaaatatgactcagagatcagctgcatgtcaccgtattcgataccgttgtgcaccatttttacatagtgccccgctccgtccgggccgatgtatgtcgtacaagcttctccgtccactttagcagaaatggcttctaaaatcggttttacgagttcgtgcgcttccttttggccgcccggcataatagaaggccctttcagcgctccctcttcaccgcctgatacacccgttccgataaagtgaatgccgctttcggcaagctctttgttccggcgctgtgtatctttatagtatgtatttccgccgtcaatcaaaatatcgtctttttccagatgaggaagaagagattgaatcgtcgcatccgttgcagttcccgctttaaccattaataaaattttacggggtgtttcaagagactggacaaactcctcaatgctgtatgtaccgacaacatttttgccttttgcctcttctaaaaactcttccgttttgctgcttgatctgttgtatacagacacagaaaatccccggctttcgatgttaagagccagatttttacccattaccgcaagaccgataactccgatttgttgttttgacatattctaacgtcccttcttcaaacgtttaaccattttaaaatttaaattaaaataaaatgatatttatactaaagaaattatcatacataaccccttttttcaagttattcaccttttcttttcatcctgaaaaaagtctctgttaaagctcgttccccttgttttgctttcttctttttttataacggcgccttttctgatcaggttttggccgtacttttcattcagctcgttcatcatctgaaaaatcggctcatcctttgcgtcctccttgaatgaaaacagatcaagctgtttatacgcctgctgtttttcaaccagttccgtcccggtgatgccgagaagccttaccggattttggttccagtgcttgtcaaacagttccatcgccgcttccatgatgtcttttttctgatcagccggattgctgagggtcatgcttcttgtgaccgttttccaatccgcataccgaatcatgatgaacagccggcaggccatgacctccttacgctggagccgttcgctcacagacagcgcaagccggtcaaacacgcccgttaattcatcccagtcagccgaatcatgcgacagggtggatgagttgccgacgcttttaaattcataaatccgctcgggattgacttctgcaggatggatgccgttcgctttatccttcagcctcgggccgtttatgccgagaagcgttttcagcgcatgttcatctccttttgccaaatcaccgatcgttttgatgcccagcgtttttattttttccgcagttttcgttcctataccgtgcatctcttctatcggaagaggccataagacgtccggcagctctctttttcttaaaatggtgatgccgagcggttttttcatgtcagacgccattttagcgagaaatttattcggggcgatgccgatgcttgacggaagcaaaagctctttttgcagtctcgcctgaatgtctgcggctgtctcatacgccctgtgtctgtgcggtgtgtccgtaatatccatgtatccttcatcaatagaaacaggctcgactaaatccgtatactcccacagaatgctgaacatttcttttgacgaactccggtagcggtcaaaattcggaggcacgacgatgagttccggacagaggcgttttgcccgccacaccggcatggtggtctttacgccccgcgctctcgcttcgtagctgcaggtgacgatgattcctttccgttccttcacgtttccggcaacggcgataggttttcctcttaaagacggatcatacgccatttctacagaggcataaaaactgttcatatcgatatgaaatataattctcccttttccggccactcccggcgcctcctttccttatatagacaaccttatatatatgtagtaaaataagagctgaatggatgtgataaaatgattcttgagtcaatgaatgactttttatttttagtcgattttttcacaattattcttcccgctctgaccgcgatcggcatcgcttttcttttgcgtgagcgccgcgcaggcgagcattggagaacgaaacgaatagatgaacatcaagcagtcgttcagctgaaccgaacagactttcttattattatatatcatcgcattacaacttggatacgtaaagtcatccgcatgaattcaccggcgaatgatgatgaagatgtcagcttcctccttttataacggcaagtgaagataaaaaggaggagacataattgtctaaaacatatcaaaaatggattgcattcggattgttttttatcgtactgtgcacaggccgctcggcttttgcggcgacatctcagactcagacgggaggcctcgggaatatcggttttttccacgattacctgatcgagccgttttcggcacttttaaaaggggtggcgggcctgttccacggtgagtacggactgtcgattattctggtgacgattatcgtccggatcgttgtattgcctttgtttgtgaaccaatttaagaaacagcgggtgttccaggaaaaaatggctgtgatcaaaccgcaggtcgacagcatccaggctaaaataaaacaaacgaaagatgcggaaaaacaaaaagaactgcaaatggaaatgatgaagctttaccgtgagcacaatctgaatccgatggcaatgggatgtcttccgatgctggtgcaattcccgattttgatcggtttttattacgccatccgctcaacgccggaaattgcttcacactcatttctgtggttcagcttagggcattctgatattcttgtatcactgtgcgcgggggccatgtatttcttacaggcttatatttcccaaaaattaaaccagaaatattcaccggctgctcaaaatccggccgcgatgcagtcagcaaaaatcatggtctttattttccctgtcatgatgaccgttttttcgcttaacgtaccggctgcgctgccgctttactggtttacaagcggactgtttttgacagtgcagaacgtacttttacagcagacgcatcataaaaagaaacaggctgcggctcaggcggagcccgccaaatcataatactgaaaccctgccggaacctatccggcagggtttttttcttgtatctgcaaagctttaagccaattatcttatcatgaagaatgaaaaaagcacccaatcaactgggtgcttcgtttttagttggccgctgtttcgataatggcaacgaccatttccgccgttttgacgagctcttcaatcggcattttttcatttttcgtatggatttgttcatagcctactgacaggttgactgtcggaatgccgtggccggcaatgacgtttgcgtcacttccgccgccgcttgtctgaagttcgctcggacggccgatttttgccgccgcttttttcgcgacttccacaacctgatcgccgtcctgatatttgaaacccggatacatgaccgcgatgtccacttccgcgcggcctcccatctcagctgcagcagattcgaaagcttctttcattttctgcacttgcgcctccattttttcaggcactaatgaacgcgcttcagccagaatatcaacctggtcgcagacgatattggtttgcgtgccgccttcgaaacgtccgatattagccgttgtttctttatcaatacggccgagcggcattttagagattgcttttgatgcgatggtaatcgcggagatgcctttttccggttccactcccgcatgagccgttttcccgaaaatggttgctctcactttcgcttgtgtcggcgcggctacaataatgttgccgacttttccgtctgaatcaagcgcaaaaccgtatttcgcggtaatgtctgaacgatccattgcttttgccccgactaatcccgattcttctccggccgtgataatgaattcaatggtgccgtgctcgatgttttgttctttcagcactttaatggcttcaaacattgcggcaagacccgtcttatcatcagcgccgagaatcgtcgtgccgtcggattttacatagccgtcttccacaatcggcttaacgcctttgcccggaacaaccgtgtccatgtgcgaagtgaaataaatcgtatccgcatcttttgtgccctttaacgtacagattaagttgccggctccatgcccggtcacttcttttgtatcatcttcttttacgctcaatcctaaatcagtgaatttttgtttgagcaccttgctgatttccgcttcatgttttgtctctgaatcaatttgaacgagttcaagaaattcttcaagcagacgtttttcgtttaccattttcagttccctccgtttaaagcggtatattaccgtgcttttttttcggtctttcctcttccttatgcgcaagcatgtcaaatgcctgaatcaattttttcctcgagtcttccggccggatgatatcatccaccattccgcaggccgccgctttatacggaccggcgttttccttttcgtatatggcttttttttcgcgcttcgtcttctccgggtcgccagaagcctgtatgtctttgctgtataaaatcgacgccgcgccttccgctcccatcacggcgatttccgcattgggccaggcgaatacaagatctgccccgagccctttcgaattcatggcaacataggcgcctccgtaagcttttctgatgatgagcgtcactttcggcaccgccgcttcggcaaaagcatacagcaattttgctccgtgacggatgattcccgcatgttcctgctgaaggcccggaagaaatcccggaacatcagcgatcgtcaatagcggaatatgaaacgcgtcgcaaaaacggatgaatctcgacgctttgtcagcggcatcaatcgtgaggctccccgccaagtgtttcggctggtttgcgacaacaccgactgtacgccgtccgagtttcagaaaaccgacagcaatgtttttggcaaaatacggctgaatgtcaaaaaacgttccgtcatccgccagctcttttattacctgtaacacatcgtaaggtttcgaactgtccgcgggaacgagggtgtttaataacggtctggcgtcttcctttttaacgggtaatgccgtctgtccgccgtgcgggagataagaaagcagggttttcacagcggaaagtgcctctttttccgttcgtgcggaatagtgggcatttccgcttatcacattatgtattcccgcaccgcctaaactttccgcgtcaatctgttcacccgtcacctgttcaatgactttcgggcctgtaataaacatgtgcgacgtatgttccgccataatcacaaaatccgtcaaagcgggtgaataaacagcaccgccggcacagggcccaaggatgacagaaatttgcggaatcactcccgagtaaaggacgttgcgcctaaagatatgaccgtatccatttaatgataccacaccctcttgaattctcgcaccacctgagtcgttcagcccgatgatcggggttttgtttttcgccgccagatccattaccgccgcgattttttccgcatgtgtctcgccgagcgtcccgccgagtacggtaaagtcatgggcaaacaaatacacgggccgtccgtcaattgtgccgtatccggtaacaacgccgtctcccggagcattctggcacccgggcgtgcggcttttggcaaacggctgcagctctgaaaaactgtcttcgtccaatagatagtcaattctttctcttgccgtcagcttgccttttttgtgctgtttttcatttttttccgctccgccgccgtttgttaaaaaggaacgtctttcgtttaagtgtctgatatgatcactcatgctcatcttgagtttctcctttttcaattgtttcacaaagctcaatcaggaccccgttcgcctcttttggagagagaaatgcgatcttcttcccgcccgctccgttttgcggttcatgatgaatcaaggtcatgcggcatgattcaagctccttgatcgtttccttcatatcggcgcagcggaatgccaaatgatgcagcccttcgcctcttttctgtaaaaaagagctgacgggagacgcgtccgacagcggctcaatcagctcaagctttgtgcctcccgcttctaaaaaagcaactctcacattttggccgtttaccagctcgtctcccatatacgtaagcccgagcatccgttcgtaaaatcctctcgcggcttcaatagagctgacggcaatgccgacatgatcaagttttttcatagcgcggccacctgctttccgccataggatatggcttgttcatacaagcaaaacacgttaaaatggtagacagtaatcttaaggagtgaaacaatgtctcaaaaatttatgaaaagcgccgtcatcgtcattttgggcgtatttatactttcaaccctcctctcaggcattatgatgtatttgcggtaaaaaagcaggcgcctcattgcaagggggtttcctgcttttttatgagggctttccgctctattgcaatgtcctcgaatgagcggttttcttttgtaatcaatactttcgttccgggagggataatccggaaaatacggatgacatcccggtttttcatacggatgcagccgtttgatacaaaccccccgatcagctcttctctgtttgttccgtgaatgccgtatattctgccgtcggtgcctttcgcatcaaaaccgatccagcggacgccgagcgggttttccggcgcgcctccctctacatttttcttccggtaatacggattgacggctttgaccgttaccgtaaattctccttcaggcgtcaaatcatccgtttttcccgtcgctacctgataaatgccttctattcggttatccttcacaacagcaagcgcgtttgtggctttattgacgataatataagggtcacccggcaaagggttcgcgccaagcggccaaagcggagacagcagcagggcggctgacaataaaaaaaatcgcatgggctcccctccttttttcattagaatgaccaatgaaaggaggactcatgcgattgatccatatgttttttacagcttgatgcctttgaaataacttttaatcacgagatattgttccatctcaccgaggaggtggaacaaagccgcccgcgcttcaaactcctcgcgcgttgccgggagcggcatttcttcaaattccgttctcatttctgcaagtctttttaaaaatttatgagcggtattgccgggatgaatggcttcccttaattcatggatgaaatgggcgattatttttccctgctccaccgttattgaaatagaggtaatcttcggcagcagccgttcaatgatttcaaattgtttctgtctcatcttaaaataatgatagtagagattttcatggcgcaaaatatgattctgcacgtcccgataggcgaggtttttcgcctcttgaatcatctgatgcgtctccggtatttccttccccgtccaatcttgctcaccagttaacaaataccgttcgatttcggcgaagatgacggaaaagttgtcctcgatttttttcctgtacgccgcgagttttctgtcgaggctcggcatatacagattcattaacagcgcgacgccgatacctacggtgatcagctggaactcattccagataaacgccatcgtaatgccgccggacatatataaatgaagaatgattactgaactggtgacgatcccttcatttatttttaaaacgactgtagtcggaatgaacagcaccagcaatattccgatcgcaaacggataatagccgatcagtccgaaaaagacatatgagaagacgatcgccaataaacaggcggcaaatcgggcccacgaggcctgaagcgaccgcttttgcgtaatctggatgcacaatatggtgatgattcctgcggatgcgaagttttgcagatgcaacagctgggctaaataaatggccagcgccgttccaagtgcggtctttagtgtccggtaaccgattttaaacattgcttgctccattctgtttgtttctttctcaaaaaaaagaagaagagcattcttcttcttttcttacagttatattttataatattttttctaaaaagtcctgtgctctttttgacttcggagaaagaaaaaattcttccggctgaccgtcttccacgatcgtcccttcatccataaataatacgcggtctgcgacttctttggcaaatcccatttcgtgcgttacgatcaccattgtcatgcccgtctgcgcgagctctttcatcacctcaagaacttctttgaccatttccgggtcaagagccgaggtcggttcatcaaacagcatgatgtcaggattcatggcaagcgcccgcgcgatggcgacccgctgcttctgtccgcctgacaaacggttcggatagtcgttccgtttgtcaagcagtccgactttttcaaggagagcgcatgccttttcctccgcctcctttttagactctttcttcacgctgaccggcgcgtatgtgatattttcaagcaccgttttatgaggaaacaaatgaaaatgctgaaataccatgccgatattttcccgcactttcagtttattcgttttagctgcggtgatttcgttttctttaatggcaatcgttccgccgctcggggtttccagcagatttaagcagcgcagaaacgttgatttgccggaaccggaagggccgatgacagcgacgacttccccttcttcgatctgtgttgaaatgtttttcagtacttcatgtttcccgaatgattttgacaggttatcgaccttaatcattggctttcagcttcctttctacgccttttccgatgaatgctaagatcaaaacgagcacgtaatagattaagcccgccacaataagaggttctaaatagttgtatgttgcggcgccggactggtaggcccgtctcataatgtctccgagaccgattaccgtgacgatcgccgattctttcgtcaaggtgattaattcgttaataatagccggagaaatgtttttaaacgcctgcggcagcagcagatctttcatcatttttccgtacggcacgccgagagcgacggcagcctctttttgtcctttgtcaattgcgttgattcccgctctgataatttcagagacgtaagcggctgaattgagcgataatgcggtgaccgccgcccaaaattgatcgatctgaaagccgagaagctgcggcattccgaaatagatgatcatcagctgcagcacgagcggcgtgccgcggaatatcgaagtataaaaatccgcaatccatttcagcggactgatcgtgctgattttaaataagctgagcacgattcctaatacaagaccgatgaccgctgaaacgagcacaatttttaatgtgaccgcaaggccttccaatataaaaggaatttgggggattgtcgctgagaaatccaaattcatacgtgtgatctcctttgtctttattcaagataaaaagctcaacgaaaagttgagctttcttttatttctcgttggtgaaccattttttcttcagtttttcgatttctccgtttttctccatttctttcagcgctttgttaaacttcgctgtcagatcactgtctttgcggaacgcaatcgcggagcccgattcgtctgatttcgcatccgctgacgcaaagccctgcagatcgttatttgaactgaaatagccttgtgctacgatgtcttcgataatggcggcatcaaaacgcccggatttaatctcttccgttaagtctgagatccggttgcggtcttcgagctgaaaaccgtatttcgaagcgagcttcttgcctttttcctcttgaatggagccgagctgaacaccgacggttttgcctttcagatcattcagggatttaatgctgcttccctttttcgtaacaatcatattgttagcagtataataaatatcagaaaaatcaacttgctttttccgttccggcgtaggtgtcattccagataaaatcatatctatctgcttggacttcaaggctgtaatcaggctgttgaagtccatgtcctgcacctcaacgtcatagccggtctttttgcccagagcttttgccagatcaacgtcaaacccggtgatctgatcgccgtctttatattcaaatggtttatagtcagccgatgtacccataatcagcttgttctttccgccctctgagcctgaattgcctgatccgcaggcggacagcgcaatggtgatacatgcggcagctaataccaacagccatttcttcatgattcatttcccccatatctactgatctcttaaatttgaatatttattcgttaacttgtattttaaacactttttaattgtgatgcaatactatttttgaaaaatatattttcctttctgtgtttattatagtcattgtttttccgattagtgacagctgaacgccgatgtataaatatttatatttatacagattccatataaaaaaaccccgaaagcgctcggctccggggtttttctttcacttatacttcttcacaatattcttcaaatgcttcctgcagttttgtgacgacggccatcggctcatggccttcaatttcatggcgttccaccattttcatgattttcccgtcttttaaaatggcaaatgacggagaggacggcggatagccttcaaagtattctctcgctttggctgtcgcttctttatcctgtccggcaaataccgtcacaagctgatccgggcgtttatcgtaatgtacggaatggtatgcggcaggccgtgcaataccgcctgcgcatccgcacacagagttgaccataacgagtgtggttccttttttcgaaagcgcttcgtccacttcctcagcggttttcagctctgtatacccggcggccgtgatttcctggcgggcttgacgcacgacatcattcataaataaattaaaatccatattcaactgggacctctcctttttgatcatctcttcttatgatagcaaggaacctccctatcggcaaatgacaccgctcatatccaattgtttttgtcccttttatgtacccgatgtaagtttatgaccttttaaaaacgggaaacttgttaaagagattgtctgaaataaaggagcagtcgtatgagccaacggaaagcagtattaatttataacggaaacgccggtcaaaaacagattgataaaacgctcggcacggtcgtccccattttggcccagtcagctgacgaacttttgattaaaccgaccaaacatcaggatgatgcccgtcagtattgtgaaaatctcgacagttcagttgactatttatatattttaggcggagacggcactgtgcatcaatgcatcaacagcatcagtaagcttgatcacaggcccgctgtcggcattttgccgggaggaacgtgcaacgatttctcaagggcgctcggcatcccgcaaaaccttcaaaaggccgctgaagcgctcgcgcccggacataaacgaatgattgacgtctgtaaaacggatgacggctattttctgaacttttggggcatcggattgatcaccgaagcatcaagccatatcaatgaaactgaaaaagcatggctcggtaaaatcagctacttcacgagcgccttgcgaacgatgacaagcgcgaacccgttccctgtcaaattgacgattgacggcgaggtgaaagaagacgaagccgtaatggtgcttgtcatgaacgggcattatatcgggacaaaccgagttcccctgcctgatgccagcctccgggacggcttagccgatgtgttaatctgccgcaacacaagccttgccgcgttgcgggagctgatgacgatggagcagggttcatttgatgatttcaaaggggagctgtcctatattcaggcctccaggattgaaatcgaaaccggacgtgaaatggacgcggatacagatggcgaggtatacggaacaacgccttgtacgatcgaagtgaaaaaacatcatctcactatgcttgttcccgaggattcacaatgaaagtaaaaaagctccttttgccgcccgggcaaaaggagtttttttaatagactgaagtattttcgtcaatgttttctaagatttctttgacgcgtccgaggaatcggccgcacacgagcccgtcgagcactctgtgatctaaagacaggcaaagattaaccatatcacgaacggcaatcattccgttattcatgacaaccggacgtttgacgatagattctacctgaagaatcgccgcctgcggatggttgataatgcccatagattgaactgagccgaaagatcccgtgttattgacggtaaatgtgccgccctgcatatcttccgcggtaagttttccgtttctcacttttttcgcaaggtccgttatttctctggctatgcctttaatcgttttttcatcagcatgcttaataaccggaacaaacagcgaatcttccgtggcaacggcaatagagatgttgatgtctttcttttggacgattttgtctcccgcccacatgctgttcatctgcgggaactctttgagagcctgcgccgccgcttttacaaagaaagcgaaaaatgttaaattgaagccttctttctgtttaaatgagtcttttatgctgtttctgtacgccgtcatgttcgtgacgtcgacttccatcatcgtccaggcgtgcggaatttctgttttgcttttatgcatattggcggcgatggcttttctgacgcctgtaaccggaatctcaatatcaccggctgacagagctggcgccggcgcttgtttttgctgttgtttcagcgcttgttgcgttgtttgaacggcggccggcgccggtgcttccgacttctgctgcattcccgaatcaatgatcttttgaatgtcttttcgcgtaattcttccgcctgcacccgttccttcaacttcttcaagctgaatgccgtgttctcctgctaatctgagcacggccggtgaataacgcgctttatttgactgatctttaccttgacggtttgcatcggtgtctgaaggggtattctgctcttcttcccgcttcggcgcctcttcggtttccgtttcttccgtttcaattttgcagatgatctcgccgactgtaagagtctggccttcttctcctacaagttctgtaatcgtaccggtaaaagaagacggcacctccgcattcactttatccgtcatgacctccgcaatggggtcatatttattcacttgatcaccgggggataccagccacttgctgatcgtcccttccgtcacgctctctccgagctgaggcatagccatttgttcaatcgccatgtcaaaaacctccttacgtctttaaaactccgctaattctctcatcgcggcttctgctttgtcaggattcatcatgaagtatttttccattgtcggcgcataaggcattgccggaacatcaggacctgcaagccgcttgatcggcgcgtctaaatcaaataagcagttttcagaaataatggcggcgacctcactcataataccgccttctttcgtatcttctgtgatcagcaatacttttccggttttagacgcagcttcaatgatggcttctttatctaacggataaaccgtacgcaaatctaatacgtgcgcggaaattccgtctttttcaagacgctcggcagcctgcagagcgaaatggacgcataatccgtacgtaatgacagtaatgtcgctgccttcgcgttttacatccgcctttccgatcggaaggacgtaatcatccgcagggacttcgcctttaatcagacggtacgccctcttatgttcgaaaaacagcaccggatcttcgtcacggactgcggctttcaacagcccttttgcgtcataaggagttgaaggcatgacaattttaagacccggctggttggcaaaaatggcctccacagactgggaatgatacaacgcgccgtgcacgccgcccccgtaaggcgctctgatgaccatcggacagctccaatcattgtttgaacggtagcgtattttggccgcttctgaaatgatttggttgaccgcaggcagaatgaaatcggcaaactgcatctcggcaatcgggcgcatgccgtacatcgcggcgccgatcccgacaccggcaatcgctgattccgcaagcggcgtatccatcacccgctcttctccgaactgttcatagagacccgccgtggctttaaacacgccgccttttctcccgacatcttccccgagaacaaaaacgcgcggatctctttccatttcttctttcattgctgcattaatactgtcaatataagacattacagacataagtattcctccctacttcgcataaacgtgatcaagcgttgattcaggagatgcgtatggcgctttctccgcttcgtctgtcgcttcgtttacgatagccatgatgtcatccagcatggtcttttcttcttcttcacctagaagcccggcttcttgcaagtatgctttatataaaagaagcggatcttgtttctttgcttcttctacttcttcgcgttctctgtagctgctgtcgtcgtcatcactggaatggggcgtcaaccggtaggaaaccgtttctattaatgtaggaccttcgcctttagatgcccgttcgcgcgcttctttcacggcccggtaaacttccagcaggtcgtttccgtcaactgtgactcccggcatgccgtagcctgctgcgcggtcggaaatattttcgcacgccacctgtttgtcatacggaacagaaatagcatacttattgttttcacacatgaaaatgaccggcaatttatacacggcggcaaagtttgccccttcgtgaaaatccccctggttggaagatccttctccaaaggttacgaaagagacgatatcctttttatccatgcgtcccgcaagcgcgattccgactgcgtgaggcacctgcgttgtcacaggggatgagcccgttacgattctgttttccttttgcccgaagtggccaggcatctgccttccgcctgagttcgggtcagccgctttcgcaaaaccggacatcatcaagtcctttgcagtcataccgaatgcaagcacaactcccatatctctgtagtaaggaagcacatagtcggtatcacggtttaaagcataggccgcgcctacttgagccgcttcctgtccttgacatgaaacaacgaacggaattttgcccgagcggtttaagagccacattctttcgtcgatttttctggctaacagcatggttctatacatttcaacggcttcttcgtcagagagccctaatgcttgatggcggtttgtagtcattcaaacccctccttctttccttttaaaaatgaatcgcgtttccgtctgcggctaacgcagcttctccaatcgcctctgaaagcgacggatgcggatgtatggactggccgatttcccaaggcgtcgcgtcgagcaccttggcaagccccgcttcagagatcatatcggtgacgtgcgggccgatcatatgaacaccgagaatatcatctgtattccgatcggcaacgattttcacaaagccatcgctttctccgtatacaagagcctttccgattgccatgaacggaaacttcccgatcttcagttcatgtccttttcgggttgcttcctcttctgtcagaccgacactcgccgcttccggatttgaataaatgcatttcggcacaagagctgcatcaagcggagccggattaagacccgccatatgctcaacggcaatgatgccttcacgggaggccacatgtgcaagctgaagaccgcccacaacatcaccgatcgcataaatgtgcgattccttcgtctgcccggcttcgttcacgatgatagaaccgttttccgcttcaatatccgtgttttcaaggccgatcccttcaatgttcggctggcggccgatggaaacaagcatttgttccgcgtgatacgtttctttttttccattcttttcagcggcaattgaaacgccgtccgctttttccaatgtatccggaagcactttcgcacccgttacaatcttaattccttttttcgttaacagtttttccatctcgcttgaaatatcatggtcttcagtcggcaaaatgcggtccgcatattcaatcacagtgatattgacgccgaaatcgttcagcatggatgcccattcaattccgatgacaccgccgccgacgatcaacatggattggggcagacgctcaagctcaagcgcttcatctgatgtcagaatatatgtaccgtctgcttctaaacccggcagcattttcggctttgaaccggttgcgataatcaattgtttcggtatcagcatgtcgttttcttcaccatttgcgtattcgacggaaaccgtaccgggaagaggtgagaagatggaagggccgagcatacgtccgtacccgttgaatacatcaatcttcccctttttcatcaagtgggcgacaccgccggccagacggtcaacgattccctgctttcgtttttgcacgctgtcaaagcggagggagacaccttccgtttcaatgccgaatgctgccgcttcctttgcggttcggtacacttccgcgcttcttaacagcgctttactcgggatacatcctttatgcaggcatgttccgccgagcttttctttttctacaacggccgtttttaagccgagctgggccgctctgatggcggctacataaccgcccgtcccgccgcccagaatgaccacatcatattcagtcgccatttgttttcactccttcgccgatctgatattgctttgactgctcctcaccggctaaaacccgaagcgcgccttgcgcgagagattgcagttcattttctcccgggtacaccagtacatccgaaatccaatctatgtacgatctgatggcggatacgaaacttttcccgtacgccaatccgcccgtcaggacgataatgtctacttttccttttaatacggcgcttgccgccccgatttcttttgctacttgataagccatggcgtcataaatgagcctcgcatgctcatctccggcctgaatgcgtttttccaccttcaccgcgtccgttgtccccaggtagccggagagtccgcccgtgccgacaagttttttcatcatatcggcttttgaatacttgccggaaaaacacatctccaccaaatcacccgcaggaacggttcccgcgcgctccgggctgaagggcccttctccgtgaagcccgttgttgacatccgtcacccgtccgcaatcatggacaccgactgtgatgccgccgcccatatgagtgacgatcatcttcatctgttcataccgtttgccgagggacgccgccgcctgacgggcaacagctttttggttcaaagcatgaaaaatgcttttccgcttgatttcaggcatccctgatactttagcgagcggagtcatctcatccaccacgaccggatcgacgatatacgcggggatatttagtccgtcagctatttccctggcaataattccgcccagattagaagcatgctggccgttgtagccgtttttcaaatcagtgatcatggcgtcattcacttcatatgtgccgccctcaatcggtctgagcaggccgcccctggcacaaacggcatcaaactttgaaatgttgatgccctgttcgtgcaaagactcaagaatgcttatttttcgaaattcgtactggtcgataatgccgttaaatgttttcagctcttcttcgggatgtcgcagcgtcttttcaaagatacagcgttcattgtgaaagacaccgattttcgttgatgttgagcctggattcagaatgagaatgcgtttttccttttcgaacattttcatacctccagatcaaattcctatcgtctgcttaatatactttggccgttttgcagaaactggcttcttgaacggcgcatgcgttcaattcgttcctcagccagacggtcggccgctaagtatgtcggaatgccgtcacgcgcggaaatatcgagcacccgctcaatgtttgcatagatgccttcaacttttttcaaagcccgctcagcattgtagccgtaaagctcatcggccacattgatgacgccgcctgcattgatgacataatccggagcgtacacgattcccatttcatgaatggtatcgccgtgacgtgtttctttcagctggttattggccgctcccgcaatgactttcgccttcagctgtttaatcgtgtcatcgttaatgacggcgccgagagcacatggggcataaatatcgcacgtctgtgagtaaatgtcgccgggatcaactgcgcgggcgccgaagtcctcaacggcacgtttaacagattctttattgatatccgttacgattaaagaagcgccttcttcgtgaaggtggcggcatagattgtaagccacatttcccacgccttgcacggcaattgttttaccttccagtgaatcagtgccaaacgccgctttcgctgcggctttcatccctttgtagacgccgtacgccgtaaccggggacggatttcctgatgaaccgaatgccggagaaattccggttacatagtctgtttcatcatgaataatgtccatatcttcaacggtggtgccgacgtcttccgccgtaatataccttccgtttaagccttggatgtagcggccgaacgcgcggaacatttcttcatttttatctttgcgcgggtctccgataataacggttttcccgccgcctaagtttaaaccggcagccgcatttttataagtcatgccttttgcgagtctcagtgcatcttcaatcgccgcttcttcactgtcatatgtccacattcttgttccgccgagtgcagggccgagcgtcgtatcatgaatcgcgatgatcgcttttaatccggattgttcatcttggcagaataccaattgttcgtaatcgtaagtctccatatatttgaaaatttccataggttcgttcctcctactgttcttgtgatgcgcaaatcgcaagcgcaattgaatacagtttattttctgcggtatccgctctgctcgttaatgcgatcggcgcttttgcaccggcgatgacggcagcaacatttgctttcgcaaaataaatcattgacttataaagcatatttccggcctcgattgaaggaaccaagagaatatccgcctggcccgctacgcttccggaaatccctttttgcagcgcagccgcttgggatacggcattatccaaagcaagcggtccgtccgcaatgcagccggtaatctgtcctctattgcacatctggacgatcgcagccgcgttcagcgtcgcctccattttcggattaaccgtttcaatagcggcaaggactgcggctttcggcatagggttccctacagaatgtgcgacatgaaccgcattttgcagaatatgcccgagctcttcaagagacggggcaatgttcagcgctgaatcagtcacatacatcagccggtcatagtccggcacctcaaaaacggctacatgtgataacaccctttttgaacgaagcccttcctggcggtttaaaaccgatttcagaagagttgagctcgggagattccctttcattaaaacgtccgcctcttgttcacgcactgcgcgcactgcttttgccgcagattcttcgggtgaatcggcgtggatgatgtcagcattgaacttcggctcatttgccagaagctctttcagctttccgctgtcacccgtcagtaaaaatcgtgccgacaagtgttctgccgccattttgacggcctggatcacttctttatctgctgcgtgggccactgcaatggtttttgcgttttttgccgcggctttttcaactaggtctttcagcttcattttgtaccacctttcttgtgcgaatccgcttttaacaatgcaagttccgtgccaaatatgcgaaagggtttattccggcttttttcaagaacacatgcagctgtttgcgctttctctgcaacttattgcatgccgtcatttgcaaggccgtacttgtccattttgtagtacagattccgaatgctgacaccaagcgctttcgccgttttggttcggttgaatttatgcttttcaagcgttttttgaatgacgtgcgcttcaaatttttcaacagcctgagacagcttttccccttctatatccggaaaatcactttgggtgccgtttttttcattcagctctgattcgaaaacaggcagatgctgctgttcgatccgttccatgtgcggctctaaaaatatcattgcccgtccgagaacattttcaagctcccgtacgtttcccggccagctgtaggctgataaagctcgcagcgcgttcggcgtgagcccctttacattgcggccgtaatcctgattgattttttcaatgagccgaatgctcagcgcttcaatatcttctttgcgctgccgaagcggcgggattgagatcggatagcggttaatccggtaatacaggtcttcacggaacgcgccttccgccatggccttttcgatgttgacgtttgtcgctgcgataattctgacattgacagaaatcgctttagcgccgccgactctgataatttctttttcctgcagaactctgagcagctttgcctgggtgctttgggtcagctctccgatttcatctaagaaaatgctgccgttattcgcttcctcaaaaagtccttttttgcccccgcgcctcgcgcccgtaaacgcgccttcctcatagccgaaaagctcggattcaagcagggattcagacagggccgcacaattgacccggatgaatttattgtattttcggtcgctttcattatggatggcgtgggcgaaaagttctttccctgtgccggattctccccgcagcagaatcgtcgccggcgttttcgccccgagcttcgcctgttcaagggcgaccagcatttgttcactcgtgccgataatgtcatcaaacgtgtatttcgcttcaagcgtgcggataatctggcgcgcccgattcagctcagcagtcagcgttttaatttctgacacgtcgtggatgacgccgacgctgccttttaaaataccgtccacaataacgggggcaacatttacgatgacatcctttttattggggccgaccttcatcctcacaccccgaacgggccgccttgtccccaatactttcaggtgcatgctttccccttctgagatatcggtggaagcgggttttccgatgacctcgctttctgacagcccggtcatttttgtatacgctttgttgattaacattccgatgccgttttcatcaacgacggaaatggcctcgtctgacgattgaataatcgcttcaagcatggtgcggatttgttttaagttcgtgacctcttccgccagttcaactgcgtcggtgatgtctttaaacacgcataacgcgccgagaagctttccgccttcgtcaatgatcggcagtcttgtcgtaacaatctgcaggtgcttgccgagaagctgcttctggttatattccggctctctcgtttccagaatccgcggcagctttgtgttcggcactacatctttaatttggcggccgatgacatcctcccgttttcggccgaccattttttctgccatctgattaaataaaatgatcgtttcgttgacgtctataaaaatcatgccgtcgtgcgttgaattaaaaatccggtcatgcttatacgtctgcgacttcagcatttggataagctgctgtttttcctccatcagctgaaacaccatgtacgccaattttcccggcatgacgatggtttgttcttttttctcatggagcagctcatccatgaccgctttatcgcctgttgtatggatgataatatctatatcttcagttatgtagggtttccaatctgatgaggttgcaattccatatctccgggcttcttgcagcccttgcgcctccggatcttggtcaaccaccgcaataatccggatcagttttgttttcatcaaaatctgtaggagcgccgtgcctcctttaccagcacctataatcagcaccttctgcatcccgatacccctttatatgaaaaaatttgcacacctgtatttcccgttgcaataatttgcacaacccctatgttaccacgttttgatctcttgacaaaatattttttcgattggacaataaaggaaatcatatcgtaaaggggttttctgaatatgagccggcttgttgcacttttgattctggtcctccccggcgctgtcgcggcgctcggcattaagctgatgagagatgcattattcgggcatgcgttttccccgtttccgtccctttttcttcagggggcggccggattggcgttttttttgttcggcctttatgtcctggccgggtttattctgtacagagatcggaaacgcaatcaagtcagcccgcggttcaggaaaaaaaagctgtaaaaaaagcccttgcaaaaaaagggctttttcagtcgtccggcagtatcgttttggcaatggattgatccagttcttcatagtcatggtaagcgatcgtttcatataattcttttctcgtctgcatatccgaaagcccctctttttgagagccttcttctttcagaaggcggaaaatacgttcaaaagccttggccgccgttctgagtgacgtgaccgggtaaatgaccatctgacagcccatatcggaaaattcatcagcactgtaatacggcgtttgtccgaattcagtcatatttgcgagaatcggcacactgatttgtttggaaaacgctctgaattcactttcggattggagcgcttccggaaaaacagcgtcagcacccgcttttatataagcggacgccctttttaatgctccctccagcccttcctgctgtctggcgtctgttctcgcaacaacaagaagagtcggcgcggcccgcttgaccgcttggattttttgcgccatttcttcaatcggcacgagctgcttcccattcagatgtccgcattttttcggcaggcgctgatcctccatttggacggcggccgcgcgcgcttcatacatttctttcgccgtccgggcggcattcagcacgcctccgaaacccgtgtcaatatcgacgaggacgggcagatcagacgagcggaccagatctttaacccgttcagccatttccgccgacgtgatgatgcctaaatcgggcagccctctgctcgccgtgtaagccgcgcctgataaataaagagccgaaaaacccgttttcttggcgataagagcggccatcgcatcgtgagcgccgggaatctgcaatagatccggcgctgccatcagcgtacggaaccgctctgcaagctcctcttgagacgactgcttgctgacgatccacgtcatgtttgtcaccctcctattttatatgagaaataagtccataaattcactaacgctgagcttctgcattcggccgctatctttacaggcctcttcgattttccgctgctgcttcaatgaaaaatgagtgctgatgtttgctgaaaacttggcaagaatcttcggaacggcttcttttctgcggaatcggtgcccgagcggatattcacattcaatccgtcccgtagccgtgccgtctgtaaaatgcacctgtacggcatttgagatggatcgcttattcgggtctaagtaatctattgagtacgctttatgttctgtcacctccattttgctccgcaatgtatcaattcgcggatcagacgccgtttcctcttcataatgatccgccgtgatatctccgaaaagcagcccgattgccgtaatatactggaggcagtgatcccggtcagccggattgtgaagcggcccttttttatcgataatccggattgccgactcatgggtcataatcgtgatcctgtcaatgtcttcgatgcggtctttcacctccggatgaagccggaccgcgcattccgccgctgtctgggcgtggaattcagccgggtaggatactttaaacaaaacattctccatcacataggacccaagccggcgggcaagcttcatttcctgacggttaaataatacgtcttgaaatccccacccagatgcggtcagagccgtcgggtaccccatttcacctttttgcgccataagggccaaatatacgcctctgctcgtcgcgtcgccggccgcccatgatttgcgtgatccggtgttcggcgcatgacgatacgttctgaggcttgaattatcaatccaagcgtgagatacggcgttattgatttcctctcttgagccgcccagcatttgtgcgcaaacagccgcagtcgccactttcacaaacagcacatggtcaagcccgactctgtttaaactgttttccaaagcgagaattccttgaatttcgtgcgctttgatcattgcgcaaagcacatcacgcacggtaagcggttctttcccttctgaaatccgcactctggatatataatccgcacaagccaatatgcctccgagattgtcagacggatgcccccattcggccgcaagccacgtatcattataatcgagccacctgttgatacagccgatattaaaggcagccgtgaccgggtctaaaacaaaaggcgtgcccgggactctgctgccgttgggcacggaggttcccgggacaatcgggccgagcagctttgtacattcgggatagctgagcgccaaaattccgcagcctatcgtatcaagaagcacatgtcctgccgtagtgaaagcttctgaactgtcaatctcctgatggagcacgtagtcagaaatctcttcgattacagcatccattcggcggggttctgtcatgttttcatcttcctttctcatctgtttacaggcgcgctccggtatagcggacacgcgggcggaaaagccggtttcggctgtgctgttcaatgacatgagcgcacagtccgaccgtccgtgcgctgaaaaatataggcgtatacagcgggatcgggatgccgagcatgtaataaaccggcgctgcgtagtaatctaagttcggataaaggccttttttctcccgcatgacggtttctccggcttcacacatatgataaagacggaaatcgcctgaaagatcagacagttttttcaatgcttctttcatcatgagcgccctcgggtccatttttttcatgtagacacggtggccgaagcccatgattttttctttgtttgcgagtttttgagttaataattgtgtaaacccgtctgtatccttcgcttcctcaagcatgtacataaccgcttcgttcgctccgccgtgaaggtttcccttaagcgaggcgacggctccggtcagcgcgccgtaaatatccgattgcgtcgaagcaatgacacgggccgtaaacgttgagttcggcaattcatgctcactgtataaaagaagcgaccggtcgaatatttcttcttccaaggaggacggcgtttttccggtaatcatatataaaaagtttgcgctgtacgataaggttccgacaggcgctaaaggctccagtccgttgatgactcgatagctgttgacggtcagattgggcattttgcctatcagcccgcggacacggtgccgatttacagaagaggtgcggttatcaatatccttatcaaagcctccaagcgcggacaaacctgtcctcagtccgtccatcgggtgagtacgttcgggcagcagacggcatatacgcaagatttcctcgggaaggtgtccgccgcgccgaacgtcttcttctagcgccttcttctctttcgcatcaggaagtctgtcttccaataagagatgaacaatgtccatatagccggccgttttagaaagctcaatcagatcgtggcctttgattaaaatactgccctgctgtgtatccaggaaagaaatccccgtttccaccgcaatgacgccatctaaaccgggagaataagattccatggtttcgctcctttgcgcactttttattgaagaagatacttagaaataatcagcctttgaatctcattggttccttcatagatttgcgtgactttcgcatcccgaaataaacgctccgcgggatactctttcatatagccgtagccgccgtgaatctgaacagcctccaccgccgctttcatcgccgcatcggacgcgaactgcttcgccatagatgcttcttttccgcacggaagccctcgctgatacagatcagcagcatgatagaccaataatttggcagcttccgcattcgttgccatgtcagataatttaaatgaaacggcctgattcgaagcgatgggtctgccgaactggctgcgggttttggcgtactccaccgagcagccgagcgccgcttcgataatcccgagcgcctgagccgctatgccgatccgtccgacgtcaaggtttttcatggcgattgaaaaaccctcgccctcttcgccgagccggttttcaatcggaatttccgcttggtcaaactgcaattcgacagtattggaacctaacaatccgagctttttttctttttttccgacagaaaaaccgggtgtgtttttttcaacgataaacgctgaaattccctttctccctttacccggatcggttatggcgaatgtcagatacagatctgccgctccgccgtttgtaataaagatttttgaaccgttcagaatatatgaaccgccttttcgcacggctgttgttctcaggcttcccgcatcagatccggagtgaggctcagtaagcgcaaaagccccaatatattcgcccgctgccagcttcggaatatacgtttgtttttgggcttctgtcccgaaatgcaaaatcgggattgtccctaccgatgtgtggacggacaaaatgacgccgacggccgcgctgacttttgatatttcatgaatcgctaaaatgtaagatgttgtatcagcacccgccccgccgtaagcttccgggacgggaatgcccatcaatcccgcttcgcccatttttttaatcagccgctccggaaattcatctgttgattccatgagctcaaccaccggcgcgatttccttgcgggcaaaatcacgcaccatttttctcatcatgatgtgctcttctgtaaaatgcatggctgccgtctcccctcatgatctttacatcatctgccgtactcataaaaaccgcgcccgctttttttgccgagccagccggcgctgacatattttctgagcagagggcatgggcggtatttcggatctccgagccccgcgtagagaacctccataatggaaaggcacgtatccagcccgatgaaatcagctaacgttaaagggcccatcggatgacgcatgccgagcttcatcacctcatcaatcgcttcctttgaagctgctccttcgtaaaggcaataaacggcttcgttaatcatcggcattaatatgcgattagatataaagcccgggaagtcattgacttcgacaggggttttattcatccggacggcaagcttctttactgtttccgccgtttcttccgatgtggcgagtcctctgatgacttcgacaagctccatgacaggaaccggattcataaaatgcatgccgattactttttcaggcctttttgtggccgcggcaagctccgtaataggaagagaagacgtattgcttgccaatacggcatgagggggacagattttatcaagtgtgtcaaacaattccgcttttgcttttttgttttcggcaatggcttcaatgataaaatcagcatctcccgcttctgtaagctctgccggggaaatacggctgaaaacggcatctgtctcctgctgtgacttccgtccttttgcctgctctttctccaggtttgtctttatgcggtgaagaccttttgttaccgtttccggctcccaatcgtataaattgacggcaaacccggcttctgcagccgtctgagcgatgcctgcccccatctgaccggcacctgcgaccatgattgttttcatcttcatccggcgctccctcctttgatcagtacacctccagcaggacggcatctccttgagccgctccgctgcatatagccgctatgcctaaacctcctccgcgacgctttaattcgtatattaaactcatgatgattctcgctccgcttgcgccgatcgggtggccgaacgcgattgcccctccgtttacattcactttctcccggctgaacccggctattttttcactcacgagcacgacggacgcaaatgcttcatttacttcaaacaaatcaatatcgtcaacggacagtccggtttttttcaagagccggctgatggcctctcccggcgcgcttgccagctcggacgcttccagtccgactgacgcaaagccaagtattgctgcgagcggcctgacatgctgctttgctgctttttcctctgacatcagcacaaatgctccggccccgtcatttacaccgggagcatttcctgctgtaaccgttccgtcggctgtaaaaattggcttgagcgctgcgagctgctcaaggcttgtatcaggacgcagcccctcatccgcttcaacgatatgctgtttgccctttttgccgatccaggtaacggggacaatttcttcacgcaatttgcccgcctcagccgcctcagccgcgcgtttctggctcaaaagagcgtaatgatcctgttcatcccgggaaatgccgtactttttggccgcagtgcttccgtggacagccatatgtacctggtcgaacgcacaggtcagaccgtcatgaaccattaaatcctgaaaaaccccgtcccccatcctcacaccccagcggccggccggaatggcgtacggaatgttgctcatgctttccattccgcctgcaatcagcacgtccgcgtctttcgcccggatcatttgatcacagatggtaacagccctgagccctgatgcacagaccttattaatggtttcagccggaacggaccacggaagcccggcatatcttgcagcctgccgtgccggaatctgcccggcacccgcctggacgaccatccccatcaccgctccttccgcttcgctttcactgatagcggcgcgcttgattgcttcttttatggcaatgccgccaagctcggctgcctttacctcttttaatgcgccgccgaattttccgaacggcgttcttgccgcactgacgataaccgtttttcccacaattttgcctcactttcaataagataaaagataacgcttacacaaaacgccctgttacaatatatgaaccggctgaccgagttatgattgcaccgcctttttcccgcccataaaaaaagaagactgtctgaacagtcttctcagctgcggcattcttcttttatagaaacagccagctttggataatcggtaaaaattgcgtctatccccgctttcatcagctgcttcatatcctcaggacgattgacagtgaacggacggagcgccgcttggtgttttgcaagatgtttgatcacttcagcgctgaccgcaggcgtaccgagcttcggatgataacccgaagcggggatggcggcaagataccgttcaggccggtacagcacatccattgtcagcaccgcccgttcaatttcaggcgccagggcgtggcaaaccgcgagactctcatgattaaatgaagaaaaaataacgcgcttttccagtccgtaatatctgacttttttgatcacttcttcttccattccttcgtaacggaatacactgtttttcagctcaatgtttatcagaaaatcagcacgttccgcaaaacgcagcacatctgacaaaagcggaattctgacacctttaaaagaatctttccattttccggcggcatcggcggttctgattttgtcatacgccgtatctttcacaaatcctttcaaagacgtcgtgcggtcgagggtttcatcgtgaatgaccacgatccggccgtcttttgtcatctgtacatcaagttcgattccgtcagccccgtcctcaatcgcttttttgaatgcgggcatcgtattttcagggcagtcgcccgacgccccccggtgggcaaaaatattcgtcatatgtgtcacctcagatgtttgtcatcggttttctctattataatcgttatgcacatcaggagggcgctatttacacatattttatcattaccgtccgctgtaataggtttcgattccgtttacaacggcgtccgcggcatgctcttgtccgttatcgcttttcagcttgtccgcatcttgaggatttgtgataaaacctaattcagccagcacactcggcatctttgaatatgtaataacataaaaaggagcttcttttacgcctctgtccctcatccctaaagacgtgacaagctgctgctgaatgtcggaagcaagcctttcgctgtccgcgccttcatatgtcgaattaaaatacgtttccgtgcccgatgccgttgatacggctgaattcgtatggaggctgacgaataaatcggattggctggcgctcgctttcgccacccgctcgtccaaacgtaaaaaagtatcgtcagtccttgaagctacaggttttgcaccttctgcctccaatttggcgatcaccttgtttgacaccgctaaattgatgtttttctcaagcagtccatttccgccggccccgctgtcttctccgccatgtccggcatcgatataaatggttttcccttgcaaaggttcggctgcataagcggacggcgcaagcagaagcagagcggcaccgaaggcagcagcgctttttgtcagtaaacccacgttttttcctccccgttttcacatatctgtttcttttttcagtttctcaagccgtaattgtccgttgctctcttttttataggtgatttgcaccgccgtatgttcaggcagcgactgacattcaaaccgcttagcgaaaggcaccttcacctcttgcctttctccgtcaatttcgaccgcgatcgtatcgtttccggccgcttttataaatgttccttcctgtgtaaatgacggcgccgcatcagcctccgcggtatactcgcagcctgataacagccatgcggtgaagatcagaagtatgacagacttcacacagatcacctcacgttttctcattcggctttatctttgaacagattggccgatttgtaaagggagcctccattcctccagcgcttttccatatttggaatgaaggctatctgacctgctgtttacctgaacttagaaagaaaacaagctgatcagtctatgaaaaaggttctgtctgaaggccgaatatgcagaatttaacggaaacggacgactttctgttcattttgaaaaaatatcagatcggcaaaaaaaagagagccgcgtcatgcactctcccgaatagaaacattcatatttattttgagcttttcataaaatgaacgggacaacttaaaagagcagcgtattggcggcaatgatgagaataatcactccgctcagcaccgtgctgaactgtccgacgtgaaaagaaccgatgcgcaatgacgcggctttttttccaagcgagcagccgatccatatggtcagaaagcttccgatcgccgcagtgatggaaatggcagcaggagaaagcccgatcaaccccgcgcttaatccgttggtcagcgcatttgcggatacggccaccccgagaaccatggattccaatataccgatttctcccgaaccgtcggcatccgctgcctccggattttgcagcagaccggcaaaacggcctttttttcctgacgcgccaacacgcgctgtttttctcggcacagccagcagaatgatgcggataccgatgacagataaaataaacgccgccagcaatacaggaagaaagcccggtaaaacggctgaaatccatttgccgaaataaattccgatataactgaatacaaaacagataaaagcgatcatcatatttgacgcatgcgatattttgatttttctgatgccgtatgacatccccactcctaaattatcaatgcttgaggacactgccaaacctaaaatcaataaccaagccatgttcgtttctctccattctttgatgtcttttcaacatgttgtgccgttgaatctacactattctattcagcagcacagaaaaggtaccttttctgcaaaaattattgattgacgatcatcattccggcggaaacgaggtgacacccttgacagaaaataaaaataagacactgggaccccttttaaaatcactgcttgataagcactcgctctccatgagaaagctcggcgccttaacaaacattgatacggccaccatctcccggattatcaacggcaaacagaaggccaatttaaagcatcttcaggaattttcaaaacacctccgcaccccgctggaggaattgcttgaggcgtcaggcatagacatcggtcatgaaaaagaagctgcgccgcaagacccgatgcacgcgattcaggatatgctgaatatggccgagatgtttgatcagcctttttcccgggagcaaattgagcgcgaactgaccagatatgaacaatacgccaaaacccagcagggccatcgcctgatttgcgatgagtttcaaaagaaaatggacaatgaagaaagcgtcggcccttttattgatcatttgaaaaacatgcatcatcagtatatggatgaatcaacaccggctgaagaccgcgcgattctcgggagcgcgctgctgtattatattttagcgaccgacgttattccggattacatgtttccgatcggctacctggatgacgccatcgccgtgcaaatcgctttgaaccggctgaaaaaaaagtaaaggcgcttaaaaaagcgccctttttgtgttgaaaaatatgaaacaccgcattacggttttgtcaaaacagagacagctgtcatatgatacatcaacctaacaaaaaggagggtgtcttctatggacagcaacacagtagtggcagtgtgcgctctgttaagtgttgtgattcagatcggaacgatattcgccgcaggaaagtggaaaaaagaataaacaaattgacggttttttcgcacaagcgtatgcttataaataaccttgtaaaagataagaaagaagatatgcatatgaaaaaaatcattctcctcttcgccgccgctgtcatattcagctcgatcggccatcaaatttcaggaggatataaagatcctgaaaaggaacggagaaaaccgtttcattcgtttaaatggttcagccggtcataacctccggaagaagaacaagcaaaataattgcacacaatgaaaacataagctagaatacggacgagttaaactcctaaggaagaaggcgaaatgatgaagcaaacttatcaaccgctgtttgaaccttttacgttcgaaagcggcgtcaccataccaaaccgtatttcagtcgcaccgatgacacattattcatcaaatgatgacggaacgatttccgaccgtgaattaagctacattactccccgttcaaaagaaatgggcatggtcattacggcatgtgcaaacgtaacgccggacggcaaagcgtttccaggccagcccggcatctatgatgattctcacattcccggcttgaaaaaactcgctcaggcgatccagtctcaaggagcgaaagccgttgtgcagattcaccacggaggattggaatgccctcctgaactcgtgccaaacaacgacgtcgtcagtccgagcggctcagaagaagacggcagacaaacgtcccgggctctcaccgaacaagaaattgagcacatcgtgaaagcattcggcgaagcgacacgcagagcgattgaagccggctttgacggtgttgaaattcacggggcaaacgggtacctgattcaccaattttattcaccgaaaacaaaccggcgcacagaccgctggggcggaagcgatgaaaagcgcctcgcgttcccgcttgcagtcgttgacgctgtcaaacaggcgattgatacacacgctgaaaatccattcgttctcggctaccgcctgtcaccggaagagccggaaacaccggggcttacaatgaaagaaacattcatgctcgccgacgcgcttgcggaagagaacttggattatctgcatatttcactgatggatgtcaattccaaagcccgccgcggcgcggatacttcacggacccggatggatttattaaacgaacgcgtcggccataaagtgccgctgatggccgtcggttccatctataccgcggacgaagcgcttgccgtattagaaagcggaattccgctggtggctctgggacgtgtcattttgattaaccccgaatgggcggtgctggtcaaagaaggccgcgaacaggaaatcgaaaaagccattcaagcatctgaaattgagaaataccgacttcctgaaccgttatgggaaatgattcagaatacaggcggctgggtgccgtttgaaaagtagactaaaaaaactgccggatgtccggcagtttttttgattcacaagtttttaccgctttgtttactcctatttccaacacacagcgtacatatagtaaatagattaatagaaaggagaccgtatatgatggctggtttccctattacgattaacagtctttccggaaacggggttgtcaatgtcggcggtgcgttttcgataagtcatttaaccgtatcaaaaaccgtctacggctcaggagggggaaatacaggtatggtcctgcaaatgaatcaatccagcacatctcaatcttcaaactctcaatactctgatcaaaatgtaacgaaaacattatgacatccgtatttccctccctttccggctggcagcagccggattctttttgccgttttgtttaatcttattcaaatatcacagcgtacatatagttagtagactgagagagaaaggagaaaaaatagaatgagcggttgcccgattacgataaacaacgtatcaggaaacggagttgtcaatgttggcggcgccatatccatcagtccgctgactgcatcaaaaaccgttttcggtgccggagggggaaatatcggcattgtcattcaaaacaatgctgtaagccagtccaaaatgtttgaacatcaattttcagatcagaatattgtgaagtcattgtaagggctgccatgcagcccttactgcataaataaagcaggcgcatgatttcccgaaaacttgatttttaacatcagcggtcaccttctcatgttttgaatgatttcagttaaagatgaatagaatgcagattgaaagcatgagtactgaatctcattaaggaaagaaggaatcgtgatgaaaaaactttgccgggaagtttggattgaagttgaccttgatgcgataaaaaagaacgtacgggcgatccgccgccatattccgaatacgtctaaaattatggccgtcgtaaaagcgaacgcttatggccacggctctgtggaagtagcgcggcaggcactggaaagcggggcgagcgagcttgctgtcgcaagcgtcgaagagggaattgtgttacggagagcgggaattacggcacctattctcgtgctcggcttcacagctctcagctgtgtgaaaaaatctgccgtttggaacatcacattatcagcgtttcaggtcagctggatcaaaaaagcgaatcggatattggaaaaagaagcagattcgaaacggctgtccattcatatcaatgtggataccggaatgggccggctgggtgtgcgcacggaagaagatcttttagcagtggtgaaagcgctcaagtcgagtacatacctgtcatgggatggcatctttacacatttttcaacagcggatgaaccggacactgagctgacgatgctgcagcacgaaaagtttatcagcttcctccgctttttaaaaaatcaagacattacgctgcctaccgtgcatatgtgcaatacagccgccgctatcgcattcccggaattcagcgccgacatgatccgtttaggcattgggttatatggtttatatccgtccgcctcgataaaggagctgagcctcgtgaatctcacgcccgcactaagtttaaaggcgcgtatcgcttatgtgaaagccatggtgacagatccccggaccgtcagttatggtgccacatatatcgccgaaccgggtgaaatcatcgcgacgattccgatcggctatgctgacggttactcccgcgccctgtccaaccgcgggtttattctgcaccgcggcagacgggtgcaggtagcggggagagtgacaatggatatgataatggtcagtttaggtgagaatgagggcaaacaaggagaagaagtcgtcatctacggcaaacaaaaagaagccgagatttccgttgatgaaattgccgaaatgctcggtacgatcagctacgaagtcctgtcagtgttaagccgccgcatcccccgcttttatttcagagacggcaaaatcattaaaatatcagctccggtattatacgtatagacggcatagttcccgtatttatgtatagaacaagtaccagcgtgagtgattcccattgttttcgtcagcaaaatctcaaaacgccttctcttccgcgttcatgcacggaatagaaggcgcaaaaagacatttagccaaaggcttgcgttacgaagctttatgctccaatctcagcttgtcagcaaccatcgcgatgaactctgaattggttggttttgcttttgtcatgcttaccgtatatccgaacagtgaagaaatggaatcaatatttcccctgctccatgcgacttcaatggcgtggcggatggcccgttctacacggcttgcggtcgtgttgaattttttggcgatgtcgggataaaggacttttgtgatgctgccgaggagttcaatatcgttatacaccatggaaatggcttcacgcaaataaagatagcctttgatatgggcaggcacaccgatctcatggataatgcttgtaatgctggcatcgagatttttccgcttcggctccggctggctgcggataatgctgctttgcgcggacggcgcacggtgtgtgacactgctgacatttccgcttacctggcggatatggccgacaaggttttccatatcaaacggcttcaggatgaaataggacgcgcctaaatcgacggcttttttcgtaacgtcttcctgaccgaatgccgtcagcatgatgacgttcggctgcttctcgagctctgattcccgcagacgctccaaaaccgcaagtccgtccagatgcggcatgataatgtctaaaacgagcacatcgggattcttatctttaaacaaagaaagacattcctgtccgttataagcaacgccaatcacttccatatcatcctgtccctctatatattcactcaacaggcttacaagctctcgattatcatcagcaacacaaactttaattttctccacgtttcttcctcccccaatgtattaacaggacgcaacccatttgactgctatatgttacattcgacaaaaccactacttccccttttaaaaaatccatatttaccaataatagtggtatatctttgtttttctagcattttctaggtttttcgactaaaaattaagtttgacaaatcaggaaacgtgaatttgtcgaaaaatcttcatgtcttattttacatgaatccaggaaagaagtgaagaacgcatcacataaaaaaactgccggatcatccggcagtcagcttgctttgtctttcccgtaaacatcaacacccgcttcagacagcatccattcgatatgaacgccgtagccgcttgtcggatcattgacaaatacgtgggttacggctccgacgacctttccgttctgaatgatcgggcttccgctcatcccctgaacgattccgccggttcttttcagcagtttcggatctgtcactttcaacaccattccctttgtcgccgggaatttttgcggcgtggtgctgacgatttcaatatcaaatttctctactttatcgttttcgataaccgtcagcatttgcgcaggtcctttttttacttcatttgacaaagcaatcggaagcgctttgtcggaaatgttgtttttaatcggctgatgcagtgtcccaaaaatgccgaacgggctgttgcggttaatatcgccgattgttttccgttctgacgaaaaccttgccagtttttcgccgggattgccgccttttcctttttcaatcgatgttacagtagaacggacgatttctccgtcttctacaacaatcggtttttttgtatccatatcagagatgacgtggcccaatgcgccgtatttttttgttttcggttcaaaaaatgtcatggtgccgatgccggctgccgaatcgcggatataaaggccgattcgatatttcccctcggcttcgtcctttgtcggaatcagctttgttttgattttttgcttatcgcgtttcaccaataaatccaaagattcaccggttttgcccgctttttgaataaacggggcgatgtcgctcattttttcaattttatgtccgttcattttaataatgatgtcgccagattcaatacccgcttgttctcccggagactttttcccatcctttgtcatcacctggtgaaaaccgacgaccaaaacaccgactgaatgcagttttacaccgatggactgtccgcccggaatgaccttcaattctggaaggacacgcactttcgtttttttaatgggaaacccggcaagatcatatactacttctgaccggccttgtgtttgccctgttatgtttgcatgaccgtgctcttctttcagcgtaaaggcttctgataattcgcccttttcagcgcttattgatgcattgaccggaacggcctgagtctggttttcaaagacgctcatttctgacggtatcagtaaatattctttaaacggcttaaaaaagcctacacttagtaaagaaacaaggagaattacacctattgctttcctcatgttatcgtgcattcattccttcactctcctcgctcctatcccacaccactttctttttctgctacatctatacttttgccttcctgcgcttgatttataaccggcatacgaagaaaaacattggatacactgttagagaaatggaacaaaaaaataagctgcctgtatcagcagcttatcctgtcgtttttacctgtccggcctgttttaaaagctcttgtgcatgccgttttgtcagatcggtcacttcaacacccgcaatcatgcggccgatttccgctaccttatcctgcttggaaagcggcgtgacatgcgttgtcgtccgtccgtctttgaattcttttgcgatcagaaggtgtgtatccgccatggcggcaacctgcggcaggtgtgtaatgcagagcacctgtgaaccggtcgatactttatggattttttccgcgatggcttgggcaacccgcccgcttacaccggtgtccacttcgtcaaagatgatggaggtgacatcctgctgggaagaaaaaatactcttcatcgccagcatcacccttgaaagctcgcctccggaagcgacctttgacagcggttttaaaggctcaccggtgtttgttgaaattaaaaacctcacaaggtcaatccccttttgggtaagctgcacgggctgcccgttgacaaccggtgcttcactggctgacggatcggttttcacgagaaattccgtatcaaacgttgatttgcccatatacagactttgtaattcctgatgaatcgcttccgccagtttcttggcccatgcttttctgatttttgataaattggcggcttctacggccacatctttgccgaccgactccaattccttcttcagcgcttcaaggtggctgtcgcggttctcgatttgatcgatttcctcttctattttagagccgtattccaaaatgtcttctaccgtcgctccgtatttgcgcttcagctgtttgatctcatttaaacgggtttcaataaaattcagccgttccgggtcatattccagatcatctaacagattgcgcatctgaaaggttgcatcctccagcagataataggaacttgacacactttcagacagcttttgcagcggttcattaatatccgaaatatcttcaagctgggcagaggccattccgacccagtcaagccccccctgctcgctgcggagcgcattataggcgttttgcaatgattcataaattttttcaaagttggatatctgcttccgctcttcctgaagaagttcgtcttcattcaattcaagcttcgccgactcgatttcttcaagctgaaattgaatcaggtctaaccgatgcgccatttcctgctcgctttctgacagcttcttcacttttttgagcagcttcatataacgctcatagccttcatggtaagcctgaagcgcggattcggcctcagcgcccgcaaatttatccaaaagctccaagtgtttgtcgtcctccattaacagctggttatcatgctgtccgtgaatatctaataaaagtctgccgatttcccttaaagccgcaatcgtcactaattttccgttgacacggcagacgctttttcctccggcattgatgtcccttctcatgacaatcatgtcgtcagatgcgtctattccctgctcacggcatacttcaaaaacgggatgaccgctgtccaatagaaacagtccttcaagctcggcctttgtttcaccgtaacggacaaattcagacgagccgcggccgccgactaatagggaaacggcgtctataataattgacttgccggcccctgtttctcccgtcaggacggtgagcccccgttcaaacgaaatcgtcagttcctctataatggcaaagttttttattgatagttcagctaacaaacagcattccaccttttatctgataattacgctacagcagctccaaaagacggctttgtacgccttccgtatcttcaggcgtcctgcagatgattaagatcgtgtcatctccgcagatcgtgcccatgatttcttcccattcgagattatccatcagagcgccgattgcctgagcattccccggcatcgtttttaatacgatcatatggcttgctgagtcaatttttacgaacgcatccattaatgaacgcttcagttttgacagcggattgaaccgctgatccgccggcaggctgtatttgtaggagccgttgttcgtcggcacctttacgagatgcagctctttaatgtctctggagacagtcgcctgggttaccttatatccttcttctctcagcatgtcaactaagtcatcctgcgtttcaatctcatggcttgtaataagctctctgatttttatatgcctttggccttttgtcatgtaagcacctctgttttcaagctgtttgtcattatgttaaccgcttcttgataaaaagtacatgatggcagaaaaaaggaataatagccccctattattccggtacatctgtctttttggcttttaatgtctcatgtgcttcgcggacggtacggagaatgtcttcttccggcagttcagcgccgtttccgtcttctccgccccattccaaatgaagcagaaactcaatattgccgtctccccccgtaatcggtgagaaggacagtcctttcactgtatatccttcagaagctgcaaattgattcatgcggcggagaacgtcagcatgaacgccgggatctctgacaatgcctttttttccgacgaattcccgtccggcttcaaattgcggcttcaccagtgcgatacaatcgctccccggtacaagcagcgtttttaaaaccggcagaatgaggcggagtgagatgaaagaaacatcgattgtcgcaaattccggcaaaccctctgtgaaatcggaaggctcggaatagcggaaattcgtccgttccatgacgacgaccctctcgtcctgtctgagcttccaagcaagctgattatagccgacatccactgcgtaggaccgctcagctccgttttggagggcgcaatccgtgaatccccctgtagacgagccgatgtcaatcatcgttttgccttttaccgagacaggaaacacttccaaggctttttcaagctttaatccgcctctgctgacgtatttaagagggtttccttttaccgttaacggaagatcccgggcgattttttcacccggtttgtccaatcggttttcatttgagtatacgatgcccgccataatggcgcgtttcgctttttcccgcgtttccgcaaggcctttttctacaagaagtacatctaatcgttctttttttgctgtcatgatccaattcctttatgtgtcttcggcggcatcagcagttttatccggttcataacctcagccttcgtgagaccgatttcttcaagcagggcggttacgctgccgtgttcaataaaccggtctgggatgcccattctgtcaatcggtgtatgatacatgccgaggtcatgagcgtattcaagaatcgtgctgccgaatccgccttcaagcacggcttcttctatcgttaaaatcggcagaccttcattaagaatggccttcatcatttgtttatcaatcggttttatgaacctcgcattcacgacacgcacggacaggccttctttttgcagttcttcagccgcttccagcgccatttcaatggtcgtaccgaatgttaaaatgaccgcgtcttttccgggacggagcacttcccatgttccgatcggaatggttttcagctctttatccatctttacgccgagcccgtttccgcgcgggaagcgcatcgcgatcggaccttcctcataggaaagggctgtattgaccatatggcggccttcattttcatccttcggcatcattaaaacgaggttcggtatatgccgcaaaaaggcgatgtcaaagacgccttgatgcgtctccccgtcagcgccgaccaaaccggcgcggtcaatgccgataaatacattcgcgttttgacggcaaatatcatggacgacctgatcgtacgcccgctgcaaaaaggtcgaatagatcgcaagaaacggcttcatcccctgaagcgccattcccgcggccattgtcgccgcatgctgttctgcgattccgacgtcaaacatgcgctcaggaaattctttcgcaaatccttcaagcttagagccgaccggcatggccggtgtaatcgcgacaattctgtcatcctcgcgcgcaagctcctgcacggtgccgctgacaagtccgctccatgaaggcgccgcggctttcggcttgacaaaatcacccgtattgattttataaggacccgttccgtgccatgtgccgattgtgtcggtctcagccggtttatagcctttgccctttttcgtaatgacatgtaaaaggacaggacctttcgtttttttggcgtattgcaggttttcaaacagttcgtggtaggaatgaccgtcaaccgggcctaaatacgtaaagcccagctcttcaaaaaacatacctgacacaagcatatattttaagctgtcttttatccgttccgctgtggcggccaattttccgccgacggccgggatgcgcttaaataaatattcaagctcgtctttcacccattgatatttgccggccgtgcgaagccgtcccagcatagaatgaatcgccccgacattcggcgcaatgctcatctcattatcattcagaatgacgatcatatcttttttctcatcaccgatatggttcagcgcttcaagcgccattcctccggttaaagcgccgtctccgataatcgggatgatatattcttttgatcctttaatatcacgggcggcagccattcccatcgcgcctgagagcgatgttgagctgtggcctgtttcccatacgtcatgttcgctttcgctgcgtttcgggaaaccgcaaagccctttatattggcgcaaggtttcaaactccttgccgcgcccggttaacagtttatgaacataggactgatgtccgacatcccataaaaatttatctttcggactgtcaaattctttgtgaagcgcaattgtcagctcgacaaccccgaggttcggcccgatatggccgccagaggcagacagcgatgtgatgaggaaattgcggatctcctcactcagctcttccagctgttcaattgacatctttttaagaaatgacgggtcctgtattgataaaagatccaaagcggatcaactcactttcagcatgaatttctgcaaattaaacagtgtctttttgaaaaaagaaaaagactccctttgtattttcatcgaaactgcttacattttaccataggagcggcagccccttcaaatcaggaccgtttttaatgatctctcgccgcgattaaatcacagaggtcatgcagcagttctttctgaagagaaaggccgctgatgatccgtttcgcctcgctgatatgatacgccagcttctctttcgcgccttcaagcgttaaaagcgacggatacgttgacttttcattcgacgtgtctgagccgaccggtttgccgatcttctcctcatgcccttcaatatcaaggatgtcatctctgatttgaaatccgatgccgatatggctgctgaacagacgcagcttttcgacttcatcctccggcgcatctgccaaaatggcgcccgccgtcacagaaaaaccgaggagcttggccgttttccgctcgtggatggattccagctcctcaagcgttatccgcttttgttccgcttccatgtcggcagcctgcccgccgaccattccttccgttcctgccgcgctgatcagctcatcgacgagacggagccgtttttctgctgaaaccgcctcagacacgtgagatgtgatcaatttaaagctttctgtcagaagcccgtctccggccaatacggctgccgcttctccgaagactttatggtttgtgggctttccccggcgcagatcatcatcgtccatgcaaggaagatcatcatggattaaggaatacgtatgaatcatttcgacagcgcatccgaccggaatcccgtctttttcatcttttccgtaagcattcagaacggctaagacgacgagggggcgcagcctctttccgcctgcttccaaagaatacagcatagattttttgaggatttcaggcatcgcaagccgttccgtatacaaagaaagctgctgttcaatcagttgtttgcgcgatgctaaaaatgcgtccagtttatttgtcaccttcgtcttcctcctgaacgctgaaaggtgcaagttcgccgttatcttttaaaataaagtccatttgcttttcgacatgctgaagcttttcatggcacatttttgaaagggccatcccttcctgaaaataattaatcgcctgctcaagcggcacgtctccttcttcaagctttgccacaatgccttcaaggcctttcatcgcctcttcaaatgtcagctcttcactttttttggtttctgtcattttcgttcgcctctcttttgcaatacttcacacgtcagaacgccgtctgtcatctttacttcaagcgtatcattttgttccacttgatcaacgcttttgatcagctctttgtctttataggccagactgtatcctctctccatcacctgaaggggacttaatgcattcagtttaccaagaaccgtctgaaactgcgaatgaagctgcttcagctggacattcatgcttcgggcgagctgatttgagcgctcctcgtaccgttttttcgcctgtttcagctgggtttcagggtggagcgccgttaatctgtacgtattccgctccagctgcctttgtttcctgtccgtaagccctgtgagctgtgattggaactgctgatacaaaagatcaaactgctgttctttttgggtatacaatcgtttcggaaaacggaacgcgtaggatgactggagcgattgaacccgttcttttttcttgctgatatgctgctgtatcgctcttgtcaggcggacttccgccgtttttgtccgttccattaagtccgtcgtgtgggggacggcgatttctgccgctcctgtcggcgttgccgcccggatatccgcgacgaaatcactgattgtaaaatctgtttcatgtccgacggctgatataatcggaatggcggaagcaaaaatcgcccgggccacgatttcttcgttaaatgcccacaattcttcgatcgagccccctccccttccgacgatcaggacgtcacacattttttgtgcattggcttcttcaatgcgcttcacaatcgatctgctggcattttcaccttgaacgagcgcgggaagcacaatgactttcacaagggggtatcttcttttaagtgtggtaatgacgtctctgacggctgctcccgtcggtgacgtgacgaccccgatcgtagccggaaaagcggggatggcctgcttatgccggtcatcaaacaacccttcgccggcaagttttttctttaattcttcatatgctaagtagagcgcccccacaccgtccggctgcatttctttcgcgtacagctgatagcttccgctcggttcatagacggagatcccgcctcttacgatgaccttcattccgtcctcgggcttaaacgcaagcctcgaactttgtctttgaaacatgacggcctgcatgcgggcatgctcatcttttaatgtaaaatagatgtggcctctcgtatgaattttaacattggagagctcacccttaatccaaatgtcttcaagatgagggtccacatcgaattttcgtttaatgtatttggtcagcgcggaaaccgtgacatatgccgcttcactcacatcctgcactcctttcataaaggctttttgccctaaactaagaaaacccgctctggctgaaaggagccttaagaagcgggtatcgtgctcattgtcacactttttgtgactgtctccggttatctatgataacgtacgtctggcagatttaacagtattatgcgcaagcattgtgatggtcatcggacctactccgcccggcaccggtgtaatgaaagatgctttttctttcgcttcatcaaactgaacgtctccgcagagttttccgctttcgagacggttgacgccgacatcaatgacaatggcgccctctttgatttgatcggctttgatgaaattcgctttaccgaccgctaccacaagaatatctgcttttttcgtatgctcagacatatttttcgtgcgggaatggcaatatgtgacggtcgcgttttcgttcagcagcagctggccgaccggtttaccgacaatattgcttcgtccgactacaacaacttctttgccggaaagatctacgttcgtctttttcaataactcgacaattccgtgcggcgtgcatggaagaaatgtatcttcgccaagcagcattttcccgacgttgagagggtggaaaccgtcaacatccttatcgggagagatccgctcgattacggctttttcagaaatatgatccggaagcggcagctggacgagaatgccgtggaattccggattttgattatactgatcaatcactgttaaaagctccgcctcggttaagcttgagtcaaagcggtcaagcttaaatttcattcccattgtttcagcggcttttttcttgcctgtcacatatgaaacagaagcgggatcgtctccgattaaaatgaccgccaaaccaggcactacgccttgtgctttcagctcttctacttcttttgccaattgttcgcgtttttctttagccgtttcttttccgtcgatgattgttgcagtcattttctttcctcctatgattcgatatcagttttaatgttagaaagaaccccgtttacgaattttgcagctttatcgtcgccgaaccgttttgccagctcgattgcttcgtttaatgacacgttagcaggaatgtcgtcagtataaaccatttcatacaccgccagacgcaggatcgcgcggtctacgtttgcaatccggtcaagcttccaattgacgagatggccggaaatcatttcatcaagctgaacctgatgttcgatcactccgtacaccagctgttcaaagaaggcatctgttttttcaccatcaagcgcgtgctcaatggcatcgttcggtgcaatatcgctgacatcaatctgaaaaagtgcctgcaaagctttttctctagctgttcttcttttcattttctttctccttcagatccgctttatccgcttgtcgttaagcttaaagagatcataacatatttttttctcaatcgcatgtcgaaatttaggttttttcaccctaatgccgaatattttcacaaaccgtattaatttcattcggatttcacagcatgaagaaactcggctgccgtttgtaagccggctttcttcatgcctgaaatgacgggaaacgtataaaaaaccaaagggctgcccatccccttggtttttatacgctcattacatttcttcgtcgatttcgacttcttgggctttcgtgtcaaattgaatgccgacgatatgaatattgatttcattaatggtcagagacgtcatgtttaataaggtttggcggatattctcctgaacgcttgccgccactttcgggatcgagatcccgaattgaacgacgcaatagacgtcgatggtaatgccgtcatcggctaaatcgacctttacgcctttaccgtgattgattttgccgaagcgctctacgacgccggtggcgaaattgccgcgcatttcagcaactccttcaacttcggaagcggcgatgccggcaatgacttcaatgacctcaggagcaatttcaaccttgcctaaatgagcctcgtcatgatccattttaagcacactgttgtcttccattcaattcacctcccgcaaaaattatgagcccattacatcatatgtttctaaaaactttgtattaaactctccgctgacaaatgtttcgtgttcaagcagtttcagatggaacggaatcgtcgtttcaataccttcaatcacgaattcgctcagcgcgcgtttcatccgtgcgactgcctcatcacgcgttgttccgtatgtgatgactttagcaatcatactgtcatagtacggcgggatcgaatagccaggatatgcggctgaatccacgcgtacgccgagtccgcccggcggcaggtacatgttaattttaccgggtgaaggcatgaagtttttcgcaggattttcagcattgatgcggcattcaatcgcccagccgttaaattcaacgtcttcctgtctgagcgaaagctcctgtccggatgccactttgatctgttctttgatcagatccgttcccgtcaccatttctgtgacagggtgctctacttgaatacgcgtgttcatttccatgaagtagtagcgctgttctctgtagtcataaatgaattctactgtgccggctcccgtgtaaccgacggccttcgctgcttttaccgcagcttcgcccatctgctccctgatttcagaatcaagcgcaggtgacggtgactcttcaagaagtttttgcagacgtctttggatagaacagtcacgctctccgagatggatcgtgtttccgtaattatccgcaagcacctgaatttcaacatggcggaaatcttctatgtacttctcgatgtacacacccggatttccgaatgccgtagcggcttcctgctgggtaatctcaatgcctttgatcagttcttcttctgtgcgtgcgacccggatgccttttccgcctccgcccgcagtggcttttataatgacaggatacccaatttcacctgcaagcgaaaccgcttcttccgtattttttataattccttttgaaccgggcacaatcggcacgccggccagctgcatcgtgtcgcgcgcgatatcttttgttcccatttttgaaatggcgtcagccgtagggccgacaaacgttacgttcaattcctcgcacagctcggcaaagtcggcgttttcagctaaaaacccgtatcccggatgaatcgcatccgtgccggtcagctttgcgacgctgacgatgttcgttacatttaaatagctttcttttgatgttttcggcccgatacaaaaagcctcatcggccatttggacatgcagggcatctttatctgcctcagaataaacggctacagtttcaatgcccagctctttgcaggcccggatgattctgacggcgatttctcctcggttggcgatcaatagctttttaatcataatagcaggtctccttactcagcttttacaagaaatagaggttgtccgtattcgaccagctggccgttttcaactaacacttcaacgatttctccttttacttcggcttcaatctcgttaaagagtttcattgcttctacgatacaaacaactgtattttcgctcacttttgaaccttggtttacgtaagggccggcttccggcgatgaagaagcataaaacgttccgaccatcggagacgtaattttgtgcaggttttcgtcttgtttcggcgcttcctgaacaggagcggcttcacgcgcttccggttttgcagcctgcggagcaggtgcgtaagcggcgggaacggcttgggcttgtcccgttacattcactgccggcgcttcattttttttcagtttgaggcttacgccttcgatttcgtaaacgaattcgtcgatggaagattcatcgattctttttatcagttcatgaatttcgttgatttttaacatcagtttccactcctatgtataaaaaatagaaatttatgggttgctactaaaagtacatactatgtttatcttacaggagcgcttgtgtaaattcaatactgatctaaaatgacatcagaaaagcccgcagcaggtgcgggcggtggagatctcttattttgtcggttcaaacgtgacggcgacgtctttcatcgtcttgatttctttttccaccaggtcaatgatagcggaagcttttgcgtttgaatgtttgtcagacatgaccgtaatgttgattttgtctccttcagcatccacgagcgcatctttgtagccttgtgttttaatcagcgtttccagctgtttttccgtcccttcagcattgctcagcgccgtcattttatcgtaggcttcgcttttttcctttgcggtcgcatcatcgcttgaaacaatgctgtttaactgttccctttctttgcttcttgcgtcttcaagctccatgcggtatgcggtaaataagttttcatcagctgtttctgtagcgaccgatccgtctttgtccgatgcttcggctgatgtttctttatcctcttttgtgcctttagaatctttcgttccttttgttccgtcttctttatccgtgccgcttccgttcttatctttcgtttcaggagccggcgttttttcagttgccacttctccgctgcttttttcgcttttcatctgcacggcatttttgctttccggcgacataatataataaacacttaataccacgacgagactgagcattgttaaaagccaaaccgtttgttttttcagcatgatttatgaatcctccttgatttttttaggggcaaccgctacacggtagctcggaacatcaagcacccttgtgacggcatcaatgatggttttttttatttgaacgttgtccactccctgagcgacaacgagtacaccgcgaatatcgggctttttcgtctggacgacgaccggggtttccttatccccgtttcgaatcatgacaatttgctcctctgaggtttgatcggttacgcttcttttgccgccttctttatcggtttcttcggtggtggtgtcttttttcgttttatttttctcaaacactttcaaagatgttgcgtctacgttcacgacaattgatacatcctccacgccgataatcgtttcaaggatttctttcagctggttttcatagtctctttcataatcatcgatcgtgtttttggcgctgctgtctttcgatgccttaaaaacgggtgcgcttttttgcccgcttttgtcttccgttcggccggacatgacggtctgcgccgcttggtccttcccggttttctccggtgaagagaacagctggctcaccagcataaaagataccccgagcacaaacacgaacagaaagtaatgatattttgtcagttttggtttttctccgtctttcgcctgtccgatcatcagctgttttttgagtatggtccatagtccgtttttattcatggccgtttttctccccgccttccatataaaccgtaattttctcactgccgatttcccatatatccgcaagtttttctttgatgtctgcggcctcttttttgtcggctgcgccttccggttcgtatttgcggtctgtgcggatgtcgatcggtgcgacggtttgcacggttttttcagaagatggggccatatacacgctgatcgttcttacatcttcttctgaacgaacctgttcttccgctgtaaggcggatgtcgtctattttgtattcgtcatgactgaacatctcctccgctttcttttttagttggacagccatttcttctaaaacatatgcgcggtttgatgcttgtatttcttttttttctgatttgatttgattttttatatcagcggattgagattgctcttgttttgtcaaataatcgaagatgatttccgggtctgttttgaaaagtttgaagatcgggttgagcatgacaatgattaacagcaggctgacaaccatcttggcgtatttttgcatactggagcttggcagcagcatgtcgatgacgatggcgaataagataaataaaataatgcttgtcagccattctgttaaaaagctcatatccaatgggcctcctttatttcatcatcatggtgaggttgcctgctgtaataatgactgtaatactgaggaaaaacatgagagagacgatggcgagcgccgcgaaaatatacagcacgcttctgctgatgacgccgaggcacgtaatgacgggcccgcctccgagcggctgcagaatagcggccgcgagcttataaataaaagcgagcgagagcactttaatcgccggaaacgcggagatgcagatcaaaattccgactcctaggattcctacggtgttttttaataggagcgaggcgctgatgaccgtatccgtcgcatccgtaaacatccggccgagcacgggaataaaattgcctgtgataaattttgcagtcctgagggtaatcccgtccgtcacggcagccgaagccccctgtacggagatgacgccgagaaacacggtgagaaatacggcaagcgcgccgatcgcgatatttctgagcagattggcaagctgcgtgactttatattgatccgtcatcgtgctgacgatgcttaaaatcgctgacaggaagataagcggcatgacaatgttttgaatgagaaggccgctcgtattcatcagaaataaaataacggggtgaaaaaaagctgcggagacggctcccccggaagacgccaaaagcgcgagtaaaagcgggatgagcgcgagaatgaaacttgtcatcgtctggatcgcttcactggcataattgacggcaacatgaaagctgtttaaagcgagaataatcagcaccatgtagacaattgcataagccactttgctgacggtgctctgctggaacgcattttgcaaaagctgcagaatgacacaaaaaatggtgagaagaatcaaagttcccaggagctttccgtttgcgagcacttcatgaaacaagtatgaaaataaagccttcagccatgcctccggcgagaacgttttttctccgttaataaagtcgatgatgcttcccttttggctttcaggcagaagaccgccgtattctgtcatgatgtcgtcccaaaactttccgatgccttctgttttcagcgcttcagcctgctttttcgccacttcatcagcggattcttggtgaactgcggtttcctgcgacgcaccgtctgttccggcagcttgtacacattcagtctgaaaaaataagaggatgaacaaaaaagcccccgcccaccgaaagcgcttcattttttgtgcccccctttccattttattgatgatcaagaaggaataagtccgagaatcgtttcaataatgacggtgagtatcggcacggccattaccagtatcaaaatttttccggccagctctattttcgaagcaatcgctccctggcccgcatcctttgtcagctgcgcaccgaattcagcgatgtaggcgatgccgataatttttaaaatggtttccacatagaccatattgacatttgcattgacggctattttttctatcattctgataatgtcgtaaatctgatcgatgagatagagaaagatcacgcagccgctgaagacgacaatcataaacgcgaaagtcggtttctgttctttcacgatcagggagagaaatgtggcgatcaggcctaaacctacaatttgaacaatctcaatctgtaagcccccctatccttggaatagaaacacagctttgatctttttgaacaggtcatcgacaatcgtcgccaccataaataaaatatagataaagccaagcagcgtcacccattgggcgtattctttttttcccatttggtcaagtatggtgtgcagaaacgcaaccacgataccgactccggcgatttgaaaaatgacatttacgtcgactcccattttatgtttgctcccctcatgtttacatcaatagaagaatgagtaacagtccggctaaaaatcctaagcttttcaccattttttcatttttcgcctgcgcccgtccggcatccgcttccgccgcttccaaatgtgtaagcgcaagcttgatatgtttctgctgagaaacacggtcatggagcccgagcgtctctccgaattgcttcagcacatcgtattcgctttttttcatcgccatggaagaccagttatgtttcaagctctgttcccaagccgttttggcggaatcgcttccctgctcaagccttctgctgaaagctagaaacaataacgatacaggttcggaaagctgtgcggcaatttgtcccgaagctatgtgcagcggcgtatgcccgaacatgatttccgcttctagcgattggagcgccgcgcgcagctgacggatctgcctcggcctttcaatatacattttggcgatctcaaatcccgtccatgtcgtcgctgtcagaatgaacacggcacctaaaagcttcagcatgacatcacgctttcagcatgcggaacaggtttcccgtcctttccgtaaatcctgctgatcgttcccggaccgcggcgtcttgacagctccacataccggtcaaacacgttttcctcccacagcattttcagcgacggcctcttgaccaagtctttcatattccatccgtgcgcagagacgataacggatacgcccgcatggagcgcctccagcagcgcttgtgagtcttccattctgccgatctcatccacaattatgacatcaggactcatagagcggatcatcatcatcagcccttccgccttcggacaggcatcaaggacatcgactctgcggccgaaactgtgctggggaatgccccgcaggcagccggcaatttccgaccgttcatctacgatacctgtcttttttgccgggatgcgtgttgatccggtgctggaaagccgggccaaatcacgaagcaaggtcgttttccccgtttgcggaggaccgatgatcagcgtgttcagccagttttctttccataagaaaggaatgagcggttctgcgatccccagcttctcccgggcgattcggatattaaaagatgtaatatcccggagtcctttgacggctccgttttcgacgatgactcttccggccagccccacacggtggcctcctctgattgtgatgtatccttttttcagctcttcttcaagcgtgtacatactgtagttgctgagccggctgaggatcagctgtgcgtcgccggccgtacacacatatgacaaatacaaaggttgtcctttttggatcagttcaaccggcctgtcgacccggattctgatttcttctgtatcccgccttacttcttcgggcacggcggagatggcatctctcaataattcagggagaacctctgtaatttcattcaatagagtctcctcctttttaccgattggcttctttaaaatgtatgatccgggacagactttatgacaccctggccctctatttatgcacaccggccaaaatcagcaccacccccgcaaaaatcaatattaattttgcatatgagagctgtccggcaatctgataaatgccgatcgtcattgtgatgataaagatcagagggccgacgattgccaaaatactattcaccacaaccgcttttctgatgtcgtttgtcaaaagcatgataatagcggccgataattcaatgagcgaggacaaaactcgtaaaccggccatcgttaaaacagtagaattgattgaaccgaacaaaattttcattgcaatcccccaacttcaagcattttgttacactatatgctctagctgacggaagtagtctcactattttcatatagaagaaagattctgaggcagaacgcaaaaaaagcctgccccgtaaaaggagcagactccgaatttctttaactacgctcttgacacgtaagaaccgtctgatgtatttacaaccagcgtatcgccttcgttcacgaagaacggtacgtttacgacaaggcctgtttccgttttggcaggtttcgtgccgcctgacgccgtgtcgcctttaattcccggctctgtttcaacaactttcagttcaactgtgttcggcagttcaataccgagcgtttcagactgatacatcatgatatgcacagacatattttccagaaggtatttcaattcttcttcgatttggttttcgttcaattcaagctgttcatatgagcttgtatccatgaacacgtgctgatcgccgttggcataaagatactgcatcgtttttgtttcgatttgagctttcgcgactttttcacctgcacggaatgttttctcctgaatagcgcccgtgcgcaggttacgcaatttagaacggacaaatgccgctccttttcccggttttacgtgctgaaagtcaacgacgcgccaaatgccgccgtctacttcaatcgttagtcctgtacgaaaatcgttaactgaaatcatgtttgatgtcctcctatattccgatcacaaaataattaattctttaggggaatgcgtaattgtccggttgccgtcctcagtgatgaggatatcatcttcgattcttgcgcccccaacatccggtatgtatatgcccggctcaaccgttaccgccatgcccggctcaagaacggccgatgacctgaaagacagccccggtgattcatggacttccattccgaacccgtgtcctgtcgaatggccgaaatactgtccgtagccttttgcggtgatatgatccctcgtcagggcatccgcttcttttcccgtcatgccgggttttatatgcaggacaccaagcgcttgggcatcgtatacgacctgataaatctctttcagtttatcacttggctctccgaccgcgacggtgcgtgtgatatcagaacaatagcctttataataagcgccgaaatcaagcgtgaccaagtctcccttttcaatcaatttgccgcttgccactccgtggggaaggctggatctgactcccgaggcgacgatcatatcaaaggaagagccgtctgctccttgacgtctcatataaaattcgagctcgtttgcaactgaaatctctgagatgcccggtttgataaacgtcagaatatgttcaaacgcatcatccgcaatcttcgcagcttcctctaatatcttaatctcttcacttgacttaatcaagcgcaacttttcaacggaatccgcgacgggaaccatctccgcttcctgcagcaccgcttggtaggatgcatatgttccgtacgtcatgctgttttgctcgaagccgagttttttaacgccgtactcaagaatcgtatccgcagccgtttggattaagctaccgccgtgctcgataatgtcaaaacccttcacttgcgtcttcgcctgctcggtgtaacggaaatccgtgataaatgccgcacgttctttcgatatgaccgcaaggcctgacgaacccgtaaatcccgtcatatactgcagattggcggagcttgtcaccaacattccgtctatatccagctgaccgaaaagatttcgcaatttctccagtttcattccctttctcctcctcgccgattcttgactgccgcctgacaacgcgggagcatccccgcccggttttcagcataaaaaatgttcacttctcgtgaacattttaccataccggatagggattatacacttattcacttgttgccgagcgcccttgcaagcttgtctgacgtaagttcattgtagttgaaggaaattgagtagccgacaaacaaaccgtacagaatgtaaaggcaaagcgtcgtcacgattgtatctgatttcaattcagtgacggatttcacatcttcgaaaatcggattgaataagaaaaaaaccgcacaccataaaatgacgccgtacaccatccccggccacatggttttaaaacgcttcaggcagacgaaataaataaacgccccggcaattgaaatgaatccgatgacaacgatgctgaccatcgtgcctagccattgttttttccattctccgatcataaacggctgaagaatcatgttggggctgatctctgaaaaatgaaagacatacccgagatagccgatcaaactccaaaatacaccgccggcaaatccgataccgcaaattctgccggtaaatgaaacaggctgctgatcatcatcctgcttctttttttcttcctgttctgaatgtttttcgcttgtcatcatggcacctccagtcatagactgcccaaaaattaaaaagtcataaaaagctgcgccatattttcattcaatgagtaaaatctaaagaaacggggtatactgcatgtagaaaaagcattgattttccggctgtctaactagaggtttaccgcggtttcctgtacaatagagtgaaaggaaatggttagtaaatcctaagaaaacaggcaggttgataaacaatgtccaaacaaaaaacgccccctgcatacggcgggcaggctgtcgttgaaggggtaatgttcggcggcagaaaaaattatgttaccgccatccgcaggaatgacggaagcattgattttttcaagcttccgagagtgccgaacgccaagctttcggctttaaaaaagattccttttttgcggggaatcgtcgccatcattgaggcgagcgccaacggcacaaagcatttaaacttttccagcgaacgttacgggcttgatcctcaggatgacgccaagctggagcaggaagataagaagggttccggcttatcgatgtttttcagcctggcggtgatcggcgttctgtcgtttttgttcagcaaattcgtttttacgctcgtcccggtcttcttagcggagcttgtaaggcccgtattttcctcagacgccgcgcagatcggaatcgaaagtctgtttaagctgattctgcttctcggctacatttattttttatcaatgacgccgttaattaaaagagtgtttcaatatcatggagccgaacataaggtcataaactgttatgaacagaatttgccaattacaatagaaaatgttcagaaacagtcacggcttcattaccgttgcggttcaagctttattttatttacgatcattgtcggcatgttcgtctatttacttgttccgacagatccgctttgggtgcggattttagacaggattgcgcttataccggtcgttctcggcatctcctttgaagtgctccagctgacgaacagagtgcggaatatccccgttttgaaagtgctcggttatcccggcctgtggctgcagcttttaacgacaaaggaaccggcggatgatcaggtcgaggttgccatagaaagctttaacgagcttctcagactggaagacatttcagaacagagcgaaaagccgtctcacaacgtaatctgagccgttaccgttattattttggaggtgggcagttatgaatcatcgtgtacaacctttttttgctgtattgatagcgcttggcgcattcggtttcatttatgcggcggtaaccaaccccgggcagatgatttcaagagcgatcaccgttattatcgcaggcgttattatttattttatcgtgaggacggtcctgaaccgccgcaccggccgtgacggaaccgctttcagaaaagcggccagacaatcgcggctccgaatgaaggagcaaaaagcgaagcaccgcgccggacacagaggccgggtcagccatttgcggagcgtgccgagcagtagcagaccgaagccgatgattcttaagaaaaaaagccagacccagcttaccgtcatagaaggcaaaaagaataaaaagaaaaacagagcgcttttttaatagctccattgcttcaaaaattgctctgttctgctttttcctagctcaatgagagctagttttttttgcggtgtgagatgaaactccgtcgccatcacatgttccaccggaataaaaataatattctgttcgtactttgtcgcgatatgcctggcatcatgagcgtctttcatcgtttcaaacaaagccccgaacagctcaaaagcgttgcggattgattttttcgggcgctctttttcgttgggcgaaagcgaaattccgatgaccggccgtttgcgttcttttgaatacagccaaatcgggaaattgcttaacacaccgccgtcaacgaccgttgaggtgcctttttcggtcttcagttttatcggttcaaaaaaataaggaatgctgcagctcattctgacggctctggcaaccgggaacatctccggatttaatccgtagcggggaagatcgtcaggaagcacgatcatcgttccgttcgtcagatctgaagcgatgagacggagcgagccttttttcaaatcgccgaacgcgatgatgcccttcgcttttaatttatccgcaatccatttttccagcatatcgcctctgtatagtccgaggcgccaatatatcgacacccactgcaggattttcagcgggaggaatgagcatctctgatcaagcaattgccttccgtccacctcatctatgatggaatgaacctctctgctcgtatagcccgcagcgataaatgcggcaataatcgcgccggcgcttgttccggcgagcctttcaaagcgaaagcccttttcttccagcgcttcataagcgccggcaagcgccaccccttttatcccccctcccgaaaatacgccgtcaatctgcatagcgcgccctctcccttccatctcaaggtgtattattattttaagaaacggctgggcgaaatagaccaaagaatgaagacattaaaaaaagggcgccccatttcgggctgccctttattcaccgggattttcggtttttttctgtacggatttcaattcttttttccggctttcgtcatcttcaaaatactgaacgaggtcgccgatgcggtcaatgctgttccagctcagatgatgttcgattccttcaacatcattgtaaatcttctcttcatcaacaccaatgattcttaaaaactgctcaagcaattcgtgtctgtatacgagccgtttgccgatctttttgccttttgacgtcaatacgagcccgcgatatttttcataaatcaaatactcgtctttatctagtttttgaaccattttcgttacagaggaggggtggactgccaaagcttccgcgatatcagaaacccgtgcatatcctttttcttctatcagcatataaatctgttcaatataatcttccatacttggtgttgtcataagtaaccctcccaaaaagcaccttaactttataaaccattacaagtttacactaacggtcatgaaaaaacaaggatgcttccggtctgtcaagccttatcagcgcttataattccattcatcagacgcgtatttcgtctcagccagctcattgacaaatgcaagctcttcagacgtgagtgtgtaaggctcaagatgaatgttcagcccttcctcaaaaccggctttaaaagcgattctggcctcatccatcgttacccgtttcggcgctaaggcgttgatggctaccgctttgtttttgaaattccgctgcatgcgctcacggactctgtcgctcggatataaaaacagatcaaacagtttatcctcatcaatgtcaagcaggatggaaccgtgctgaagaatgacgcctttttggcgtgtctgtgcgcttccggcaactttccgtccttcgacgaccagttcataccacgaaggcgcatcaaagcagacggacgagcgcggatttttcaagctttctttttctttctccgttcgcggaatcgcaaagcaggcatcaagtccaaggtttctgaatccctgcagaataccttctgaaatcacccggtacgcctctgtcaccgtggccggcatttccgggtgatcctctgaaacgattacgctgtatgtcaattctttatcatgcagaacaccccgtccgcctgtcggtcttctgacaaacccgaggccgtgtttatgtactgcgtcaaagttaatttccttcttaatattttgaaaatacccgacagacaaagttgccggattccagccgtaaaatcggatcaccggaggaattttcttttggctgtgccaatataaaagcgcttcatccagcgccatgttaaatgccgggctttcattccctgagtcaataaaccgccatgtttctttttccatatactgaacccttctttatcgttttaataaaatcagtttagcaaactgccttgaaaatgaaaaatatttcgtttcattaaggatgacaatcgcttcatgctttactataatagtatttgtcccaaaacgtccggtaagccttgttttcaggaagcagggttttgattttataagctaaaggagtagaattgcattgtctaatatgattgctttaattattgttgcggcgtttatcgtttatatgatcgtgtcgtatttttaccagcagcgtttaatgaaaacacttacggaagaggaattccgcgcgggctacagaaaagcgcagctgattgacgtccgtgaaccgaatgaatttgaaggcggccatattctcggcgcgcgcaacattccgctgtcacagctgaaacagcgcaaaagtgaaatccgtcctgataaacccgtttatctgtactgccaaaacaatgtccgcagcggacgcgcggcacagacgctccgcaaacacggctgcaaagatatttacaacctgaaaggcggatttaaaaaatggggcggaaaaattaaagcaaaaaactaatcatgaaaaaagagctgtccgttttatacggaagctctttttttataccgtgtcagcggctgacgtcaggtgtacgttcgtattttaaaaccggctttcttgccgccttggtttcatccattcttttgacaactgttgtatgcggcgcctcctgaacgatttcaggcgattcctccgcttcccgcgcaatttgaatcatggcatctataaacgcatcaagcgtttccttcgattccgtttccgtcggttcgatcatgatgctttcttcaacattgagaggaaaatacacagtcggcggatgatagccgaaatccaaaagccgtttggcaatatcaagcgttcttacgccgagctttttctgccttcttcccgataacacaaattcatgcttgcaatgacggtcaaacgggagatcataataaggcgcgagtcttctcatcatataatttgcatttaaaaccgcgttttcggtcacagcttttaagccgtcaggccccatggaacggatatacgtgtaggctctgacattaatgccgaagttgccgtaataaggttttacgcgcccgatcgactgcggccggtcatagtcaaaagtcaaacggccctcttttttcgtaagaacgggtttcggcagatacggaatgaattcttttttcactccgaccggccctgagcccggtcctcccccgccgtgcggcccggtaaatgttttatgcagattaaggtgaacgacgtcaaatcccatatctcccggtcttgctttacttaaaacggcatttaaattcgctccgtcataataaagctttccgccggcctgatggacgatgtcagccatttccgtaatgttttcttcaaacaacccgagggtgttcggattcgtcagcatcagcgccgctgtttcttcgtttaccgctcttttcaaatcttcaatgtcaaccagcccgtgctcatttgacttaacggtaatcgtttcaaaaccggcgaccgtggcggatgccggattcgtaccgtgggctgaatcagggacaatcaccttcgtccgtccgaagtctccccgcgcttcgtgataggcgcggatcatcatcaggccggtccattcgccgtgagcgcccgccgcaggctgcagcgtcacctcgtccatgcccgtaatctcctccaagtgtccgcttaaatcgtataaaagctcaagcgccccctgaactgtgtcctcgtcctgaagcggatgaatagcggaaaaacctgcgaaccgggcaattttttcatttaatttcggattgtatttcatcgtacaggagccgagcggataaaagcctgaatcaactccgtggtttctcttagaaagagcggtataatgccgcataatatcaagctctgatacttccggcagctttgcgtcttcatcgcggatatagtcaccgggaagaaggctttcaagctctgtttccggcacatcaagctccggaaggctgtaaccgacacgcccttcgcgggacatttcaaaaataagcgcctgatcttgattattcatgttgatcccccaatcccgcaataagcgaatcgatctcttctttcgttctcagctctgtgacggcaatcagcatatgctgattcagttccggatacgcaagacctaagtcatatccgccgatgatgccgtcttgcaggagccgccggtttgcttccttgacgggaagattcagcctgacggcaaattcattaaatatcgggccgtcaaatgctacgtgcaagccggctttttccgcttggcgtctcgcgtaatcagctttcaatatattttgacgggccatgtctttgacgccgttttttccgagcgccgtcattgcgactgaagccgctaaagcattcagcgcctgatttgaacaaatgttagacgtggctttgtctcttctgatatgctgctcgcgcgcctgaagagtgagaacaaaacctcttcgcccgttttcatcctccgtttggccgacaagccggcccggcacctttctcatcagttttttcgttactgcaaaatagccgcagtgcgggccgccgaatgccgcaggtatgccgaaaggctgcgcgtccccgacgacaatatcagctccgtatgccccgggcggtgtcaaaataccgagcgcgagcgggtttgaagaaacaatcagctggctgtttcctttatgtgcgagcggctcaatgccctttaacggctcgatttgtccgaagaagttcggatactgaacgatcacggcggccgtctcatcacaaacggcatgttccaatgcttcaagatctgtgacgccgtttttcgcgggcacctctacaacctcaatatattggccctttgcgtatgttttcaaaacatcccgtgattccggatgaacggctgcggaaatgacgatttttttctttttcgtatgtcccgatgcaagcatcgccgcttccgcaagcgccgttcccccgtcgtacatagaggagtttgcgatatccattcccgttaattcacagatcatcgtttgaaattcaaaaatcgcctgcagctccccttgtgagatttcaggctggtaaggcgtataagccgtgtaaaactctgatcgggaaatcacatgatcgacgataaccggctgatagtgatcgtacactcctgcgcccagaaaagatgcatatgtaacagcgtctttatttttcgccgcaagctttgtcagctctctcgtcagctccgtttcagattttgcttgtttaatttggtagtctttttgaaacctcacatcttccggaatatcggcaaacagttcatcaattgtttctgcgccgatggctttcagcatttcttttttatcctgttctgtcgcgggcaaatatcgatgcttcatatgactctcctttttcagttctgttttggacgtttataaaacggtgtgcggacaaccttcgcttttaccgtttttttacggatttccacttctacttccgttccgacttcactgaattccgttttgattaaggcaaggccgatatttttctttaaagtcggagattgcgtgcctgtcgtgacttccccgatcggaacaccgtcttttttcacggcgtacccgtgtctcggaatccctttttcaatcatctcaagtccgaccagctttcgcggggctcctttttctttctgttcacgcaatacagatttcccgaaaaaatcggaatctttcttgtgtttcacggcaaatccgattccggcttcaatcggtgtaatatctttcgtcaattcctgaccgtataaagcaagcttcgcttcaaatctcagcgtatcacgggcgccgaggccgcacggaacgaggccttcatgctctcccgctgcaagtatctccttaaatagatgaaccgcatcttcattgcggcaatataactcaaacccgtcttcaccggtatagcctgttcttgaaagcaggacttggcgtccggcaacgtccgcctcgtcaataaatgtaaacggctttaaggaggacaaatcacattcagtcagcttcgcaagaaccgtctgagcattcggcccctgaacggcaagcagtgaaatcccgtcagactgattcgtcagcgtgacgtcgccttccgcatgttccgtcagccaggcgatgtctttttcaatattagacgcgtttatcacgagcagatagcagcgctcgcttttctgatagatcagcaaatcatcaaccgtaccgccgtcaggataacacatggcggtataaagcgcgtttcccggctttaaatcggcaacgtcatttgtcatcattttttgcagaaaagacagggcgtctttaccggatacttcaacttcccccatatgagacacatcaaacagtcccgcttttgtgcggacggcttcatgctcctctttaatagaagaaaattgaaccggcagctcccatcctccaaaatcaatcgtttttccgccgtattctttatacacgtcataaagcggtgttcgtttcagcatcatcttccccttcagtcattggcgcattgtaaaaacatataaaaaaggacagagaaacacctcatgaaaatgaaggtttctctgtcccggcacctgaaagtttactttatgaacatatcataaagacgtcccctttggtggcctgcttcttctaagtgcagacactctccagagttgcgtcgagcaagagttcttttgcctgagagattcactccgcagtttgctccttcggcgcccggacgcccatctttcgtccgagtctctccccttgctgtcattcgctcatatttaccaattttatggacatactaaagcaatatcttttagtgaaatcattacttatatcctaccaccctcatttacgtccggcaacaaaaattatgataaatcagttttttaaaagaaaggcggttttgttacatatgacagcagagatcatatttgatgcaaactggccgggagagttttctgagcggctgaaaacggacggtccctggtcaaattgggagatgtacaaactgtcggctgaagtccagcagacccttgccattcctgaattcgaagggttgagggctcctttgtaccttcccgatttcactccgcttccccatcagcttgaggtcgcgcagaaagtcgttgaaaaaatgaacggcaaggcgattttggctgatgaagtggggctcggaaaaacggtggaagcaggcctgattttaaaagaatatatgattcgcgggctggccaaaaaaatcctgattcttgtgccggcatcactcgtttcccagtgggtgaaagagcttcaggagaagtttttaatacccgctgttgaacagaagaaaagctatgtgtgggaacagtgcgatatcgtcgtttcttctattgatacggccaaacgctcccctcacaaagacattgtcctttctattccgtatgatctcgtcattattgacgaggcgcacaagctcaaaaacagcaaaacgaaaaattatgaatttgcgagaagtcttgtgaagaaatactgcctgcttctgacggcgacgccgattcaaaaccggatcgaagaaatcttcaatttagtgtcactgttaaagcccggccatttaggaaacgaaagcggatttcaagaaaccttcaatcagaaggacgggattgacgctcatgagcatttgaaagaactcgtcaataaggtgatgatccgcaacacgcggagcgacaccggccttacatggacgaagcgccacgtggaaacagtgccgatcaccttttcaccgacggaacaggcgctttacgatgacattgccgcactgaaaaacggcacggaaaagcccgcaagcgcattttccattatgacgctgcaaagagagtgctgttcaagcagggaagccgtgtatatgacgctcaaaaaaatgcttgaccaaaaagacaaacaagcgcccgcattcgatgaacagacgatcgctaatttaatggaccgcatcaatcaagtcacgcaaaactcaaaagcgattcaagttgttgacttgatccaaaagattaatgacaaagtcattatttttactgaatacagggcgacacagatttacctgcaatggttccttcagcagaacggcataagctccgttccgttcagaggcggatttaaacgcggaaaaaaagactggatgaaggatctcttccgcggcaaagtgcaggtgctgattgctacagaagcaggaggcgaagggatcaacctgcaattctgcaaccatattatcaattatgacctcccgtggaacccgatgcggcttgaacaaagaatcggaaggattcacagactcggtcaggaaagagatgtccatatctacaatatggcgacaaaacatacggtggaagagcatatcttaaaacttctgtatgacaaaattcatttatttgaaaatgtcgtcggagaattagatgacattttaacaaaaatcaaagtgagcaattttgaagaccatttgcatgatattttatgccattcgctgacagaggaggaaatgagaatcaaaatggacaatctcacctcttttctgtcgtacagtacggaaaagcccgccacaaaaaaaggctcttaaaaaggaggaagcgcgacatgagacagcaggaggttcaccaatttttactgcgcttttttgaagcgaaccactgcccgattacagaacacgggccgggttttatgacggttcagttgacggtcgagatggacaaacaaattatgaaccgcccgttttattggcattggcgtgaaaaaacgggcggcgaaccgaacccgatgaagattacgttcatcactgataaagaaacggctccggaggatatggacggcgagtttatttactttggagccccgcgcctctttcaaatctttcaagcagttaaacaaaatgggagatttacaagaatatatgagaaaattgtatcagccggagccagagtgccgcttcagccctggcttggattaaatgtagtgatttcataccaatccgacatgaaaaaagacagacttttgtctttaggcctgcatcttgtttctggaacaattatagaagggtttcagcagaagcttgcaccgcttccgctgacctcgcaaatatcagactattgctttaccatatcgccgatgattaagccggaaagcgggattaaaaggatggagcattacttaaaagacgctgccgccaaagagccgtcagactgggctgacagcgcgatcgccagatggaaaaaggacctcaggcttctcgatcagttttatgagcagacagaagaaaaacctgaggaataccatttggaaaaacaagcgctgaaagccttatatcagccgaaaattcacattcagattgaaaatggcggtttatttttcctgcaaagtaatttttctggataagcgttatccattcgacacctttcccgttttttctggaaattctatattataataaaagtatatagaaaaaatttctggcgtttcgcatgcgatgaatcacttccagacatgtaaagataaggtcatgggcggattggctgaaatacataaacaagtattttaggaggagaaaatgcatgaaaaatgcaaaaatggaattttcgcaattagataaggaatgggttgagctgatattagaagctcaaaaagcaaatatcagcctagaagaaatacgcaaatacctgctttcgcataaaaagtcttctcaacatatccaggcagccagaagtcataccgtaaatcctttctgaatgtgctataatatcacaaggaaggtgatgacattgattggccagcgtattaaacaataccgaaaagaaaaaggctactcactatcagaactagctgaaaaagctggggtagcgaagtcttatttaagctcaatagaacgaaatttacagacgaacccctccattcaatttctcgaaaaagtctccgctgttctggacgtctcggttcatactttacttgatgaaaaacatgaaaccgaatacgatggtcaattagatagtgaatgggagaaattagttcgcgatgcgatgacatccggggtatcaaaaaacaatttcgtgaatttttagattatcaaaaatggagaaaagcgcaaaaagaggagtagtgccgccatatgtgcacaactcctcttttaactgtccgactttcggattagtttttatcctcactgtgagccttttcattttccttgacgtaaccgtctttatccgtatgatctttcgtaatggtcaagccgttccattgcgttgcttcaaaagagaattgaagagaaatcgcattgccttggaacttgttttgcacacttaatccgtccgcagtttttgcggtgtcatttttaaattggatttccattctcacctggtcataatcagcaggcgttttcggaactccgtcgtactcaggagctgttttgccgttaatggttgccacattgacttttccgctctcactcaggaatttcggatcaatgtgcttgctgatcgcttcggcagctgctttatcctgttttgttgacattaagtataagtctttcaggctggccgcctttaaaatgatatttttaggatagccgttgcccccttctttaccgactgtcagaaccgtaatttcaaactggctgaggaaatcctccgcagattcatttcctttctttgctcctttaaagtcagtaaaattcaaagccatcagcacttctttaatggcaagtgaaccgttgtttctgaattcaaaatctttcgtcaatttatcacctggttttaagtttgacaaattgacattggctgattgttctttagccgataaatcaagtgttcctgacgcaaatgtagcgtccgtcgactttacatcattaaatgcggcccatgtgcctcctcctactaatgctaaaccgagtgcggcagaggcaacgcccaagcttaatttctttttcatacccatgtttgtactccccttactttttattttttgttatcaaatcctgtcgccaggttgcaaccgtattcatgtggagatggttccctttttcgcatgttcttccagcgctttcgttttccgctcaatatcgcggagggcgctgacgatgactgttattgagtaaatcaaaagcatgacgccgggaacgattaacagaatcgccgttccgatcggctggcttgccaaatgtatgacatatcctgcatacggaagctgatatcccgtatactgggccgccactttttcagcttgaacgggtgcggcatccggggcggcattatggtccccttttgtctcaaacagcaggttcccgtccttttttgtgatcccgattattctgtgtgtgacggctgttccgtcatcttgcgtaaaggtgatcacatcccctttttttaagtcattcacgtcagaaattttctttaccgctatgagcgaacccgtcttaaattccgggtccattgaacccgacagcacggatttcagcgtatagccgaagatggccggctcacccccggaagcccgggtcgaaatcaccgttaacgtcagcacaataatcagactgaagatgacggcatacaaaatattactgatcagtttcagcgtttttttcatgttcttccccgctttcttttaccggctcagccggctctttctccgttttctttagatcagaaacggttgcctgttcccggcatttgacgagtttcatcggttttgaccactcaaatttttcttcgtccgccggatacccttcaggcttgtaaaccttgaatgcgtatatgcccggctgcaaagaccgctttgactcaattttataaatcgttttgctttttttatcagtaataagccctttatccacaacattgccgtttcgtaaaggctgctgctgagaagcgattttatggagctcccatttccagtcagaaacagtccgctcttttcccttattctccagctcggcatagagttgaagcggcgcacacacggtgcctgacgtatcagtttgatttgttatatgtaaatcactctgatcccagcgttcgtcataacggcaatcgtcatccgtatattgaaaatctccgcacgtttgaaccgggagactgaagcttttcacatcattgaaggaggaacttgtatcacctgtgaactgagcacatatcgtcacggacaggcaaaaaatgaacgaaagccgtaaaaatagcatcatccgccatctcaccttgccctttttttccattcgcaaccatcggaacatgccttaccccctgtaaaactgttaataaatatgacaaccgttctttttaaagaaccgcatgaacaaagtataatcaaggattatcgtcttgaaaaatgtcaaaatcggtcaaattgttcgtttttaagaatggtatctttcaaaaacatcgttttgcttcaaattacacacctttttggaattttttctaataaaacgtgagaaaataacgaggtgactagaacaaaatggaaagtatatacagcgaaaggacgaagaatgatgatcacacaaagtctgatttgcctttctcttcttgttttcggggtttcaggaacagctcaggcggaaacggtgccttattatgctgttcaccataaatcaaaatgggaaaagttagcagaaaaagaagctaaaaaaaggtatccgctcgcccaaacattatttattcaaaaggtgtgggatcggaaaagaacggatgaagcagtcaaacaataccacttgacattgcgggatggcgcaaaagaatttggtgtgtttgttacgatttcttttaatccctacagccaaaaggtaaataaaattgccgtcattgaggaataccaataagaccctcctgatacaggaggacctttcgtgtgattcactttatttttttcgttgcatccacagcttaaaactgtacggcaatattccgaaccagtgctgagaagccggcactttcttttctttccgcacttcttttcgctctctccgttcctgtttcggcgtatcgaaatatttaacgaattgctcagtcatatattttacataatcatttgttttcacggctctcacctcatagtgctgtctttactatgaagtgttgtctcgccgcctcttttttatacttccgtccattgaatcagctgtttcttcttctgatcgaacaaaaggtgagcctcgcgtctcgtgcctgacactgtttcggcctgaattgtaacctgaaccgtttcccggcgatcactcccggtgatgtggaaggaaacagttccgtacggaaaacgctgtgtaccagtttggaccttttgtccctgtgtcatatggcggcttgacagcagcgcgccgttttggagcagattctctccgatccagtactccccggcctctttctcaaatatttttcgggtgatgaaatcagatgaagtatagctgatgacaagtaaaactgcggcagaaacaaacagaatcgcgggatatataaaaccgtcagatttgtgcatttaatcaccttttaaagagctgtaaaccggaatgaccgcctgattctttttacctgtaacgcttgagatctctaataagagcaggccgtttttcacatcagccgttaatgatgccgtgttttgcaggatcggcacgtggccttttccgtttactcttttccttatcatcttatgataaatttcaaaacgcacttcttcgccccctgttttccggcatgctaacgccaatccgccgtccgccggcttcacagtctcagcctgtttacattcgttcatgatctgctgaacggcaatttgatgctcccggctgtctaatccgccgttatcggtccggtttgataaaaacagatgtaaaatcgggcccagggttcctgataggaaaagacagactgccaaggagaacaaaacattaagaagcgtaaagccagtctgttttgagaatgctgaggcacatttctttttcgccgcggtcagccgcacacactttgtaatactcaccatcctccttccacttcacaccgggagacggcggcttttttccggtcatcatataagtgctgatatgtttctgaagaagctggtacgcttcctggcgatcttctattttcagaccatctgtcagcatgcccgtccagaccggaatgatagacgtcataaggaacagccaaatggacattgctgatagtgtttcaatagtagagaaccctttatttccgtttagcatggacatttccgctccctaagtaaactgtgatctcataggtgaacccggcgctcttcaattgaatctttcctcccgaattcggatggcctttttcattaaattcaaggctctccggtaaagtcacaagtgtaatgtgaagcgaatcaaaagaacgttcgacaatccttccgcctgactgcagtttgtatttatgctcttttggtagaaaagtgatttttgttcttttatgttctgcgatagccgtttcctgcgcaagctgaatatctttttgaagctgttctgttttttgccgcacggcaaggtgggtgcagaccggcggaaccgtcgtgaacaaaatcgtcagcaggacggacgccaggcttaacacaatcaggctttcaagaagggtaaacccgttttctgtctgcctgttattgttcaactgtaacttctccgccactaattaagatctgtttaccattcgggcaggctgtattctttttgatatacccctctgattgtaaatcgttcatatccggcattttaccttcatggtcgatttcgtacgccgtcacttgggctttcaccatattctgcagtccttcacagcctttatgctgaatgctttgattatgttttgtaacgttaggaatggtgattaaaagcagaatggaaacgataaataaaacgatcagcatttcaattaaagtaaatccatcttgatttttcagacgaagcactcccttacatttggttcatcatctggtacatcggcatcagcattgacatgtagacaattaaaatcataccggccacaacaccgtaaatgacaggctggagaatgccggtatacttcgccgcgttttgttcaagacgctccatcataaactggctgtacgtataaagttcgcggtgaagcaggccgtttgcctgtccgtggctgactgcagccgcaagatctttttcataacacggatgcccggaaagagcggattctatggtttctccggctttcagacgtgtaatgagcatctctgcttcttcacgataaaaaggcagaaaagattgttctttaaaagctgttaagctgtcatagatagaaaggccggatttcagaagactgctgagctgtaaagagaaaaagtagctgttaaaaagaacggccgcttttcctaagaggggtattttcacaacaatgagcattttatcttgcggggattttttcttacataagaaccaaacgtacaaaaacaagcagaaagcggcggacagcgccagtgcgcaggcttcatgaaaatgccgaaaaaacgcaaagatgaaagcagtcgcaccggatgtattcatattcattgattgataaatcccagaaaactgcggaataattaaactttgcaggatataaaacatgacacagacggaagaaattaaaaacatcggataccggagcatttttttgatttgattcgtctgcatgagctttctctgtaataattcgccgctttgtttcatcgcccctggcaattctccgtgtttctctgcgaaatagcagatagagacggcttctttatgaaaagacagtgcctcaagcacttcgtaaaacgcatcaccttccctcagccggcggattccgtccgtcagctctgcaagctgacgtttatgcagctggagtttcagcagtctgagcccttcaatcagactgtatcctttttccgtcatttcaccgagccttttcaaaaaagccgcttgatccttcaacggccaggttcgtttaatccgcttcatgatacacccaccgatcgtaattgtcggtcgtgacatagccgagcgcgattccttttctgatcagcctgcggagcgtctgatattgaaaattggcgtgctctccctttgcttcccgaaagcattgggtgaggtttttcccgtagagcagttcataaatgcccgcacggcgtgtctgcctgtacatccggcagtacaccgaacagttttcctctttgcagaacggacatgttaaatcaaccagacgctgagcagcgatggcaatgacggtttgttcaatttctgtcatgttcaccccaaactccagcagtctgtatatggcgcccttagcatcccttgtgtgcaggcttgaaagaacgaggtgtcccgtcatggccgcgcggactgcgatttcagccgtctcggcatccctgatttcccctaagatgatcatatcgggatcatgtcttaaaatcgcttttaaaccggcggaatatgtgactccggctttttcattcacctgaacttgcaacacatcctcatctcttgtttctacggggtcttcaagcgtgacaatccgccggttgaaatgcctttttgcatagttgacaagcgagtaaagggtggtcgtttttccagatccggtcggtccggtaaacagaagcaggccgtgcgaatgcttcagaaaggacaatagtgcggcgcccgccccccgaaataaagacagtttatccagagggggaatctgccgcttaggcaaaagcctgatgacaagactttcatcattcattgtcggcaaggttgacattctcaaatgaacggtttccgtcggaagcggcagagacaatgacccgttttgcggcttacgtctttctcctatatccatggccgataaaaacttgaaatgagaaataagccttacgcattcctctttttttaagactctttttttcacaagagcatggccgatgcgaaaatgaatgaaagcatccttttctctcggcacaatgtgtatatctgaagcccttgccgtataggcctcgtttatgatgttcctgctgtatgtttcaatatttttcacaagactttcctccttccgcacgtattgtaaatcagatacacaaaagccggcaaaggagagattatgcgttttacactgtgtaaaacgtaaaaaaataaaaaataagccccctgactttgatttactgaatgaaatccggaaccattcggccattttcagccatcaaaaaagcaggcgtatgcctgctcttcttagcgtttcttttctttccgcaaatattttttttgatgctccctcaaaatgtctcctgtccagcctttctgccgcagataaatataaatcagcagggttgatacaataatgagcacgatggaacagatatacgcatatttccaatgaagctccggcatgttatcaaagttcatcccccagagagctccaagcgcggtcatcggtgtaaagagagttgtaaagatcgtcaaggctttcacaatttcatttcctctttgggaggtaatgacttcctcggcgtgcagcagattgctcagttcctgatcaaactcattgatatatgtaatccctctttccatcttatgatgagccctgaggtaatctttctgcctgtcatttttcgggagaaacgcttcttttaaagccatttccacttttttagctcccagtgtaagacctttccaaatgaacagctcatggcgcagtttatgcacattttccaagattcctttgctgttgtcatcatgaatctgccatttcagcgtccgctgcttgacttcaaattcatccagtccgatcagataggaattcatcagctctcccagcagaacaaaaaagccttcaatcggattttcacaggtttgaatctgctgtgtggcatgcttttcttttacaccgcgcagcagcgaaaaatcaaaattaatcgtaaaaaagaagtctctcgtaatataaaagtgaaatacggtatggtttttttcatcatctaatccttgatgatagattaaagatccgaaaaccgcttcattattctgatcatttgtatctgagcgcagaaagtttatatgattttcatgttcaaaccacttttcgcattgcggccagtgattgtgatgaatcatttttttcgcttccgttttttcatgcggaccgagctggtaccacagccagtccgctcccgaatgtaccttcatctcttgtcatcctccagtatcgctttcttgttttattaccgtaaatgaagcaggctaaaccaggttcgatgtttgagcagctttctacagtggtattattccgaaaaaagggaggtgcaagccttccttcgcggaaggcgttacattgtatatcatcaaactatctgccatcgtactatttattttattaacggcgtgttttgtcgccatagagttttcaattgttaaagcaaggcgctcccgcattaatcagctcattgaggaagatgtaaaaggagcaaaagcagccaagcatgtcattacacacctcgatgaatatttatcggcgtgccaattgggcatcaccgtcaccgctttggggatcggctggctgggtgaaccgacagtcaaaacaatgcttcagccgttatttttaaaaaccggagttcacgaagcggttgcccaagtactgtcattgatcatcgcctttctgctggttacatatgtgaatgtcgtcatcggcgaactcgccccgaaaagttttgctatccaaaaagccgagcggattacacttttatctgccagaccgatgattttgttttataagttaatgtttccattcatctggctgctcaatcattccgcccgcctgattacagccatgttcggcttgaagcctgcttccgaacatgaaatggcttatacggaagaggaattgcgggtgctccttgccgaaagctatcgaagcggcatgatcaaaaaaagcgagctgcattacgtaaataacatttttacatttgataagcgcactgccaaagaaattatggtgccccggaatgaaatggtgagcctgccgttagacagcggatcgggacatatgctccgggacattatcaaaacaaataaatatacccggtatcccgtcgtaaaaggagataaagatcatgtagtcggcatcatcaatattaaagaagttttattcagattcctgtcagaaggaggggcgtttacaaaacacgaactcagcccttacatccagccggcgatccacgtgattgagacgattccgatttatcaattgttcgttaaaatgcagcgagaacacgcccatatggccattctcattgatgagtacggcggaaccgcgggattagtaacggcggaagatatcattgaagagatcgtcggcgaaatccgcgacgaatttgatacggacgaaacaccttccgttcaaaagcttgggaagaaccgctatctcctgaacgccaaattgctgatcagtgacgtcaatgatttactcggaacagagattacggctgatcaagtcgatacactcgggggctggtttcttactcagcatattgacgcgaagcccgggagcaccattgattttgaaggctacacatttacggtaaaagaaatcgacagccatcatatcatgacgattgaagctgacaaagctgaatagctgagggagaaatcctccccggccattcagctttttatcatcttaatgattcttttacgataaatccgttttttgccagcgccttcgccagactctgctctgttttcacctgagaaaaatcgatgccgagcttcacgacagtctgcgcgatttccggtctgatgcctgagattgtcgtttctatgccaagaagttttgtgctgtcaatcactttgaaaatctgataagcgaccatcgtatccacaatcggcactcctgatatatctaaaaataaataagaaagacggagtgaagaacattggtcaagcaccgattccaaaatcatttttgcccggtaggtatcaatttcgccgacgagcggcaaaattccaataccgtcggcaatcggcataatcggcgcgcttagttcgttaatcatttccttttgggcgtttaattgtgtaaccgtcactttataatattcctctgtaaatacttcaatcatatggtcaattgctttgttcagcttctctccccaatggaataccgcattcgccccgggcttctcagacatcgtttcacagcatgtctgtatgcggttccagaccaatctccggaattctttaaagctcgtgacgctttcatagaccggtacttcatggacggcccggtcccttgcgaactgaagcgcccactttgtcagctcctcttccccgccgtctttttccgataaaatgccggcaacgatttcaattaacagacggtgctgcatttccgctttctgatcatctgaaggccgccccgattttggtatgagcagccactggcgtgtgatttcacctgattcttcaattaaggttcgagataatgtttcattcaaatgtttcacgggtctcctccattcaaattactttgtatgtataaatcggcgccggacgcacatactgtaattacatccgatgggctatagccaagcggtaaggcaatggactttgactccgtgatcgttggttcgaatccagctagcccagtcccgcaaccgcaaaaaacgaagattagctgataaatttgatcagcggatcttcgtttttctcttatgatacagattgatgtaccgtttttttcttcgtcagcttcatcagttctcccggattgtatccgataacgagcttattgcgatcgatcagaatcggacgccgcagcagtttcggcttctcagtcaaaagcttcagcacttcatttacagtcatttcttcaatgttcaggttgaggtttttaaatgtttggcttctcgtcgccaatatttcatcaattccttcggtcgttaatgataagatctgcttcaattcatcaattgtcggtgtctccctgaatagatggcgctcttgaaagtcaacattgtgggcttttagccaatgtttcgtttttcggcatgatgtgcagctcgggtatgaataaaaaataagttctttcatttttaaaaattcctccctcggataatccgtctctttgttaacataagtaccctgaactttttttccctaaacgtatttcaaaaagatttttcggatcttttttagagagcggcataagatataaaacacagggaaagacataaattccacaataaatataatcatgaaaatgtttacattttgagtgccgatctattataataaacttcagatagactctcgggaggggataaggaatgaatcgcatgttccgggtgttaggattttggacggggatatttgcagtcatgttttttctagggggcatgaaagacgcttctcttttgttttttggacagacgatctttttcgtatttctttcttatttgaatctgactgagcggatgtatatttatatttttggagcttacttaaccgtatttttcgccggatttacatattactctatttttattatgacaccgggcggcggaacccattgaacagaaaaagacagaccgattatggtctgtcttttttcatttacagtgaaaaaccattgataaacgggtttcgctcctgctctgtctggatgtccgtttccggcccgtgcccgcttaatacaagtgtatgtccgggaagcgtgagcagtttttgatgaatggaatcaagcaatacgtcctgacttccgccgtgtaaatcagttcggccgatgcctccctgaaagagcacatcacctgaaatcaccagatccgcgtccttcacataataagaaacgcttcccggtgaatgtcccggcgtaaacaatgtctccaaatggaaaggcccgatgtccaaaatgccgtcgccttcgatgagccgttcggcgggccgtgccgttacggcaatgccccgcaatatgcctgatccgtttaaggaagagtcctccagccacttttcttcatttttgtgaagatagacgggaacatcccatctgtctcttacttcgtcaagtgcgccgatatggtcaaaatgggcgtgcgtcagtaagatggccagcggcttcagattgttttcttttatgtaattgttgattttgtccgcttccccgcccggatcaaaaataagacaggactgatcctcactgacaagaaaatacgcgtttgcctgaatcggaccggccggcattcgtctccatttcactttcatcacctctttatgtatatgcccttattatgaaggttttctgcggaagattcaatgaatgcggatgggaaaacgctatcgacaaataaaatgaaaacggttaaaataaaatggaaagattttcaggttccaatgacaaaggaggagcatgatgttactagttgtaatcttcggccttgtcgcattattagctgtattaggagtcctgcgggctgtcagacagagaaatatcctgggatttttgttagccgccgccacgctgggtgtgtttggctggtttaccgtaatgaccgttgtaaccagcggctatccgactgcacattaaaagcctgtatccaatggatacaggcttattttttattgctgcaaatgtttgctgacacttttgattttgctctccagcgtcgtttctttatcacgtctgtcatcaatgcggatatttgtcgccactctgtgcagccctttttggaacggggcttcgtgaatgtcctgaatgactgcgaataagtcgctcagctcaccttcaatcaacgtgttcatcggcgtgagctgaaatttgattttgccggcagctttgtaaccctccaaaatgttttgcacatccgctacatactcactgacgctcggtgtttttgttccgatcggaatgattgtgacatctgcaattgccatttggttcaaactcctttttcatttgttatgattggttctgtcatgcctgttttcagtgaaatcagacggtcatacgtaaagccgtataaagcgtattccccgttcggagagatctgaatcggctccatttccgtgtttttgagcaccgtccgctcccgttcgtctcctaagtcaaagctgatcagattgtaagagcggccttcaggcttaaatatgtaaaaccgcttgtgtgtctgatcgtaatcatattccatcggcgcaaagctctcatactttttttggagaggaaagcggtgtgtcacggatgccggcttttggaaaaggaactcgccgtctccgtccgattgatccgtttgtctgacggcaatcgtcatgcccgggcgggaatcagcccagatgacgtgatgaagcactcttttttcttttttcgtctgcaagtcataagaatataaaggaccctcttcctccgtttttccttgcttgatatattggaattcatcagtggaggtccaatgaacaaaaggggcctgaacgggactcttttttaaaatgccgttgttcatatcggccgtataggctgtgaagtcccatgtttcagtaaaaacggtaatcatcatttgatacgggtcatacggattccaagccgtctccagctcataagagttaaaggctttgtgataaagtcttttcccctgcttgttcataagcacaagctcagtctgaccgctgcttgtcacctgtacgagaatcagctgttttttccggctgatctttacattgacaatattgccctttgtttcatagagccgttcggattttccgctgaaaagatcatatttcatcagctgatgatgtgctgtatacagaattgttctgttatccagccatccttccgttttttccgcttcctttttactgagcggaacgattttctgttctgccgattttgccgaaacgcctgtgtcttgctgctgatgagatggttcacaggccgctaaacacagaacgaatgcggacagcagaacacaaaccaagtatctcatcagccttccctccattcttttctattgtcccatatttgtttatgtaaacaaatgagaaatttcacagatgtctcaaaaaacaagcgacctccacaaaataccttccgtcgcttgataaatatcagcaaactggtgaaaaggcaaagggttttttcccttcccgagctcaatggtatagccctcttttccatactgctgtataaaccaatccctaaaaccggcatggctgtcaatggttttaacgccttgatagcggtttccgcttatcgcttcaaactcccgaatcatctgagatgattgctccggttcacatccttcgtatccccagtaaatctcttctccctgcgtatgaagcgcgatcagccggtcaggcggctgatccgttatcagccgatgcatcgcctgcgcctccggttcagtgagcggcgccgttcccggaaaatcacggtatgaaggggctttcggtttgcgcctttgttcaatatcccaattggatgggaaatgtttatttaaatccacaccgtttatattcgccttccattcgcggaaatccgagcggtgctcatttaattcgttgagaaattcatttttttctgataaatcttcacatccgtaaagcacgagatcaaccccgtcgggatttacgagcggaacgaatgacaatgatgtccggctgaatatatcaagcgcagagtgcccgaaaacggttttattttcgcataatgccgcgcaatattctttacaccatttaagcgcgaccgaggtggtgatccattcattggcatgaaatgaggcgtttacatggacttttctttcggccgtatccgcacctattttcagctcataaagcggctttcccaatacggaactgccgattttacggcatgtgacaaacggaaagacatccgttattttctcaatttcttcataaaccgattgggagccgtacaccttttcttccttcacccattgatcagcggaaagaacgctttcacagtgccggatgtatcgcgaaagcccgctcagcgtctcaagcggcggaccctctgactgcccgctcacggcaaagccgggacaaaataattcatcgctttccgccattttatcagcggctttcaacagtttttcatcaattgaaagcacctttgcaatatctttcatatgctgtttcaattcaggtttgacacgaattcccgccatgttcatccccctttttttaaaactatatgacaggggagataaaaaaagaaagctgcccgcgatatgggcaggcagactttcttcagcagttttgatgtttgagccattcatttttggcaatccacgccccgccgatgactccggcgtcatttccaagtgccgcaatcgaaatatcggccgcttccgcagaacgcgggaacgcggtgattttgaaggtctcttccacttttgaccgcaggatttcacccgctttagacacgcctccgccgagcacgattttcgtcggattcatggcgcttgccagatttccgagcacgaggcctaaatgttttgcgacgtaatcaacgacttcaagcgctgtcttatcctgctgtttagccgcttcgaacacgtcacgtgccgtcagatcgcgcacttttaagagcgaagagtcggaaaccgctgcaagcttttctttcgcgatgcggacgatgccggttgcggacgcaatcgtttcgatgcagccggattttccgcaattgcacggagctcctccttccggaatactgcaaatatgaccgatttctccgccggccccgtttttaccgtgaacgatttctccgttgacgatgatgcctccgccgactccggttccgagcgtcactaaaatgacatctttggccccgtcacctgcacccttccacatttctccgagcgccgcgatattggcatcgttttcaatgacggccggaatacccgtttccgcctcgagatggtctttcagcggatagtttttccaccccatatttgtcgtctcatagaccattcccgtcgccatttccacgggtccgggcgctcccattccgatccattttacgatccgtttcggcttgttcagttcttccagcttctgatcaagcgctttggcgatcgtgaccgtaattgtgtttcctgatttatcggtcggaacttcccatttatgctgaatttcaccgtacatgttgataaaggccagcttgatggtcgttccgccaagatcaatccccgcaaaccatgtatcttccataataatctccttttcttatttaaaatcctgctgtgttatctgtctttgatccgctccgattctctctgaagaactccggcggctttttgccataattctctttcaatcacgtttgacaagtacatttcctttaattcatctttcataaagtcaatttcggcttgtctgtcaccgaaataaacgatatgtccgaatgacttaaacagctgctgcacgtcataaaatgaattcatcttcttcaccatttctattcttcttagtataagcgtatttcatcactgatccgggcgtcaagcaaaaaacgattggagaaaatatccttgtattattttcataaattgtatattcacaattgtaaaaaaacactcatttatgcgtttttctgttacaatactttcgtgcccaaaagcacaaaaggattaaagtttgatggggtgttgttttgaaacaagaaaaaaggctgacgttcatctcagccatcagtttatttgtcttgatgttagcagtcattatttcctgcctgtttttctttcatacagagccgcatatgccgctgttcttttgcgtcattattctgtctctggcaggtttatggctcggtttctcgtgggacagtcttgaaaaaggaattgtcagcggattgaaaaacggtgtgcagccgattatcgtgctggctttgatcggtgtgctgatcggcgcctggatgtacagcggcgccattcccactgtcaccgtttacgctttgtcaattatacagccgagtcagctgcttttgactgcattattttcctgcatgattatcagcacgcttgtcggctcaagtctgacaactgtcagtacaatcggcgtcgcgctgttaggggtagcaagcgcggcgggagttccgctcgaatggacggcgggagcagtcatttgcggagcttgtttcggtgataaaatgtcaccgatgtccgacacgacgaattttgccgccggaatcggcgaaattccgatttttaagcatattcgccatatgatgggcaccaccgttccggcactgctgatcacgatcgttcttttttatattctcggttcatctgtttcaataaatgccgcttcaacgcaaaatattgaggcggtcatttccggaataaaagaggccgtgcacgttacgccttggtcgcttctttcacctctgttggtgatcattttagctgtgagacgggtttccgtgattccggtgcttaccgccggtattatttccgcagggcttctgactgctgtttttattcctgacagcagcattcaaggatttatatccgccctgcaaagcgggacggcgtttaaaaccggcgaccaggctgtggccagcattatcaacagaggcgggctccaatcgatgatgggatcagtctctctgatcatgatcgcctttgcgctcggcggcctgatggaaaaaacgggcctgatcgcggcgctgcttcaaggattgataaaaggcgtgcatacgaaaggacgtcttgtcatggcgaccgtcttctcaagtataggcgtaaaccttgcgacaggtgagcagtatttgtcgatcttaattccgggtcaatcttataaacctttatatgacaagctcagtattaagcggattcaccttgcgcggtcgcttgaggacggcggaacattgatcaacccgctgattccctggggagtaagcggcgcttttatggcaagcgcattaggggtttccgtcatcgactacctgccgtttacctttttcctgtacatttctcctatgatctcaattctgctcggtttcctgaaaaaaagctgacaatacgagaaaacctgccgttttttaccggcaggttttcttatgcaaaaaatcccgctgaaaaaacgggatttgtttaaaatgcctgctgaatgaatttgtttctgataaacggtatttttaaaaagaaatgaatgaatgtccgtctgatccccggctggctgagcacgctgttcatcagacggtagcggttttggtaaacggctaaaacagatacggcgcataatgagtagatcaacaattttttcatcttatccctcctgcccctatcgtttgtcaaacagcgagaattattccggtgcaagaagttttttatgcgattaagcgatggtttcagattcagtcacgatcatatcgaccggaatatcgtggggcatgcggggaatgcggtctgtcagctggcagtcaaagagaagcgacacggtacggcctttataaccggacaggtaccgatcataatatcctccgccgtatccgattctgaagccttcccggtcaaaagccacgccgggcacaatcacaaggtcaatgtcattttgggcggctttttccgtcagactctcgatcggttcactgaggcccgcatatacggtttccagctgatcatacgcagaaaatgtacggaactccattgctcccgtctgcggaaagcattttgggatacagacttgttttttctcttgccaggcctgttcaataatcggccgtgtcggaatttccaggcgtgtcgagatggtaacggcgatcacgcgggcctgtttccattcttttaaagaaaacagcgtttcacgcatgctgcggcattttttctcccattcactttctgtcatgtcagaaagctttgcttttatatcggttctgatttgtgctttcacgtttctcaaacctccctgaaagacaaaaaagccagaactttattgaaagctccagctttttccgctgtgttaaacagcttattttgtttcacggtgtaacgtagattttttatcacgtgggcaatattttttaaattcaacgcggtccggattgttgcgtttgttctttttagaaatatagttacgctcaccacattcagtgcaagccaaagtaatattaacgcgcattattttccctccaaactaaatatcatttacttattcagacttatatataataccactataatggacggaatgctagagctgatttacatgaaatgttgtttaagtgcagaaaacatcagtttacgcttctgatcctctgaatgagcttgcgtcagaagaaggcaaaatatgacgaaacaggacaaaaaagggctttccgatacgaaatctatagagaaataaccgtttgctccccgagtaaaaaagattttccgacaaaattccgtttttttctctatttcctttagaatggcggcgttttatggtataaaaaagaagggcaaattaataatagaaggtgatgaaacgtggaaattgctattattgcgttgtttatcgtcagtatagcgcttattgcattctcatattctcaaagagatccgatgaaagacgtggaacaggagctagaaacgcttcagctttccgccatgcaggaaatttacaagttgaaaaagaaaatgacggtgcttgaagaagaattgctggaaaccaacctcgtgatccgcaaagccaaaagcagcggcattaaccaaaaaatcgccaaacaaatcatttcaaaatataacaacggaatgtctgcggaagccatcgcaaaagcggagcacgtgtctgtcgaggacgtcaataccattattaaagataatgagaaggtgctcgtatgacaaaacggggcattcaggcttttgcagcaggcatgattttagcgacggccgttctcgccgctgtcttctatttgactgaccatgaccaggcagccgccgttaaaaccgaaaaaacagcattgacagaaaaagaagtaaacagctacctcgacgatcagcacaaagtctccgtcaaccgggatgactatcaaaaactgcttgattctaaagaaaaatcattaaacaacgaccaaaacatagacgctaaaaagaaaaaagtaacatacaaactgacgattaaagacggaatgagcactgctgatgtgtcatccattcttgaaaaagaagggattattccttcagcgaaagacttcaatgattacgtcattgacgcaggctaccacaaagaaatccgtgccggccatttcaaagtcgactcagatatgagctttaaaaaaatcgtcaaaacattaacccgctaaaaaagcttgcaggcatcgtccattcagatggatacggccggcaggcttttttaataggcatataaaaaggacccggtcaatggccgggcccgtttttttatccgaattttccggtgatataatcatgtgttttttgatgatccggctgacaaaatatttttcctgtatcgccccactccaccagttcgcccatatagaaaaacgcggtttgatcagagaccctcgcagcctgctgcatgttatgagtcacaatgacgattgtatacttttctttcaatatcaaaatcagctcttctattttccgcgtggacacgggatcaagagcggacgtcggttcatccatcagaaggacgtccggtttggtggcgagcgcccttgcgatgcacaggcgctgctgctgaccgcctgacagtgaaagcgcctgctggtgaaggcgatccttcacttcatcccagagcgcagctgcttttaaagattcctcagcgatttcaagcagtttctttttatttttttcgccgtgaattctcggaccgtacacgacattctcaaatattgactggggaaacggattgcctttttgaaacaccataccgatctgttttcttaattctgccgcatccgtcttttccttcagcagattgcgcccgttatagatcatgtcgcctgtcactttgacattcggagccatttgcagcattaaatttaatgttttaataaaagtggatttcccgcagccggacggaccgatgatcgcagttaccttccgctcctcaaaaccgatcgtaatgtcttttaaagcctgatgggctccgtaccatacgttcatgccgtgaatatcaaataaattctgtgtgtgcaccgcttccttcacaagtctcacagtccttccccctatccgaactttccgttaatgtagtcatctgtcttttgcgctttaggactcgtaaaaatttgttctgtctgcccgtattccaccacttccccgtttaaaaagaaagccgttcggtcagacaccctcagcgcctgctgcatgttatgcgtaacgataataatcgaataatcttttttcagttctgtcaaaagcgtctcgattctggcgtttgaaatagggtccagagcggatgccggttcatctaaaagaagcacggcaggtttcatcgcaagcgtacgggcgatgcaaaggcgctgctgctggccgcctgataacgacagagccgatgaatgaagccggtctttgacttcatcccaaagcgccgccttcgttaagctttcctcgaccgcatcatccaaaacggctttcctgcgttcccctgcatacttcagcgcatgtgtgatgttattgtaaatggatttcgggaacggattcggtttttgaaacaccataccgatctcccgtctgagagacacgacattaatcgcttcacccaaaatattcagcccttcataaaggatctctccctcgcttcttgccgaagcaatggcatcgttcattctgttaatctgtctcaaaaatgttgatttcccgcagcctgacggaccgatcagagccgtcaccgcatgtttttcaatattcatgtttacatcttttaccgcttgtttgtcaccgtaataaattgataaatgcttcacttccaaaatcgaagactccggcgaacgctttgtctgttccgcttgttccctgatgatgtgatcaatcatgttttcgcctctttccgattaatttgccgtaagctttttataaatgacagacccgagccatctcgcacaaaggttaaacaagagaaccgaaatcaccagcaccgccgagccgccgtttgcaatcgcttcggcgtcagggatgattccctgcgtattgacactccatatatgaaccgccagcgtctcagccggcctgaaaatgttgaaaggagatgattcagaaaacgggttcaaatccgtaaagttcagccgcggcgttgtcagccccgctgtaaataacaatgcggccgcttctccgaatactcttcctgatgcgagaatggctccggttaaaatcgaaggaatcgcactcggaatcagcaccgttttgacggtatgccatctcgatacgcctaaagcgagagaagcttctttcagctccttagggactgcagtgagcgcgccttctgtcacccggaccataacgggaaggttaaagaccgttaatgcgagcgcgcccccgataatcgtgtagccccatccggtcaagtttacaaacatcagcatgccgaacatcccgatgacaatggacggaagcgaagacagcacctcaatacacgttctgataaaatcggtgattttatttcggggcgcatattcagccataaagacgccgccccccacaccaagcggtatcgtgatcagcatggtgataaacagaatgtaaaaggagttaaaaagctgatcccgtattccgccgcctgaggcaatggcgctcgattttgacgtaagaaaatgcaaggagatttcagagacgccgtgaataagaatgtacaaaaacaatcctgccaaaatcgccgcgattacagcggcgcataacccgaatacaccggtggccaatttatccgttattttccggttcattacactttcctcctagatgacaagtagcgtatgagcaatataaacagaaacgacatgatgagaagaacaagccccatagaccataacgtattattttcaatactgccgtatgtggtatggcccatgtttaacgtgataatcgtcgttaatgttcccgccgtatcaagcaggctttccggcagaagctttgtatttccgataaccatctgtacggcgagtgcttctccgaacgctcttgccatcccgagcacgacagcggtcagcaatgtcggaaacgccgccgggataagcacctttctgattgtctgccacctcgtcgcaccaagcgcatatgaaccgtcgcgaaggtgtttcggaagtgacgcaagcgcatcagcggaaatcgatgtaacagtcggcagaatcattaccgagagtacgatcgttcccgccagaaggctgtgacccgttccgcttgatttaaaagagccgataaacggaaccaatactgtaagacctatgaatccataaacgacggacggaatgccgacaagcagctcaattaccggctgcagcactttttttccccaagtcggcgcaatttccgtcataaacacggcacccgcaataccgaggggcgctgcgatcagagcggacagaaccgtgaccgcaaatgatccgaaaataaaaggcagcgcgccgaactcaggttttgcctgggttggattccaattcagacttgttaagaactcaatcgggcttacaccatttacaaaaaaagattgcagcccctttatgccgagaaaaattgtgatcgccgctgatgccgcaatgataatcgcggcacacacagacacaatcacccttccgcggacttcatccaattgcctgttttgttttgagcttattaagcgttcgcttacagactctttttctctgtgatttatcatttgtttacactcctataaagaagaagaggcggggagcccgccctcccctcagctttgcttgccgtttgcgtcacgtgtgactttcatatcagagatcggaatgtagccctgatcttttacgatacttttctgtacttcatcgctgttcatatagtcaagaaacgtttttgtaaggcctgacgcttcacctttcgtataagagtgctcgtaagcccaaatcggatactcgcctgtgacgacatttttctcttccggtttgatgcctccgatcgataaaggcgttactttgtcatcgtttatataagagaatgccagataaccgattgctcccggcgtttccgcaatgatttttttgactgtattggaggaatcctctgtaatgccctctgcaggctctgctccgtcaagagcatatttgacgaacgtagcgcgtgttccagatgaatcaggacggttcacgagtgtaattttttgatctttaccgccaagttctttccagtttttaattttgcctgtaaagacatctgtcagctgttttttggttatatcctttacgcccgcaccggggttgaccgcagccgccatcgccactaccgctactcggtggtcttttagggctttcgcatcaatgccttctttttcttcagcgaagacatctgagttgccgatttgcactgccccttcagacacttgcgaaagtcctgttcctgaacctcccgcttgcacctgcacatcagcatccggatgtttttccataaacttttccgccgctgccagtactaacggctgcatggctgatgaaccagaaatggttaaagaacctgatgcttttttatcctcacttgcagattgactgtctgtcttgccgctttcctttgcatttccgcatgctgcagcaacaatcataacagcagccatcagaagcataagcatccatttgttttttttcatttcctgaattccccctgcatttaatgtgtaatttgtcctacacgtatagagtaaagggttcttgtaaaatgcgtataaatcaagtgttaaggttttgtaaatccggatgtttttttgtataaaaaaaacgctcacaggttgtgagcgtttttctgttagttgcttgtattgccgttttcagcgtcttcctgaattttatcttcgtttttctgcttcgtattattatcttcttgtttctttttcagctcaaagtatttgtccagagctgctcttcctatatcattcgtaatcgaatatcgatcgctgtaattaatataggcccaaggaacgactacagaaatagccacttccggattatcagcaggtgcatacgcgacaagagtcgtattatacgttccttcacccgtctctgatttgtcaggaccgtcatagaaagattgcgccgtacccgttttaccggcaggactgtatgtcgccgtcgcaaaatcagttgcggctgtcccttttgtcatgacacgtctgaaacctgcctgcacttctttaatgtctgcatgattcatatcaatcttattcagtacttgaggctgaacagactctacaacggctccgattccttttttcgaatcaggctgtctgacctcttttacaagctgaggtttcaaacgatagcctccattggcgatcgttgatacatactgcgccatttgcagcggtgtaaacgtatcatactgtccgatggcaaagtctaacagaagaccggaaattcgctgtgtcccttggtacccggttgcttcattcggaagatcaatccccgtcttaactccgagtccgaactgattgaagtagtatctgaaagtatcgaatgccttcatatcaagcggcagggactggccttttttgtactcccctttaccgacagcaatcgccgttttgaacatgaacacgtttgatgattcctgaagcgctttttggatatctacgggacctaaattcgtccatgattttttcgggtttttacttcccttgaaatacataggttcatcctggaaaacggtgttcaaattaatcgcgcccgtctgcagtccggtcaacaccgtcgctcctttgaccgccgatcccattgcgtaggaggaagtcattgcgccgagggcataatcattaattttgtactttccatggtcattcgtaatctgcttgccggccatcgtcagcacttctccgtttttcgggttcatcatgacgacgaaggcccgatcaagaagcttcgtgctcggtctcgcttttgccgatcttaaatttttctcaatgattttttcaacggatttctgcaggtccatatcaatggataaaacaaggtctttgccggcctgtccttttgaaatcactttgctgcccgtgacatttccggatgagtcggttaagttctgcactttctctttttgaccctgcagcaggctttcatattgatattctaaatagctttttccgaccctgtcattccggctgtagccgagtgacagatagtgatccagcagattggaaggaagaccttcgttcgcactggatacactgccgagcaatgtccggatcaggcttttataaggataagaccgttcccagtcagacgtcacgtcaactcccggcagttcatctaaatgttcactgacgacggccatttcttttgccgacaccccttcatttttgatgtattgaggcgtcagtgaatagcctgaatccatctgccttttgatcgcaaggatctgcatatcttttgaagtgagctcgttcagctgtttgtctgtgatacgtttcagctgaagctgatataaatcatcttcagacagttttttgtcttcagctttttgcttttcttcggccgtaatcagttttttcgcttcatcaggcctcgttaacatccaatagtcttttttatcccgctcagtcacctttttggtgcttaccttaatcatacccgacagtttttttgcgatttttaaacgctgcgcctgggtggttgaggctgaacgtgtatatgtaatcgcatttaatgctttattcgttacgataggatttaggttccggtcgtatatcttccctctcggaaccgccgtgctgacatcagactcctcctgcttattagcggcgtttttataatcatcaccctgaacaatctgcttgatgccaagctcgacgataatccaagtgaaaataagaaacgcggccaaaaacaaaaaattaagccggatcggcagtgattttttcttttctttgtttacagctattttctttttatttctcctcatgacatcaccttttcttatttacagaaagaaatgacaccttctgttcaggtgccatttttcattctaaaggttttttcgatatttttctacagataacccttttatctttctccttttataaaattcggttccgccgcctgtttttgtcggtcttcttctactgtttcatcagaagtttccgtatccagtttaatgtcttttataaagtaataaatcagcggatggccggctccgagcagcacgagcgccgccggtattcccactttttccttgaataatgtaacgattacaaggaaacaaaggatggaaacgatccggcccgcatttaaaaataactccctgagcacaatgtattcaattctggcttttctggcaagacgcgcccggcctatcacatcatatgtaagcgagacatacggcacgagcagaactggatagccgatcgcaataaacactccgtacaaaaggagcgtcgtgaagctcattttaaaaatgatgagaaacagggcgccatacaagatcaatccgccgataagaatcgcctttttccgagctctttttttgatgagccttgatgcaaaataataggcaaaaaaagaaaccgcggaattgacgagaccgaatgttccgagcgccagctcactgtttgtcgcaatgaatacaaatacgctgattaaaaaaacaaaaatcccttctctcaagccttgaaaaaagtgcgcgttggtaatccggcgccaattcagattcgtgtggcgctcatcaaaaacttttttcagcataaaccggcctttcgactccctccgcttcagaaaaaagctcataaccacggcaagggcaaataagccgagcgacaggctgaaaatgattgtataacccgtattgttttcaagtcttgaaatgacatatccggccacaatcggaccgatcatgcccgccgatgaagacaaaatgcctaaaaacccgttaaaaaaatctctcgtttccggttccgtaatttcgaacgtcagcacattaaaagccagccagtaaaagccgtatccaactccgagcacggcccctatcaaaacgagacgggaagcagcagtttctccggcaagcagcacacttaaataaaaagccgccaaaaagataacgccgaacctgagaataaacaccctgtcgatttttttagccagccggccagccagcagaaaggtaaccggctgcatcgttacgaccgacaaattgtatatggccaaatcaataaattttcccgactgcttccacaaatacacgttgacaaatgtatttgacagcgcgatgcccaatgagtaaaggccgccaatcgtcaataacagcagcagccctttatttatttcgatgtcgccgataattttttttattttgctcatcattgactcccctttactacacattagtttgtctcactcaaactgagatatgtaaaaggattcaaagtcaataaaaaaacaaggcctcccgcgggagaccttgtttgatcgaactatttattttgcttcgctgtaaagacgggcaacttcatcccagttcacaacattccagaaagctgaaatgtaatcaggacggcggttttggtagttcaggtagtacgcatgctcccaaacatcaagaccgaggacaggtgttttaccctctgaaagcggtgaatcttggtttggcgtgcttgtaatttcaagtttgccgttgtttacaacaagccaagcccagcctgaaccgaaacggccggcagctgcggcggcgaatttttctttaaattgatcgaagcttccgaacgtgcttttgatctcttcagcaagctcaccagtcggttcgcctccgccgttcggagataaaagagtccagaataaagagtggttggcatgtccgccgccattgttgcggacagctgtgcggatgtcctccggcactgcgttcaaatcagcaacaagctcatctacagatttctctgcaagcgctgatccttcgatcgctttgttgaggtttgtcacgtatgtgttatggtgcttcgtatgatgaatcgtcatcgtttccttatcgatatgaggttctaaagcatcataagcgtaaggcaattctggaagtttgtaagccataatttttttcctcctttaaatatatgtactgaaatgccgcttaacgcgaacttttctaatctcaatgtaacaaaagaaagcatggtaatcaatgaaaaagctcacaatccggcgattccagcagacatattacactttatccgttcactgccgaaattaaacctttctaaagcaccgtccataagaaatatccgatcataaagagctgaatgacgccttttgccgccacgcttgttaaaaagccgattaacgagccgagccccacttttgccgcggacttgatatccttttgatgaacaaacacctcagcgcagacagcaccgataaacgggcctattataatgcctgccacgggaataacgaagggcccgatcaacaatccgatcgtgcttccccagattgccgccctgcttcctccgtaccttttaacgccaagtaaatttgacacataatcagctgcaaataaaacggccgcaaataccgcctcaatgagccaaaacaggtaagaataaggactgaaggaaaacaaaaatccgtagagaagaaaaccggccacaataaaaataacgcttggaatcaccggatatacaagcccgataaaagcaatgacgaagaccgcaatgataatcagccaatacaaaacactcatgacaaaaacaccctcctttgttttgcgggcgatcaccgcttcccgctttatcttattatgtatgattccttatcaccgctttaaatactctcacttgtgttcatcccctgtgaacgatacaataagcaacatataccagtttaggctaggaagtgaagatgttgaacatatttacggctttattgaaaagtacatactctccggcagatattgcaaaaacacggtttcaggggataggaaaagcgatcctttatgtatttttgctgtctgtcctttttacgctgccaagcgcttattacctttgctccggcaccgtaaactcaatgaacggtttcaaaaccgtgttaaagaaagatttccctgatttcagcatttcaaacggagaattgcagacgaaagcatccgcctctaaggaaacggaagcgaacgggttcgtcatcgtgtttgatcccacagatgcttacggcgctaaacaaatagcggcgaaacaaaatgcgatcggcattttgaaaaataaaatggtgcttgctgtagacggacaggcgacagaaatgaattattcgctgatgcctgccgatatcacaaaaaaagaaatcatatcagcattaaaccaaaataaaacaatgatcgtcaccgtcctgtccgttttgctgttcatcatgacagcggccggcaaattcattgaagtatcatttctcgccgtcatcggcctgatattgaaaaatgcgcaaagaaagacattgaattaccagcagctctggaagctttcggcttattccattacactttcgaccatattctttacgatcatgcgcgcgcttgttattacggtgccgagtgaatttttagtgaattggtttgtaaactttatcatccttttcctcgtcttaaaagagataccgcgaagtaaaacagctgtgtaacaaagactgcccccggcggtcttcttttttgtcatgaacaaaacgggacaagcatacaatgaagtaaaaatgtatgcgggaggcggttggaatgaagcggcttacttttgtattcggcagtttatttgtgatattcattatcttttacgatcttaaaatcggcacgatcccttctcaagaccttccagcatacgcagcggcggcacagccagcccaacaggaagcttcatacagaacggttacggtcaaaaaaggcgatacggtgatgtcgatagtcggcgcacataaagcgccagatgatattgcacaagattttgaggcgctgaatccgaatgtaaaagcaaacgccattcaggcaggcaccgcttataaattccccgtctaccgcaattaaacgttaatttcttgtcagttcggcaaatacactgttacaatataacatgtaaatagaagttgcctgacatgtaaaaggctcagcctgcaaaagcggtaactacaattaaggagcgattgacaagtgagtgaaatcacacatcgtacaaaaacgcgtcccgtcaaagtgggacctttaacaataggcggaaataacgaagtcgtcattcagagtatgacgacgaccaaaacacacgacgtagaagcaacagttgcggaaatcaaccgtttagccgaagccggctgccaaattgtccgggtggcatgtccggacgaacgcgctgctaacgcgattgccgacatcaaaaaacaaatttccatccctctcgttgtcgatattcattttgactacaagcttgcattaaaagcaattgagggcggggccgacaaaatcagaatcaacccgggtaacatcggccggcgcgaaaaagtggaagccgtcgtaaaagcggcgaaagaaaaaggaattccgatccggatcggcgtaaacgcgggatctttggaaaagcgtattttagaaaaatacggctatccgactgctgacggaatggttgagagtgcgcttcatcatatcaaaatcctggaagaccttgactttcatgacatcatcgtcagcatgaaagcctctgacatcaatctcgccatagaagcatacgaaaaagcgtcaaaagcatttgattatccgcttcacctcggaattacagaatcgggcacgctgtttgccggaacggtaaaaagcgcggccggactcggagcgattttaagcaaaggaatcggaaacacgctccggatctctctgagcgccgacccggttgaagaagtgaaagtagccagagaactgctgaaatcattcggtctcgcttcaaacgcggctacgcttatttcatgcccgacatgcggacggatcgaaattgatctcatcagcatcgcaaatgaagtggaagaatacatttctaaagtcaaagcgccgattaaagtagccgttctcggatgtgccgttaacggaccgggagaagcaagagaagccgatatcgggattgccggcgcgcgcggcgaaggacttcttttccgcaaaggccaaatcgtccgcaaagtccctgaagaaacaatggtcgaagagctcaaaaaagaaatcgacaagctggcagaagaacactatgcaaagcttgaagcggaaaaagcaaaagcagaacaagaaacacaaaaagcttgacggatattccgccaagcttttttttgcgttgtgttaaaaaaacggtgtaatgaagatgccaagcacaagggaaacaataccgattcccatcgcccatccgcctaaagcgcctgctcctcttcttctggcgatatagccgacgataatgccgcatgcccctaataaaacagggagcacaaacagggaaatgatagaaatagccaatgctgcataccctatcccccggccttcacttactccgtcccgattatcatcacggtctgctgcccggtcagaagcacgatatggctctgagatttcggccgctgtttcttctgaataaacatcacgcgtgatatcggttccttccgatccatgatctacatagtaatcgttgccttttcgattttcgtaatcgtatgccaccttcaattccccctttttcttttatgaaaggagcttttttagtttccgcgttttttacgaattcatgtttgctaaacttttctggtattgttaattgtttatgttacacttgaagggatgaatttataggagtgtggacatgttacggttaggtatagatattgacggcacagttacggcacaggatacatttgtcccttatttaaaccgctcatttcatctttccattaccttggatgatatgactgattatgatctgacgaagcttttgaacattacagacgaggaattttgggaatggatgaacgttcatgaagcagccatatataaagaagcgaagctcgcggaatttgccaagcaggcactggacggactgaaagaagagcaccgtcttatctacattacggcaagacgcggccacttagcagatgttacgctggactggtttgcaaatcgggacattcattacgatcacattgagcttgtcggaggccatcacaaagtggaagccgtcaaaaaacacggcattgatttatttttcgaagatcaccacggcaacgcgacaatgatcgcaaaagaagcaggcattccggttatcctttttaactccccatataatcagctccccatcgattccaatattatcagggtgcagaattggcttgaagccgtcgcctggattcataaaaacaaacacagctttcagcatgttaaaagctgaaaaaaacctcctgtataagcaggaggttttttatcggcacgcaggacaggtgccgtaaatttcaaacttatggccgctgatttcatacccttccaaatcatcgtgcagcttatccatcggacaggactcaatttccttcgttttcccgcaggttaaacagataaaatggtgatgatgatgggtataagagcatgtaaaacggaacagtttttctccggaaagctccgtcgtttccaaaatgccgagttcttcatataacgaaagatttctgtatatggtatcaaagctcagacccggatagtcgtcatttaatgcggcaagcacgtttttggcggtcagatatttatcagaatcagcaaaaagctgcagcatgtcttctcgcttactcgtatatttataccctttttctttcagcaggttcaacgcttcttgtacgttcatgaggacctcccctttacaacacggtatcgctccaaaaagaaaatggcagctgtctgaacagcaggccattttcttatgatgtatcaaattatacctataaaatgatgaaaagtaaatgaaagcctagtgaatcgcggttttgaacttaccgcccctcgtttcatgggtattcatgatcgtaataaaggcgtttttatcaatttcaaacacaatggatttcaatttagtcacttcaagccttgtcacgaccgcgtaaatgacttctttggattcatccgtatatccgccttttccctgaagcttggtggttccccttccaagccgatgcaagattgcatctgaaatttccgcatactgatctgccacaataatgaccgcttttgtttcatcaagcccctggatgacggcgtcaatcgttttcatggcaatataataagtcatgaaagaatacatcgcctgctccggaccgaacacaaaaccggcccaaataaaaataaacacattgatgagcataacgaattctccgactgagaagggcagcttttttgtgagaaggataccgagtatttcagtaccgtccatcgagcctccgtttcggatgacaaggcctaccccgaaaccgagcaaaagcccgccgaataccgtcgccaaaataggctgggtcgtaatggcctccacatggtgcaaggaggattcaatcagcgctaaaccgacgattccgataacagtagagatgagaaatgtttttccgatatatttatatccgaaaatcataaatggaatgttgagtaacacaacgaataaggcgaaattgaggaggggattggacataaagaggtggtctaaaattaatgaaacaccgataatgcctccgtcgataaaattattagggaccagaaacaattcaatacttacagcggctgaacccgccccgatcagaatcatgatgaccctgaagataaagtgtaaaaatgattctcttttatgctgtttatttggggtcataaaatctcctttcctgtaataactattttaaacagtaagcaacttcattttaccattaaaagccgtaacattttaatgatttgctcaatacattatgtctaaagaggtgaaagtatcgatgattttaatacaaagaattattttgcagcggctcaatcaagtcactgcggacgatcttctgaaatattccaagcaatacggaatcagcattacgagaagtcaagcggctgaggtagcggctctgatgcacggaaaaaacgtcaatatttttgatgaacaggagcggcttcgcctgctgaaaaaagtggaaacgataacctcaaaagaaacggctcggaaagttgacgaacttttcaatcaattctcagggtaaaaaaggaggggcaattccccctccttttttattgagctgatatttttttaagaagctcctgatcaaactgcttttctttcagcatttcgatttcaaaacggtacggcggcttcttatttttcttgtcttcgcctacatacggtgtttcgaggattttcggaatatcggcaagctgctcgtgatgaacgatgtactgcagagcgtcaaaaccgatctctccgaacccgatattttcatggcggtctttccgggcgcctttaatattcttactgtcattcacatgaaggacttttatccgatcgataccgacgattttatcaaactcgttaagaacgccgtcaaaatcattggcgacatcatatcctgcatcatgggtgtgacaagtgtcaaagcagacggatagatgttcattatgcgtaacccccgaaatgatctcggccagctcttcaaagcttcttccgcattctgatcctttgcccgccattgtctccagcgcaatctgcacgtgttgaccgggaacaatcacttcgtttaaaccttcaatgatttttttgatgcccgtctcagccccggctccgacatgcgcccctggatgaagcacgatctgtttcgcgccgatcgctgccgttctttcaatttcagaacgcagaaaatcaacgcccagctcaaacgttgccggatttgtcgtatttccgatgttaatgatgtacggcgcatgcacgacaatctcgtcgatgccgttttccttcatatgggcgcggcccgcttcaatattcaagtcttcaatttttttgcggcgcgtattttggggagcgcccgtatagatcataaatgtgttcgccccgtatgaaacggcttccttgcttgcggcaaggagcatatgttttccgctcattgagacgtgtgagcctaatttcagcaacccgattccccctactttcctctgttagattggtttcttctctgcttctttctgattttttccatttcgtagctcattttctttttatagcccggctttacttttttcggctttttcacaaggcgtttcgccatttggtcagcctcatttgccgtctttttgcgatttttgcggcggtggcggtcatcgcctttcttccattcgccgtttacaagctccgcatattcaaacacaatacccatcttttcgagtcttacgagcgcatcttcgtcagaaagctcataaatggtcagtgcttggcctgatgaaccggcgcgtgcggttctcccgacgcggtgaacataaaaatccagatcgtccggaagctcatagttgatgacgtggcttacgcctttaatgtcaattcctcttgccgcaaggtctgtcgcaatgacataagtgaattccagatcattaatctgcttcattaccttcttacgctcacgcggcgttaatcccccgtgcagaagaccgatcctcatgcccttttcagtcaggtatttcgcaatatggtcagccgtgtttttcgtattggcaaacacaatgcccagataagggttcagatgagacatcatatcaaaaagcagtttgtctttatcacgctgtttagaaggaaccaaaacatgttcaatcttttcggctgtgattcttttcggctcaacatgcgcgtacttcggattttccatatactttttcaaaaacggcttcagcttttccggaatcgtagctgagaacacaagcatctgaagttcttccggcatccgcgatccgatataatcaacgtcttctaaaaagcccatgtcaagcatcagatcagcttcgtcaatgacgagagactgcgctttatagacgttcaatgcctgcgccttaatcagatccgcgatccggcccggcgttccgacgacgagatgaggctgtgttttcagcttatcaattgatttttgcttgtccgtcccgccgatgaagcattttgtccggatcggctcatcttccgcaccctgtgtgattttgagcgcttcctgatgaatctgattggcaagctctctcgtcggcgccgtgataacagcctgcaccgtatcagaacccggatcaatccgattcaaaattggcaataaataggcgtgggttttccccgtccccgtctgggactgcccgatcacgctttcgtttttcagtacggcaggtatcagccgcttttgaatatctgtcggttcataaaaaccaaggcggtgaactgcatctataataaacggttttaagttatatccatcaaatttagtttctttcatttttcccagctccttaaagcggcacattctgtgtccatcatcacattataaccgattttatttaaaaacaccatgtcttgggggaatcctgttttcgagacagaaaagcaaatgccccctccgatgcatattgtaatagcagagagacagaaaggaggtacaagtatgtttccacagcagccgatgagaaatatggcgcagcagggccggccgttgatgaatccgcgtatgaggatgggaggaagaccgtcattgccgggccggcagctgatgcagcagggccggcagcttttccctcagcagcagattgccggagcgggcctgagaaacgcaggcacgggcggcggagggggcttaaaagggatgctttcccgttttttacccggttcaggaggaggaagcgctgccgcgtctgcaccggcggcggccagcggaggagcaggtgcaggactgcagggaatacagaacctggcaagtccggcatccctgtcgagcatgctcggcaacgttcagaaggtgctcggcgtggcgcagcaggttacgccgatgatccagcagtacggtcctttagtacggagtctgcccgccatgatgaagctttacagccaattaagcagcagcgatgatgagaatgaatctgacgagacaaaagaaacagacgaacaggacaaaaaggatgaagctgaaaaaacagatgaaacagaagctgaaaacaaatcagacgcctcatccaaaacaccaaagaaaacgtcaaaaaaagcatccgcttcaaaagaaaaagacgccgcacaggcagaatcagcggaacagccgcgtccaaaaagaacatcgggcagatcaaagccgaaattatatatttaacattctttgatatctcacgaaagattagctataatgagatcagaagaatgcaagatttgagccgtttaactacggctttttatattgcctctacactcacttttgataggaggacatctacattggacgttatcaaaatatcgccgcgcggctactgttacggcgttgttgatgccatggtcatagccaaaaacgcgtcactcgataaaacactgccaagacctatatatatactcggaatgattgttcataataagcatgtcacagatgcgtttgaggaagacggcatttacacgcttgacggtacaaaccgtctggagattttaaagcaggtggaaaaaggaaccgttattttcacggctcacggggtatctccggaagtaagaaaagctgctgaggaaaaagggcttgttacgattgacgccacatgcccggacgtcacgaaaacacatgacttaatccgaaaagtaaaagctgaaggctatcatgtcatatacatcggcaaaaaaggccaccccgagcctgaaggagccgtcggcgtcgctcctgaaatcgttcatctcgttgaaacagaagaagacgtgagaaatctcgatattcaggctgagaaattaatcgttacaaaccaaacgacaatgtcccagtgggacgtccacgatattatggaatcagtcaaagaaaagtacccgcacgtggaataccatcaggaaatctgcctggccacacaggttcgtcaagaggctgtatcggagcaggcaaaaaaagcggacttaaccattgttgtcggcgatccgaaaagcaataactccaacaggctggctcaagtgtcagaagaaatcgccggaacaaaagcctaccgaatcggagacatcagtgaactgaagcttgaatggctgaaagacgtcaataccgtcgccgttaccgcgggcgcatcaacaccgacaccgattacaaaggaagtcatccgctttttagagcagtttgaccacaacgatgaatcgacatggcagcttgaacacagtgtgccgctcaaaaaaatccttccgaaagtaaaaataaaaaactgaggcccggggcctcagtttttttataagaaggtaaatgggtttgtatctgtttcggaagcgaaaatgcgcacgtcatagtttttctctacggccattgccgtaagcttctcagccgtgccttttctcatgatcttttcagcataatgccccgggtctacgacgtttaatcccatcatcatcgcatcctgcgctacgtgaaaataaaggtcgcccgtcacgtaaacatctgcacctttccgctttgcctgataaatatatttatttccgtcgccgccaagaaccgcgacttttttcaccttgctgtttcgctctccgaccatccggactccgttaacgtcaaacttttctttcacaaacagagcaaactcttcaagcgtcatgtcctgctgaagttttccgatccggccgagtcctttttcaagcggagactgctccaccggataaatatcatacgctacctcttcatacggatggctttttttcagcgcttttacgacggttttctccatacttgccggaaaaacggtctcaagtctcacttcatggacgagttccagctctcccgtctgtccgataaacgggtctgccccctccagcggcttaaagctcccgattccctcagaagagaacgcgcaatggctgtaattgccgatatgtcccgctccggcgttgccgagtgcggttcttacagcttcttcatagtctttcggaacatatacggcaagttttttcatcgggtccgaatatgtcgggacgagcacttctgtgtctgtcaggccgagagcttcggcaagcagatcgttaacaccgccgtccgctacatcaagattcgtatgagccgcatatacggcaatatcatgctttatacatttctcaatcagtcttccgcccggctgatcagtggtgatctgtttaagcggccgaaaaatcggcggatggtgggcgataattaagtcaacttttttctcaatggcttcatctaccgtttgttccagaacatccagtgtcaccatgacatttttcaccggcttattcaatgtaccgatctgcagtccgattttatctccttccaccgcataagccttcggtgaaaattgttcaaacagctggatgatttcctgtccgttcacatgtttaggcatgtccgattacctccttcagcagagaaatccgctctttcaattcagctaatttttcatgattttcatgctttgcgctgcggctgatctgttcataaatttgttcagtatgcttaagttcctggctccatttccgaagaaacacttcgttcctctcttttaataaaaacggacccgcaagcattccggcagccatcggcacgtcccggtacggcgcatcacggtcgccagtttccgcaacgaggatttcataacactttccgtcttcttcgagaatcacttcatcaagcagttcataaccttcctgatacagccactctcttatatgaacggcatgaatattcggctgcagaatcagccgttcacgccccgtcaatttcgtttttcccgactccaaaatatgagcgatcagcgctccgcccatgccagcgatcgtaatggcgccggcttctcctttttcaaggacgctcagcccgtcacctttccttacggagataagagtgcttaagtccagtttttccacctgctgtttggcggatagaaacggtccgtctgtaatttcaccggcgattgcgcggcttgccaaatgattcaaaacggcatagcaaggaagatacgcgtggtctgacccgatatcagcaaccagggcacccggagggatatattccgccacagactgcaatcttttagataacttcatttcattcacaatatcacaacttttctcatgttctttttcctttactatcatataaaaaaaccgcccggaatccaagcggcggatagagtttttcatatgtcttttatatagggaccggtaaagctttatttaatgtcagaaacccattttgccatgtcatccagcttttcggccggcacaaggcccgcaggcatcccgttgccgcctttttcaatttttgttttaatctcagcgacatcttttcttttgccgacgccttttaagttcggtcctgacacaccttcatagttttccccgtgacaggtgatgcagttcgctttataaatctcttcaggtgaagcgtttgcagtttccttctcggcatttttgctttcaccgccgcttgcgatctgatgcgcatctccattgccttttacagctaaaaagaaagtcagccctattcccagcactgcaatgagcaaaaaaggaatcagcggattccacttcatatctccatccccctttttcattctccccctatgtaaacacttctaattctaacttatttttacaaaaagtaaatggtcttgctcagcaatttcattgatttcacaatttatacaaaaagcaaaaataactgttttgtttatcacaaaattatctttattctattgtataatgaattgtatacgcttacaataaagaatataaataaacttatctcattttccctctttcaggacatgccgcattttttccgaacccatttgcaaaacatatgcttatccagtaaaataaaggtatattatccatatatcttatacataaaaaagaacggatcaaaaagacccgttccattctattcgagaaaatccttcagacgtttgcttctgctcggatgtctcaatttacgaagcgcttttgcttcaatttggcgaatacgctctctcgttactccaaacactttgccgacttcttctaaagttcttgtgcgtccgtcatccagaccgaaacggagacgcagcacgttttcttcacgatctgtcaacgtatccagcacatcttccagctgttcttttaaaagctcatatgccgcatgatccgacggagatgtcgcttcctggtcttcgataaaatcaccgagatgtgagtcgtcttcttcaccgatcggcgtttctaaagaaaccggctcttgagcaatttttaatatttcacggactttttcaggcgtaagatccatgtcttcagcaatctcttccggtgtcggctctctgccaagatcctgaagaagctgacgctgcacccggattaatttgttaatggtttccaccatgtgaaccgggatacggattgttctcgcctggtcagcgatggcgcgtgtaatcgcctgtctgatccaccaagtcgcatacgtactgaatttatatcctttacggtagtcaaacttctcgacggctttcatgagacccatgtttccttcttggatcaagtctaagaaaagcatgccgcggccgacataccgtttagcaatgctgacaactaaacgaaggtttgcttcagccagtctgcgtttagattcctcgtcaccctcttcaattttttgagcgtaggtgatttcttctttagcagaaagaagatttacccgtccgatttccttaaggtacatgcggactggatcattgatctttacgccaggcggtacgctgaggtcattaaggtcaaattcttcttcggctttggcaagctgttgaatattaggatcttccgtttcttcattttcactaattaattcaacaccttgttctcctaaaaattcataatactcatccatttggtctgattcaatttcaaagctggacatgcgttcagcaatttcttcatatgttaaaacgccacgtttttttccagtttcagtaagctgttcttttacctggtctaatgtaagttctgtttctgtttcgtgggtttgtttatcagccattatggatccctccttccaaagcttgcaacgaattctaaaagcggtatgtttcttatccgccccggaagccttctctctttttcagcatgcagggctgcggataataatgacaattcatgatgaggttaagcgatctatttgctcctccgcaaggaatcattgccaatcagaacgcaagcctctttttggtgttactttaatgatcggttcaatgcaacaatttcttgagccagagacgcagctttcacgaagtctttctgcctctccgcatccgctctttctgcttctttttcctttatcattgaccattttcggtgatccaacactttttttacgtaatcggataactcggcctctgagagctcctcgtttacttggagcatccctatatctgaaagcagctggctgatttcctcatcctgcattctcgccataagatgctgcggcgtcatgtcagcaccctcttcataaacagcgtacaggtatgctgccagcgcacgatgtccgtcaatgttaaattcaaagccgacacgctcaatcactttctttatgacgtttcggtctctcagcatatgagcgagcagaagtctttccgcgttctcataggcgggacggagacggcgccgtttcgcttttgtcgtcacccgggcccgtcttgtctgcggttcggcgtttttgtcgccgggggcgttttgtctggcgtagatggaaagctgttccgtcaaagattctaccgaaagagaaaattcagaggcgagctgcttcacatacatttcctgctcaagcgacccggaaagagcgctgatttctttcagcacttctttcatgtaagcgagccggtctccttcgtcagataagtttttccctttgcggaaatattgcattttaaaagccatgaccgtaacgcttgcatcaatgatatcggtccggaatttttctccgccccgggttctgatataatcatcaggatcaagcccgtcaggcagcatgcttactcttaccttacaatcagctttctggagcaggccggccgctttcagcgtagcttcgtacccggctttatccgaatcgtagcagagaatgacctcctgaacatttcttctgaggattttcacatgctcttcggtgagcgacgtccccattgtggcgatactttcttttacgcctgagctgacggcggatatgacgtcagcgaagccttcaaacagaacggctctctcctctttcctgatcggcaggcgcgccttatgaaagttatacagcagcttagatttatgaaacagcggcgtttccgggctgttcatatacttcggctgctggcttccgagcgcccttcctgaaaaagccgccacggctccgtggtgatcatgaatgggaaacataattctgtttctgaaacggtcaaaatacccgctgccgtcttcccttctgatcagcagacccgctttttccatcatttcttcctcaaaaccgcgctttttcaagaatttcgtcatgaaatcccaggaatccagcgcgtagccgatttcaaactcatctatgagctctttcgtaaaaccccttgataaaaggtaatctaacgcttcctggccttcctttgtatttattagcaaatgatggtaaaatttcttcagaagctcgtgggcttccgccatcttctgctctccggaagattcaggcctggatgcagagtgaatcgttatatcatcagggaaatcaatctgatatttatccgcaaggtgagaaacagcttccgtaaatgaatagccttccatctgccgtaagaaagagaaaacgttcccgcccgctccgcatccgaagcaatgaaagatctgcttatcgctggagacggaaaacgagggcgtgttttccccgtgaaacggacagagcccaaagtagttgcggccttgctttttcaattggacataatcacctatgacttcaacaatgtctgctgactgctgcacctgattaactacttcatctggtatgcggtttcccatcttataacactccgtcgtacattattcgatgttttgatttgaaatcccttcatcattcgacaggatttttttaagcagggtaacaaatcgattccgatcttctttatttaattttttaggtcctttggaatgaatgccgcttcttctcattttgcctgacatatgacggctcatcagagcgaagtcaatcgtgtcttcagtataagaacggcccctttccgataagacggcaatatttctgttcagcaaaagagatgctaaaccgatatcctgcgtgactacgacgtctcccgatctcacatggtttgcgatatataaatctgccgcttctttatgaggatcaacgtatacccagttctcgtctttgcttctggaaagctggtagtgttcaaatgatgcgacgaaaataacccgaacgctgaattgcgatgcaatgagcattatttcctcttttacggggcatgcgtctgcatcgacaaaaatcgtcttttctttttcatttagaagactaattctccatccctccatcaatctcctgcataaaaacaagcgaaatcgcatatgctccatgactgcggatctattttgagctttgtcgaaaaatttccgggagttattcttgacatcttacccataatagtttattcgtatcacacgaagcttaaacctaaaaataaacattttatcacaattttttattataatacaaacttcgcgaagatgccatcctttttgtttattccctatttgcatacccaaaaacccaggataaagcgtcctgagttatcggccctttgttttgagatgatgaatgatgttcgctgtttcttcgactgctttattcgaaacgtcaacgacttggcagccgatccggtccacgattttctcaaaatactccagctcttctttaattctgttgatattggcgtaaatggctttgtcatttaagccgagagattttaaccgttctttacgtatatggttcagtttatcagggctgatttttaagccgatgcattttttcggatcaacgctgaacagttcttccggcggatcgacctcaggaacgatcggcacattggccactttcagacgcttatgggcaagatattgtgataatggggttttagacgttctggatactccgagcaggatgatatcggcttttaaaatgcctcttggatccctgccatcgtcatatttgacggcaaactcgatcgcctcgacctttttgaaataatcttcatcaagctggcggacgcggcccggttcatatttggcggtcagaccgtaagccgattccattttatcgatgagcggaccgataatatcgtaatacagcacattcgctttttccgcttgttcaaccaggtatttgcgcatttcaggaacaacgagcgtaaaacaaataatgccgccgtccgctttggcgagagacacgacttcattaatggtgccgatatcttccacataaggtattcttctgatatgcgtatcatcggctgagccgttaaactggctgagcgaggcttttacaacgagttcggcggtttctccgactgagtctgatactacataaatgatgcgattgtccatgttatccccccgttagttttcaagcttatatgatttcattttctgataaactgacaagtatcttagtcatattcgttttggtaaaccggccgatgacctcaaagcctttatccgtatctttaataacgggcagggcatcgatctgtttttcaattaaatacttggcgatgtccatcacataatcatcacgccggcagacggcgatattcggcattcttgtcatgataatatgaaccggtattgaggcaagttcctgctggccgatgctcgcccgcagcaaatctttgcgtgacagcacaccgactaagacagcatcacgatctacgacaaataacgtgccgacatcttctaaaaacatggtgcagatggcatcgtataccgagacattttcattgatgacaacagggatcgattgaaaatctttcacttgcagctttttcaatttatccgcaagcagctgatttcccgttttccccgtataaaaataaccgacccgcggacgggcctctaagaagcctgacatggtgagtatggccaagtccggccgcagcgtggccctcgttaaattgagctgttctgcgatatgctctccggtaatcgggccgttttcctttacaatctgtaaaatttgttcttgccgtttatttaattcgatcgtactcaccacctttatggaagggtttctttatctatgttttcattctgtgatgtttatgtaaaaggggaaaagacgattgccgatcacacagcaaccgtctttttctttattttacaataagatgattcatattagcaaaagacttgattacatctgcaagagcggccatttgcgctaaacggttggtttttaatgcttcatcgtccgcatttaccatcgtgtgattaaagtaatcttcgatcggctcttttaatccgctgagcacggcaagcgcctgttcatagtttttggaggcaaagctttccgcgacactgtcttttgttttttcataagcgtcaaacagctttttctcctgttcattttcaaacagatccggcttgatatcgcggctctcgccttttttactgatggagataacccggccgagtgattcagccgtttctttaaagccgggtgtgccgaggtgcttctcaagcactcttgccttatgaacggctgcatacggctcaagttctgtgctgtccagaacggcttcaataacgtcatgacggatgtcttcggcgtttaagacgtatttcagacgctgtgtaaagaaatcgaggagttcattttctttttccgtttctgtcaacgacagcagttctttaaaagaaatgccccagttgcggtcgatcagaatggaaacaatgccgcttgcctgacggcgcaatccgtacggatcctgagaacctgtcggaattacgtcaatgctgaagaaggaagcaatcgtgtccagtttatcagctaacgccacgaccgcgccggtaaaggttgaaggcacttccccccggccgctctcggcatatagtgctcattgacagcggcagcgacggcttcatcttcaccgagcatgcgcgcatatttttctcccatcacgccttgaagctcagggaactcatagatcatatgtgtaaccaggtcaaatttagaaatctctgcggcgcgcttcacaagtttttgcgtctgttcatccgctttcaggcggacggcaagtttgcccgcaatggtgaccgctcttcttactttatccccgagggagccgagctcttcatggaaaacgatattttccagtttcttcacgttttcatcaatgttcagcttttggtcttctttgtagaagaacgcagcatctgaaagccttgctctcagcactttctcgtttccgcgggcaacattttcaattgcatggctgttcccgtttcgcaccgtaataaaatgaggaagcagattcccgttttcatcttttaccgggaagtagcgctgatgctctttcattgttgtcacgagcacttcttcagggatagaaagaaactcggattcaaaagatccgtaaagcgccgtcggatattccaccagatggttgacttcgttcagcagatcctcatcgaccggaatattccattttttcttggccgcaagcgcatccagctggctttggatcatttgtttgcgttctttcgggtcagcaatgacgctttgttctttcagcagcttttcgtatgatgacggcacatcaacagatacttcttggccgagaaagcggtgtccctgcgtgttccggcccgtctcgacatttgtgatttcaaacggaatgacatcttttccaaagagggcggcaatccatttgatcggacggatataacgcagatcctgcgtgccccagcgcatgtttttcggaaaatgcattccggcaatcaaattttccagctgcggtaaaagtgtcttcgtctcttgtcccgcctggaatttttgaacgaagacatattccgtgccgtttacatcttttatatacaggtcatccactccggcgccttggccttttgaaaatccgatagcggcttttgtccagtttccgtcagcatccagagcgatttttttcgcagggccttttgcttcttcctgaatatcagcctgtttttctgctacgtcttttatatatactgccagacgtctcggcgtattaaaaagtttcacttcgccgtgggcgatatttttttcagcaagccagccggtcagcttttcaccgagctgcaccatgctgtcatgtaaaaaccgcgccggcatttcctcgagtccgatctctaaaagcaagtcttgtttactcatgggaagagccctcctctttaagcattgggaaccctaatttttcccgttcttcataatacgtttttgccacttttctcgctaagttgcggacacggccgatatatcccgtccgctctgtcaccgagatcgcgccttttgcatcaagcagattaaatgtgtgagagcatttcagcacataatcataggccggatgcacaagcccgttatccatttgtctgatcgcttctttttcataggtgctgaacaaatggaaaagcatatccacgtcagatgtttcaaaagtataaacggaatgctcgtattcagccatcataaataaatctttcacagtaaatcctgacgtccattcaagatcaaagacgttttctttatcctgaatatatgacgcgagacgttcaataccatatgtgatctcaacggacaccggtttacattcaattccgcctacctgctggaaatatgtaaactgagtaatttccatcccgtcaagccatacttcccagccgagacctgcacagcctaaagacgggttttcccagttgtcttctacgaaacggatatcatgttcaagcgggtcaatgccgagcgcacgcaatgaatcaaggtaaagctcttgaatgttatcaggcgacggcttgataatgacttggaattggtgatgctgatagagcctgttcgggttttcaccgtaccgtccgtccgcaggccgtctggacggctcaacgtaagccactctccacggctccggcccgatgcttcgtaaaaatgtatacggactcattgtgcctgcgcctttctccacatcatacgactgcatgagcacacagccttcattcgaccagtgcttctgcaaggttaaaatcatatcttgaatgttcatttcaagcacctccactttctccattcttttacaagtgcggcggcaaccaaaaaactcccgtctctatgcttgccggccgcaaacatagggacgagagttctcccgcggttccaccctagttgctgaggatgtgaatcactcagcctctttttaaagggttgctcgagaatgcctttcgttgcgcgctcatccttagcttacactgtcctaaggtcgcttgtatgagttggacgcaagtacttctttctgtcactgcaacatattttataataaatgatcatataaaaagatgggcagaatgtcaacttttgttttcatccaaaaggttcttcatgctttccatctggtctaaaaaccgttttgactttaaataaagtcctgaatattcctcgtaatacagatcaatgacctgtttaatttcgtttttggtttcctgttttaacgagacgctgccgagccttccgatatcaaagtaataaaaaagccttagcagccttgccgtttgcggcgaaatcggaactctgtacggatccttttcaaagcagcggtggcagataaaaccgttatctcttatcgaaaaatgaaacgtcccttccccgcttttgcagtggacacaatgattcagctccggatacagccccatgacgccgagcattttcatctgcacgatgaatgtgatcacgtccgggtcagtcccgtcattcagcctcttaaaggattcgagaatcaattcgaataaataggggttcggtttcttctcttccgttcctttgtcagtgagttcagcgataaaagcggcatacgccgtcaaaaataaatcttctctgatcgttctcatgctgagaatcatttcaccctgctggagcgtgccgagtccggatgttctttgcattaaaaatgacccgtacaaaaacggctggctgactgctgacagccggctggctgacttcctggcgcctcttgccatgacgccgattttgccgtgttccctcgtcagcaatgtcacgattttattcgtctccccgtagtcattcgtacggagcacgattccttcacatttagtcagcatttccgcaccttccaacaacgggaggggccaagaggtttacaaaattggaaaatcaattcgggctagctcatcttccggttcttcgggtctttccaggttctctttttccagttctttaaaaagaaggtacgtatcaacacttcctgtttgagaaaatacgttccaggtaaaattcaacacaaaaaacccacctttcatcattaaactagcttgccaatccaaattcttacccttatcttgacctgatgtcctccttttcatgttaaacaaattttgctaacgaatccctgtttctgtgaggtaatcccacacatcaggcatgcgcctcagatgaattaatattcatcctctttgaagccgaaatcacgcagctgagacattttattccgccagtccttctgcactttcacccataattcgaggtaaacgcgtgaacccagcagcgcttcaatatcagcccgcgctcttttgccgacttctttcagaagcgctccttttttcccgatgacgatccctttttgagaatcccgctcaaccacaatggtggcggcgacatggacggagccgttctcctgccctttaatggactcgatagcgacagcgatgctgtgcggcacttcttcccttgtcagatggagcaccttttccctgatcagttcagaaataatgaaccgctcgggatggtcagtcacctgatcgctcggatagaactgaggcccttccggtaaatacgcttcaatctgcgcgagaagggtttcgacgttgttcccttccaaagctgagatcggcacgatttctttaaacggatagcgcgtacggtactcatcaattaaaagaagcagctggtcggggtggatcttatcaattttgtttacgatcagaaagaccggcgtggacgtctgtccgagcttttcaatgataaactcgtcgccctttccgtacccttcttcggcgttaatcataaataacaccaagtcaacttctttcagcgtattctgcgccactttcatcataaaatcgccaagcttgtgcttcggtttgtgaatgcccggtgtatcaataaaaatggtctgcgacgtgccggttgtcagcaccccttggactttatttcttgtcgtctggggtttgtcgctcatgatggcgatcttttgaccgatgaccctgtttaaaaaggtagactttccgacgttcggtcttccgatgatagatacaaatcctgatttaaagctttcgttcgtcatgtaaatcctccgatgaaaatgcgcccggcaataattcttccgcagtcatttcttttatttgtccttgtaagttggtcagaataacaagcatatcctttgagcacagctcggaaattacttgtctgcaggctccgcacggcgaaaccggtcccggagtatccgcagccacggcgagcatcgcaaattccgtatccccctcggaaacagctttgaatatcgccgtgcgttcagcacagttgcacatgctgtatgccgcattttcaatgttgcagcctctgtacacttttccgtctttggtaagaagagcggctcccactctgaaatttgaatacggtacatacgctgtgtcccgtgcttttaatgcttctgcaatcaattcttgtctgttcatgtgtacttaattcctctcttacctttatcctgtatgataccgctgtcacttttattttacataattatgatcggtttttcacgcccatttttggcaatgtaaaataattgtaagaatcttctgctaacatatcttcggcaggaagatgagtaaaccaatgatacacgatatcacggcaaagacgcaaacggctccggcggccgcgtcctttgccgcttttgcgagcgggtgatactgatcggtaactaaatccacaacatgctctatcgccgtatttaaaagctccaaagcaagcatccctccgatcagcaccaaaacaacggcccattcggctgtgctcagcccggtgagaaaaccgcaaacgataacggcgcaggccgcggtaatatgaaattgaaaattccgctctgaccgcgccgttttccagattcccctccatgcatggacaaagctcttcaggaacctgctccactcatttttatgatctcgtgagtccatactcatccagcaaatccttttgctttgaaaacatttcttcctcttcttcttttgtcatgtgatcatagccaagcaaatgcaaaaagccgtgcacggccagaaaaccgagctctctcataaacgaatggccgtactcttccgcctgctctttcgttctgtctgcgctgatgataatatctcctaaaacaggcggcatgtcggcgcctacgatttcaacctcgtcttcgccttcttcttcaagcgcaaatgaaatgacgtcagtcggggtgtcttttccccggtagtctctgttgatttctctgatttcttcatttgtcacaatcgtgaccgatacttcagcctgatcctgaacgccttctttttccgccgcgaattggagcagcttctccacttcttggagcgcatcagctgagacgctgttcgtttcatcaacaatatctatgagtaaacccatttatttcaccttcttcgtagcctccggatattcaatccgggagtggaaaattccttttaaagtcgcacatagtgtttttgcgatcgtatccagttctcggaacgtgagatcacattctgagaattgtccgtcctgaagcttatcggatataattccccgcaccagtttttcgatccgctcaggattgggattatgcatggaacggacggcggcttcaacgctgtcggccactgagataatagccgcttctttcgattgcggcttcggccccgggtagcggaactctttctctgtaatctggtcgcccttttctttcgctttataataaaagaattttaaaagggacgttccgtgatgctgttccgcgatatccacaagctctttcggaaacttatagcttctgagcatattcgcaccgtctgtcgtatgtgcgataatgatatttttgctgagctgcggagacagcttgtcatgcggattatccatattcatctgattttcaataaaatattgcggacgtttcgttttgccgagatcgtgataatacgctccgacccgtgccaaaagaccgtttgcccctacggcttcacaagccgcttccgacagatttgccaccatgacgctgtgatgatatgtaccgggtgtttccgttaaaatctttcgaagcaggggatgattcggattagacagttcaatcagcctcatcgttgaaagaatgccgaatcccgtctcaaaaaacggcatcagaccgataattaaaacggatgaagcaagtcccgagacgacccccatcagcatcagcgttccgatttcaaccggtgacagcgccgtattttgtattaataaaagcgacagcacgataatcatattaataaatgagacgaacagtcccgcctgcaatatttttgatctcgcattgtgtttccccaaaaacagaatgcctgaaatgctgctgattaaatagtaaatgccgatgacgtaattaaatgttcccgtcacaccctgattaaacatcatactgccgcagatcgccagaatgatgcttcctaaaatggcgagcctttcattgagcagcagcctgattaaaatcgcgccggcggcgatcggcacaagatagccgatattggtgtattcaatcttctgaaagagactgacgacttccataatgacgagaataagcgttgtaatgatagaaaacagcaaaagagatttatttttcagcttaagctcctgctgctgtttctcaaaatagtagacaagcgtggcaataaacagcccgatcatcagaagcagaccgctgatcggttttaacaggttggaattattcaaaagccccgtcagttcaagcttcctgtatacttcccggtcgatcagatcattctcttccacgagaacctgtccctgtttgatctgtaccggctggacgctgtctgacgcttcctggcgtttttcatccgtcgctttcggatcaaatacgtaattcgggatgaccgcgtattttccgatttcagtcgcagccgctaaatattttgacggcacagaagcgcttttcagctcttttgcgaccttatccttcgcttcggcaagcttttcagaaggaatttcactgctcatcaccgtattcaccgcggtaatgacggaatccctcacaaatgagaaatcttcattgtttgcatggagaagcgatttaatggcatcttccgagacggattcattgacatcctgtgtcagcttgtttttcaccgatttgaccagtgatttttccgatggtgactttttgtctttttccgcatcttttttcacttcgccgatgctgtcaaaaatggaagtgatcaggtcaagccggttgtcggtatagccttttttcagggtgtattgatcttccaccgcatcttcggccgcctgttttttcgattccgtcgcctgctgatcttccactgtggcgggcgcgtaaatcgtcttatcactgactgaaaacaaatccaaattaagtgattcaggttttacatgaataaagagcaaaccaaacatgatcgctgaaagcagcaggtacagcagcacatgggctgagcgggcatgtctgaaactgcggaaccgttcccgggcgcttttgcccttttccttctttttcaaaacaagaacctcctccctgaaacatcaggaacacatcatataaaaatgacccgataacgggagatcgggtcatttttgcattacttttgcttatcataagcttcaataatttttgcaacaagcggatgcctgaccacatctgtctggtcaagttcaatcacggagatgccgtttatatccttcagcatatccttcgctactgcaagtcccgatgtgacgcctttcggcaggtcaatttggcttacgtcgcccgtaatgatcattttagagccaaaacccaatctcgtcaaaaacattttcatttgagcgggagtggtattctgggcttcatcaagaatcacatacgcgtcgtcaagcgtccgccctctcatataggcaagcggggcaatttcgataacccctctttccataagacgctccgtatggtcgcttccgagcacatcatggagcgcgtcatacagcgggcgcagataaggatctactttttcctttaaatctccgggcagaaaaccgaggctctcgccggcttccacagcgggtcttgttaaaatgatttttttaatgtggccgttttttaaagcatgcaccgcttttacgaccgccaaataagttttgccggttcccgccggcccgatgccgaacaccatgtcgtttttcttcatcgccgccacatattctctttggccgagggttttgacacggatcggtttgccttttgccgttttcgttatttcctcttcatacatgctttcaaaatagtccagttcatctttttttgccattttcacggcatacagcacatcacgttccgaaatctcgatccccttgcgaattaaagtaaggagcgagcctaataatctgtcagcgatctcaaatgtttcatcattcccggaaacgtaaatggtttcaccgcgtgtgatgaggctaatgcccagatccttctccattaaatgtaaaaaggcatcttggctgccgaacaaagaaagtgcttcgtccgggcttttcagtttgtgattaatcgcaagtaaatgttctgccattctttagtctccctgaacaataggtgtggtttgaacgatatcttctataacttggtagagaataatcaactttactttaccattctcaacggattggtgcaaaactttttcactttccacctctccgctgccgtttaatcgcttttctacatcttgtcttcccattttgataccggcctgaaccgcttcgcctttcgtataagtccgcacggttgtttcactttctcttgtctgttcttgaacgtaagacaccggaagcttcatccccagaaattgaaacgggtgcttttcttcctctgttttcggatgtttcagcggctcctcattaaattcaaagccccaaaaaggcacgccccatgatccgaaagacagcttgtgcttcgtccttactttacccgtatatagcgtaaatgatgtttcaagaggcacggttacttctgacttgtaccatgtttctccgtaaatttccgcttttgaggcgactttccggtcttcatttccgatcagtcctgagacgagaagctgtcctttgttaacatgatcgttcacaaaagccatcggctgccccttttgcacgaacatccttttgatgaccgccttctttttggcaacgatatggcgggggctcacgtacttttcttttgtcggttcgtttttttcgaccactttcatatgaagggctgtcccgttcaattccacaccgacccacgtaatattatcaatgccgtttgttaatgatttttggattttctccggcgtcatcattaaaaattgcaaacggccttttttcacaccgatttcttcaaggtgctttaccatctgatgctcggtttcgggcttggcccctttaatatcaatgtcccaaatcatgttggacaaaagaaacaatataatgaaaaacatcacaaatcccgcagtgaagcccaggtttaattttgatttgagaagcagaaagggaagaccctttctttttgtaaagcttgctttgcattcatgttttctgatgactcttctgaaagcatgtacatcttgaagctgaatcatcagcagaacacagtcttgcttttttttcaccgcaaagatggcgattccgtttctcgtgcattcattcagcagccgttcaatcccttttcctttgacttccatttggactttacccgaaaaaaatgacagccatttgtttttcacattatttccccccggctttatgaatcgacatatcgtacgtgatctatcgtgccttccaaaaggatttcctcaggaaggattgccttaatgaccaagttttttcctgatatgatacattgcccctgcttgagcatcagcctgacttcttcttcgctgaacagcaggaggcctctgtgattctctatgtagatatgaagtctgccgaccatcgtaatacgaggcagatccatcataacgtccgggggaatttccaatgctcttgtcagccatgcctttacacgattctttctttgccccataaaaaaagaaccccctttcatctcatatgtatgatttgaaaaggggttctaacactttattttttaccgatgttccgcatggtccgatgcggtttttttgcacggggcggacccaaaacctcactgaatatgatgccttggaccgcagtttctttatttattttgagggctgatttcttcagagatgcgtttcgtgcgcgttgagaagtcagcttatgttcaagcccgttaaacatctgctccgtctccgctaggcgcttttcagcttcccttcttttttgctcaaaagggttctcttctgaaacggcaggcaattcttccgcttccggcttatgctctttctgcggctgtttttgatcctgcttttttgcctgattttcgggacgtgtacccggcggccgtttttcatctttgtttttcttgccgaatattgccgatataatgccgatgacggcggcaatgacgagcggatttgtcagaatctcgtgcatacagcggctccctccttaatagagaggttattgttggtcttcatcttgctggtcattcgtcagcttgccgatagaatccctcatgtccgtatccgcgtcgatattttttatgttcatatagtccatgacgccgatgtttccttcacgcagcgcttctgccatcgcaagcggcacttcggcttctgcttccacgacttttgcacgcatttcttctacgcgagcgcgcatttcctgctcttgggcgaccgccatggcacggcgctcttcggctttggcctgcgcaatgtttttgtctgcttctgcctgatccgtttgaagaatcgctccgatgtttttgccgatatcaacgtcggcgatgtcaatcgaaagaatttcaaaggcggtgcctgaatccagccctttgccaagtacggtctgcgaaatcatatcagggttttccagcacttttttatgattacccgaggaaccgattgtcgagacaatcccttctccgacacgggcgacaaccgtctcttctcccgctcctccgacaaggcgctcgatattggctcttacggtgattctggcttttgcttttacttcaattccgtccatggcgacacccgcgataaacggtgtttcaatgaccttcggattgacgctcatctgtacggcttccaatacgtcacgcccggccaggtcaatggctgcgcagcgttcaaatgtcagctcaatattggcgcgctgtgccgcaatcagggcattgaccaccctgtcgacattaccaccggccagataatggctttcgagctgatttgttgttgcggataggccggctttgtgcgctttaattaacggattgacaacgcggcttggtatgacgcgccgcagcctcattccgaccaaagtaaaaatgctgattctgactcctgccgcaagcgccgaaatccatagcatcaccggtacaaaggtgaagaatatggctaacacgattatggcagctgcaactattgctaaaatcgccaaacttgacagttccatctaattcctcctcaaggttatcatctatatttctctcacgacaatgcgtgagccttccgctttcactactttcacctgtctgtctttttcagtgaatgatccttccgagacgacatccagacgttcatcatcaataatgacggtgcctgacggtctgagggctgtagcggtaatgccgactttccccaacagctccgtccgattctgatttgaaacataaccgctctccgtgcttgttgaatcagttaatattaattttttaaagaatttcattcgtttccccaacacccttgttaatatgataaaggctgtaatagacacagcaatggcgatcaagagagaaaccgccattacggtaaagctgcccgcagcgagaaagaggctcgcgatgacgcctgcaataccgataagaccgattatgcctccgggcagaaatatctctaaaaggataaaaaccaagcccgcgcaaaataagaatacgctgtcatagccggcgaatccggcagcgatatgcccggtgaaaaacagcagcatggccgtcagtccgacggcacccggtatcccgaggcccggcgagaacaattcaatggtcaaaccaagcaaagcaagcgttaataagacggggacaacaaacggatttgtcagccatctgcccagtttgccgacgaaaccttcttttgcatggtgaacatccgctttgtcaaaacctagctttgtatataaagcatcaaggtctgaaaccgtgccctccgaatatccgacttccttggctttttcagctgtcagtgtcagcagttttccctttggggcgcccgcttcctttgcattgatggcgggatctgccatggccagggcgtatttcggatttcggttgtttttaaccgctgcgtcctccatttctgcatgccacagtgattgagcctttttgtccgccgcatttccttttccgtcgatgatggctgcggcacccatttttccgcccggcgccatatagatttcatctgcctgaagcgctatatacgctccggcagaaagcgcccgtttattaacgtaagcggtaacaggcacatccgcgcggccgatgatatccgcaatatccaaggctgattgaacggcgcctcccggtgtattgatgtcaagaataatgtgtgacgcgccggactccttcgcttctttgaaagaacgcgataaaaacgaggcgagcccctgttcgacatttttctcaaccgggatgacataaaccgatgggtgatcagctttcgcgttcaattgaacccctaataaagataatacaaataagcccaatagagcaacagcaattccgtttttttttcggaacaaggcaaatataccctccttcccgtttcgttcttctttatatacgtaacaaatgtactttagtttcatttttttatgtataaaaaaagacatctctctaggaaagatgtcttttttctcgtcaattaagataattgactgctgacaagtctgttaattacgctgccgtcagctttaccttttactttaggcataatagcactcatcactttgcccatgtccgctttggagctcgcaccgacttcagcgatggtttcatttacaattgtctgcagctcttcttcagaaagctgcttcggtaaataaatttctaaaatgtccagctctttttgaactttatctactaaatctaaacgatcagcgtttgaaaattcatggagggagtctttacgttgcttaagttcacgagataggacagtaagttcctcatcctcggtcaaactgtctttcttaagcttaattgcttcgttttgaagtgaagctttcaccattcgaacgacagtcagtttgtctttctcacggcttttcatatacagcttcatatcttggttaagtcgctcaagaagactcataaatccaccctcttttagaatttgcgttttctagcagcttctgactttttcttgcgctttacgctaggtttttcataaaattcgcgctttcttgcttcttgcaaagtacctgtctttgatacactgcgtttgaagcgacgaagagcatcttcaagcgattcgttttttctaacgaccgtttttgacattctctttccctccctccgaatacaccaatcgactacctttaaaaagatacatatataaacatgtactttgacattataatataagccatcagtcaggtcaactaagcgagctcacttttccgtcatgaataaggctgcttgtctatataatgatggaaaggggtgtttcgtttgataatactgattctctttaccgcacttatcctgttttttttactcggaatgagcctgctcaggcagggcctgatcgcattaacgtattcaaaaattgagaaaagcctgctcttatttaccgaccaccctttgaaagcttttctcataagcatcgtattcaccggttttcttcagagcagctcagccttcatggtcattgtcatcggctttgtcagcgcaggcgctttatcttttaaacggaccattccgatgattctcggcacgaatgtcggctccacatttacgacggagtttttagccataaagatggatgtgctcatttgggtgctttttatcggaggccttgtgtttatcctcatccgtaaatatccgttcaggcagatcggtataagcttcctcggtctcggcatcatctttttttgcatcacatgcttcagccggcttgccgttccgctgacagaaatgaaggcgggggcggaggttttgcgccatgtgaatgattcgagctggtccgctctttttatcggcatgatattgacggcaatcattcattcaagctccgtctgcatcggcattttgatgagttttatgaacgaaggggtgatcggcattgaacaagcggtcagcgtcattctgggatctaatatcgggacatgcgtcacggccgtcatggctgctgtttcaggcggttatgccgccagacagaccgccggtgctcacgtagtgtttaatattctcggcgtgctgctcgtctttcccttcctgtctgcatcagcaggtattacggagcgcctgtctgatgatcccgcgcagatgattgcgcatttcagcctgttatttaacgtagtcaccgcgttattgtttctgccgttcacacatttgttttaccggctgattgacaggctgattcctccgaaaccgtaaaaaaaccgatgcgggaaggcaccggtttttttatctgttatgaagacatgcgcatgttccgggtcatttcaccctcaacgacgcggacgaattgtccttcgttatacggatagcccgctttttgaattttgactttaacaagtttgccgattacatcttccgtgcctttgaagacgactttcatgtaattgtccgtatagccgacgaacatgccgtcctcatcagactctttaaatgcctcttccggaatgatttccagaacctctccttcataatcggaggcgtattctttggcaagctggtcagacagcgcaatcagcttatgcacccgttcgtttttcacgttctcgtcaacctggtcttccattctggccgcaggtgttccggtacgtttgctgtaagggaatacgtgaagctctgaaaacttatgttctttaatgaaccggtatgtttccataaattcttcttccgtttcacccgggaaaccgacgatgacatcagatgtgacggcaagacccggcagcgcttctttcagcttatttaaacggtccgcgaaaaattccatcgtatatttgcgtctcatccgtttcagaacggtgtttgatcctgactgaatcgggatatgaaggtggcggacgattttatcagacgcgtccagcacttcaatcacttcatcagtgatttggcttgcttcaatagatgaaattctgatccgcttcagtccttctacacgtgtatcaagctcgcggagaagcttggcgaaattataatctttcatatcttcgccgtagccgcccgtatgaatccccgtcaggacgatttctttatagccggcatccaccagctgctgcgcctgtttaatgacttcttccggatcgcgggaacgaagcaggccgcgcgcccaagggataatgcagaacgtacagaagttattgcagccctcttggatttttaacgacgctcttgtgcggtcagtaaaagcgggaacatccagctcttcaaacacgcgtgctttcataatattgccgacgccgttgatcggctgacgctcttccctgtactgctcaatgtaaccgagcattttttcacgatcctgcgtgccgacgacgatgtcaacacccgggatggccataatttctgccggagaggtttgcgcatagcaccctgttacgcagatgacgccgtcaggattttggcggatcgcccgtctgatgacttgacggctttttttatctcccgtgtttgttaccgtacatgtattaatgacatatacatctgctgtctgttcgaattcttttcgttcataacccgcatctttaaacagctgccagattgcttctgtttcataatgattgaccttgcagccaagggtatgaaaagcaacagttgccattactgatcacctcttaataactctgtatgataggaaactgcgcttaacgcgtaaagaggcgcagtttcagtccgtaaaattctcggtccgaggccgcataagacggcgcctttttctgaaagctgatgaacttcagactcagtcagaccgccttcagggccgaatacgattaaaagagacgaaccttgcggaaggcttttaagctccgcggcgaaagcgcccgtttctccctgctttgatgactcctcgtatgcaacgacacatttatcgacattctccgccatttcaagcagctgccggaacgtatgaacggttttcacttcgggaatttcattgcggtacgattgctccgccgcttccttcgcgattttcgcccatctctcccgctttttctttgcctttttgtcgtctagcttaacgacggatctggcgccttgaaaggggatgaacatactagcccccagctcggtccctttttggataatccattcaagcttatcgcctttcggaaggccgctggcaatcctgatcttcaaaggcagttcacggttttcacccgtccattcagcaatgctgcatgatatatgatctttagaaaccgctttgagcaggcataacgcttcatggccgtctttcgaacagcagataatccggtctcccgcactcattctcatgacgttcgctatatggtggacgtcttcccccgtaatttgaaaatcgggagtttcgtccatctcctgcttcgtgagctcgataaaatatcgttgcatacgctgtgacacctactaactgttattttttcgcgatgatgctgacccaatcttccatagacagaatctctgtgatggtaaagccggctttttccaacgcttcttttacttcctgttttttctggccgataatgcctgaagtaataaaatggcctccgtctttgagcaggtcgtacgcctgtgatgtaaagcggagaatcacttctgccaaaatatttgcgacaatgacatcatgttcgcccgtgatgccgtctaacaaattgttctgcttcacttcggccgtatcactcactttgttcaattttagattcagacgcgcgctttcaacagcgaccggatcaaggtcatatgcatgaaccgattcggcctcaagcatggcggccgcgatgcttaaaattcctgaaccggtgccgacatcaatgacacggtcgcctttttgaacgatacgctcaagcgcctgaatgcacagaacggttgtcggatgcgttcccgtaccgaatgccatgcccggatccatttcgataatcagttcatcggtattcacgggtgtgtacgtttcccatgtgggcacgatcgtgaatttttcagaaattttcaccggatgataatactttttccaagctgtcgcccattcttcttcattaacttcagaaatggtgattgtgtttctgcctaaatcaatgtcgtacaaaagcagattattaatcgtctctttaatgccgtccaccgtttcgccgaggaaactgttaatcggcagatacgctttgacaatgacaccctcatcggggtaatcattggggtcgagctggtagatttccccgtaaacattctcacgctctttcattaaatcaagcggatcttcgatgacaaccccgctcgcaccagcttcatgcaaaatatttgagatgggttcgaccgcttcatgtgttgtgtgaatgctgatttcggaccatttcaaaactaccaactcctatccaatcattactcgcctttaaatgcgcgttttactttgtcaaagaaactcatttcttgttcatccggcaggtttccgctgacttcagcgaactcgcggatgatgtctttttgtttgtctgtcagattcgtcggtgtgacgacgcggacgacaatgtgctggtcgccttgtccgtagccccggacgttctgaacgcctttgcctcttaatctgaatttcgtgcctgtttgtgtgccggcaggtattttcaatttcacttttccgtgaagcgtcggcacttccacttcgtctccgagtgctgcttgggcaaacgttaacggcatttcgcaataaatatcgtctccgtcgcgttcaaagaactcgtgggcgcgcacatggaatacgacaaacagatctcccgcaggccctccgtttacgccaggttcaccttggcccggaacgcgcagctgctgtccgtcatccacaccggcaggaatcgtgacattgatttttttccgttttttcactttgcccgtgccgccgcagtcagaacacttgtttttgatgatttttcctgttccttcacagtggtggcagactcttcggttaaccactttgccaaacggcgtgttctgttcgacgttcagctggcctgaacctccgcagtgcgagcacgtatccggctttgttcccggcttcgcgcccgatcctttacatgtttcgcaattctcttcgcgcggaatttcaatgatcgtttcttttccgaaagccgcgtcttcaaatgacagggtcattgtatactgcagatccgcgccttgccgcggcgcattcgggtcacggcgtctcgtgccgcctccgaagatgcttgagaatatgtcatcgaaaccgaagccgccgaagtctccgccgcctccgaaaccgccgccgaatccctggttagggtctgtatggccgaattggtcatattgagcgcgtttttggtcgtctgagagcgcttcgtacgcttcttttacctctttgaatttttcatctgctccggattctttattgatatcaggatgatatttttttgaaagcttccgataggcttttttgatttcatcctttgaagcgctcttacttaccccaagcacttcatagtaatcacgcttactcatctcgcttcactctcccgaatttctcacataaattagattgtatcattttgaattatgttttttcaattccttttatcccgggcaagaaaaaaagtcaaagccaagagatgcctgactttgactttctgtctgttgaatcagaatatgctgggtgttcttccgcctaaagccatgcgggaaagaacttattttttcgtttcgtcgtcttttacttcttcgtattccgcatcgacaacgttgtcatccgcttttttgccttcagcgtttgctgcgccttcagcctgctgcgcttttgccgcttcttcataaagcttcatagaaagctcttgaacgattgtttgaagctcatcttttttcgctttgatgtcttcaatttcgtttttctcgatagcggctttcagcgcgtctttcgcgtcgtttgcttttttcacttgctcttcgtccactttgccttccagatcttttaatgttttttccgtttggaacacaagctggtcagcttcgttgcggacttcgatttcttcttttctcttcgcatcagcgtcagcgttttcttccgcttcttttaccatgcgttcgatctcatcatcagaaagacctgaagaagatttgattgtaatgttttgttcttttcctgtgcctaagtctttcgctcttacgtttacgataccgtttttgtcaatatcgaaagaaacttcgatttgcggtacgccgcgcggtgcaggcgggatatcagtaagctggaagcggccgagcgttttgttgtcggcagacatcgggcgctcaccttgaagcacgtgaatgtcaacagccgtttggttgtcagctgcagttgagaatacttgagacttgctcgtcggaattgtcgtgttgcggtcgatcagtttcgtgaacacgccgcccattgtttcaataccgagagaaagcggtgtaacgtcaagaagaacaacgtcttttacgtctcccgtgatgacgccgccttgaatcgctgcacccaacgctacaacttcatcagggtttacgcctttatgcgcttctttacccgtttcttttttaattgcttcctgtacggcaggaatacgtgttgatccgccgacaaggataactttgtcgatttcgctcgcagaaagatccgcatcttgaagagcctgacggacaggagccattgtgcgctcaacaaggtgagcggaaagctcttcgaatttagcgcgggtcagtgtcagctcaaggtgaagaggacctgcttctcccgctgtgataaacggtaaagaaatttgtgtagatgatacgccggaaagatcttttttcgctttctcagccgcatctttcaaacgctgaagcgccattttgtcttttgaaagatcaatgccgttttcttttttgaattctgctacgagatgatcgatgatgacttggtcaaagtcgtccccgccaagacggttgtcaccggcagttgaacggacttcaaacacgccgtcgccaagttcaagaacagatacgtcaaacgtaccgccgccaaggtcgtaaacaagaatcgtttggtcttcgtccgttttatcaagtccgtatgcaagcgctgctgcagtcggctcgttgataatacgctctacctcaagaccggcgattttaccggcatcttttgtcgcttggcgctctgcatcgttgaagtatgcaggaaccgtgataacggcttttgaaactgtttcgccgaggtagctttcagcgtatgctttcagatgctgaaggataatagctgatacttcttgaggcgtgtagtcttttccttcgatttccactttatagtcagtacccatatggcgtttaacagacatgattgtgttaggatttgtgattgattggcgtttcgccacttcccctacttggcgctcgccgtttttaaatgcaacgactgacggagtcgtacggtttccttcagcgttggcgattactgtaggctctccgccttcaagcactgccacacatgagtttgtcgtacccaagtcaattccgattactttactcactttgaattacctcctgctatgtagttattgattcacttttaccattgaaggacggatgacgcgatccttcagtttgtagcctttttgcagttcttcgataacaatattgctgccgaagttttcatcttccacctgcatgacggcttggtgaaggttcggatcaaattcctgaccgacagcttcgatggcttcaacgccttctttttcaagtgcgtccatcagctgacggcggaccatttccataccttgcagcaagctttttgtctgctcgctttcagcttctacctgtaacgcccgttcaaagttgtcgagagccggaaggatttccgttacgacgttttgagaacggtatttctgagcagcttccatttcaaggcggctgcgtcgtttatagttttcaaagtctgcttgaacacgcaaaagcttgttttctttttcatcaagcaaaccctgcaattcatcaatttggtgctgaagggcttcttcctgacctgccgtttcttcatgctgctcttgtgaagccgcttgttctgcctgttctgtcacttcttcttgttctgctgcttcaacctgttctgcggtttgtttttcttctgacattgtgttcacctccctcaaatgctgtaaaaagatgactgaaaatgattgccaaaattcccttattcatcatacaaacttgtgaatgcttttgacaagtccgaagtcacgtgctgcagcaggctgacgactcttgaataattcatgcgcgtcggcccgataatcgcgattgatccgatctgcttcgtatcaactgtataggtggccgtgattaagctgcagttttccatttcttcgtagtcgttttctttcccgattttgattgaaattccggcttttgatgactgaaacagcttcagaacatcctgctctttttcaattaaagataagagcgagcggaccctttcaatatcgtggaactccggctgattcagcatgttgatctttccgccgaaaaacaatttctcaacgtgggccgccggatggaatgtggagcggagcgattcaagtatgctgtcatagttggcgatatgctgccttaaatatgtgacaacctctttgaaaatgcgctcattcaattcgtccatcggcacgcccgctaatcgatcgtttaatatattgaccagtttttcaatatcggccaaatccactttagccgggaaattgatggtgcggttttcgacatgccccgtgttcgtgacgaggatggcgaccgccttatccggctggatcggaacgatttgaatctgtttaagatagttctcgctcagcgtcggcccgaggacaatcgatgtgtagtttgtcagatcggacaggatttgcgctgatttttggactgttttttccagctcgaagattttttctttaaatatcgagtgaattaaatccagatcggtttttgtcagcttgacgggtgacagcaaatgatcgacataatacctgtaccctttttccgacggaatccgtcctgaggatgaatgggttttttcaataaagcccaattcctccaagtcagccatctcgtttctgatcgttgcagagctgaatgtaatctcgtctttttttgaaagagttcttgatcctacaggctgcgctgattgtataaaatcattaataatcacttgcaggatcaacagctgacgatttgttaacatcatcatcacccctgttagcactcaaggtcagcgagtgctaattctatatcaaaagtaacaaaccaaaagaaaaatgtcaattataactcacccaaaaaagcgccaaaaacctcatttcctaataatttgccctcatgcgttaatgcaaccgattcttccgtgtcacagatcaggcctttttcggttaaatctttgagaacatcgggaaacagttcgtcaaccgagcgtccgaatttatcgagaaaagcttgcttttgtacgccggacatttttctgagaccgaggaacatttcttcttcaatctgctcctcccgtgtcacctcgtgcgtatcacggtaaggcagccccttttcttcgatgagctgaatataatgtttcacaggcccggcgttgacggtgcgcgtgccgctgatatatccgtgagcgcctgcgccaaaaccgaaatacgcttcattgctccaatacgtcagattatgctgtgactcgtatccgggctttgcaaagttactgatctcgtattgacggatgcccgcttcactcatctgcctcatgaccgtttcatacatctcggcctcttgttcttgcgccgggagatgcagacggcctttttgcattaaattataaaacaccgttttcggctctacgatcagcgagtaaacggaataatgctccgcatcaagagacaaagccgttttgacggaattgtcaaggtcggccagcgtctgacccggcaggccgaacatcaaatcgagactgatgttgtcgaagccgagagccctcgctcgttcaaaggaagtgaatacgtccttttgtttatgcactctcccgattttttgtaaaagctcatcttcaaaggtttgaacaccgaaactcagccgattgacaccggcatttttcatgatttttaatttttccggggacaaatcatccggattcgcttccgcggcaaattctatgagtccgtcagaaggtttcagcacgcggtgaatggaatccatcaatttttccagctgggcgggtgagagcgatgtcggcgtgcctcccccgataaaaatcgtgcggagatcagggcgtcccgtccgttctattgtatttatcatttccttttcgagtgagtttaagtactcatcgacaggctggctctgaataaaatatttattgaaatcgcaatagtggcagatatgctcacaaaacggaatatgaatataagctgatttcattttgaaacaccttcttctttacagaaagaagccgcagcgcgggactgcggcggcttccgttattttttcgggctgtcatccattttaagaacggccataaacgcttcctgcggcacttctaccgagccgacctgcttcatccggcgttttccttctttttgtttttcaagaagcttccgtttccgcgagatgtctcctccgtaacattttgcaaggacgtttttccgcatggccttaatggttgagcgggccacgattttctgtccgatcgctgcctgcacgggcacttcgaattgctggcgggggatcaattctttcaatttttcgacgatgactttcccgcgctcgtatgcgtaatcgcggtgcacgataaacgacagcgcatcaattttttctgcattcagcataatgtccattttgacgagtttggacggtttgtagccgatcagctcgtaatcgaaagaggcgtaccctttcgtgctggatttcagctgatcaaaaaattcatatacgatttccgcaagaggcatctcatatacaatgctgacccggttggcgtctaagtactgcatatcgataaagttgccccgtttcccctggcaaagctccataaccgctccgacgtaatcgttcggaaccatcatcgtcgctttgacataaggttcttccacccgctctattttttgcgggtcaggcatgtttgacgggttatccacgatgatcttttcgccgtccgtcatataaacgtcataaataacgctcggcgcggtcgtaataaggtcaattttaaattcccgttcaatccgctcttgaatgatttccatgtgaagcattcctaaaaaaccgcagcggaaaccgaagccgagggcttgtgacgtctccgcctcgtattgaagagatgaatcgttcaattcaagtttttccagagcttcacgcaaatcattatatttggctgtgtcaatcggataaagtccgcagtataccatcggattgagtttgcggtagcccggaagcgcttctgccgcaggcttaaccgcgctcgtgatcgtatcaccgacacgggtgtcgccgacgtttttgattgcggctgtcaaatagcctacgtcaccgactgtcaattcgtcagccggctgcgctttcggcgtaaagacgccgacttcaatgacttcaaactcttttccggttgccatcattttaattttctggcccggtttgaccgttccttctacgactctgatatacgcgacgactccgcggtacgcgtcataaagcgagtcaaagatgagcgctttcagcggagcttccggatctcccgcgggagccggcactttttctacgatctgttctaaaatgtcttcgatgccgatgcccgctttcgctgaagcgaggacggcgtctgaagcgtcaaggccgataacgtcctcaacctcttgacgcacacgttctggctctgcgctcggaagatcgattttattaatgacaggaagaatctcaagatcattatcaagcgccagatagacgttcgccaatgtctgcgcttctattccctgagccgcatcaacaacgagaatcgcgccttcacaggcagccaggcttcgcgaaacttcatatgtaaagtcgacgtgtccgggcgtgtcgatgagatggaatatatattcttctccgtcttttgctttgtatttcagctgaacggaatttaatttgatggtaattccccgttcgcgttcaaggtccattgaatcaagcaattgttctttcatttcccgctgggtgatcgccgatgttttttctaaaatccgatccgccaaggtcgatttgccgtggtctatatgggcgatgatggagaaattccggattcttgactgcctctctaaacgcttttctttatctgtcacaatctatcactcctactattaaacgcaaaatacactagcttagattatatcaataggattgtaaacattcaattaaaacaagaaagagaaaagcttcctttaaggaatcatccgcttttctcttcatcaatgctatcggttcagtttcgaaacccactcgtacatcgcctgcgccgagtccgtcacggtatttgaaagggtttctcccgcttttgaaaacaggttgaaggtttccgcctgttccagctgtttttgtttttcttccagatctttcgccgtaacggtttgccccaaaatggaagcttctttttcctgtccttctccgccgccgagggtgaatgctccttttaaggagggatctttgtatcctttcatatcaagcattccgctgtttgcctgctgcatgccgaacaaaacgccgaaaaacatgacaatggcgatcagcaggcatttgccggtaaaacggatcattcgaatcacctgatttctattgttttttcttctctcctgattgcgagctgaccttgtctgcatcccagtacagttcgctgaacacatcggccacggcatctgatgcgcgcctcagttcttctagattgttatccacgcccccgaattccagcagaagcgaccggtcgtttaaatcctggttgtatactccattatctcccggagagccttttgataaaacaccgacgcttaagccggggtattttttctccatcagcttatgaagttcacttgcgagtttatagttttcttcaaaattagcgctttttttgccgaccacgatggcgactctggcatagctttttcctttgatgtcggctgtcgtatttttcttgcggcgggaatcccggtgaatgtctatggtatattgcaggtttttatttttggcgagcgcgctttttacgaccggccttgattcgtcatagcttcgcgcataatttaagccgtctttgttcaggcgggcctgaatgtcggttttatctacggtcgctcctacaccttgcgcttcaagcgcttttccgaacatatctccgacaagcgtgacattggccttcgaatggcgggcgttatccggatttgtttccccctttaacagaggaagataggattcggtattatgagtgtggtaaataaaaacgacttttttgctgcctgttgaatgtttcggcggcgccgtttcttcttttttcgttttgttttcgatttctgccaggttcacttctttttctttttccatcaccttcgacggcggcggagattcagcaggcatattcgtataatccgtcccctgccccgccagaaggatctccgtatcgtattgggcaaatcccggcagctcacgtcccaagaaactccgcgggtcttccatattaatacttgtcgccagttttaaggaaagccgggacagctgaaaagagtctttttcaggaagctctgaggcgaaataatgattttccataccgaggaggtgtgcaaacgcgtcacccggaagttctccggcaattccgtgaagagaatccgaagaaagcctcagttcagggcgaagcgatgtgagcacacccgataatacgaaaataacgataaggcttgtcataaacaaaaacatgcccttgagcgcatttccaccgtttactgcaacgacaatttgacggtttctgcgtttttttctcatgatttgaatccctccagcgcttgtctagtaattactctatgaacaagctagaggaggtagaaccattttaatgattataagagcctttgttatcttgtgacactttttcatgaagggcggtgtttaacccgtttgcaagcacgttcgccatatcatcaataaaggtgtcaatctccttcggcgtgaccatcagattatggccgagcggagagagcacttcgtgaatcagctggcgtttttcgttttcgtccagcgtgccgacaataccgagaaaggattggcgttctttttctccgggaaggtcttcgtctgtcagcaccttctttttgccgaagttcattccggcgggcaccagagatcttgacgggctgtcatctttcatctctctgccgaaatgctttaatatataatccaccgtatcgcttgcgatcgtaaccgcatcaacgacagtcggtaccccgattgcgatgacggggatgccgagcgtctccttgcttaattcttttctcttattgccgacgcctgatcccgggtgaatgcccgtatcagaaaattggatggtcgtgttcaccctttcaacggctcttgccgcaagagcgtctaccgcaatcacaaaatccggctttgattctttgatcacaccttgaataatatcgctcgtttcaattcccgttaatcccatcacaccgggagcaagcgcgctgaccggcctgtacccttcctgtacgttttccggctgaagcctgaacagatgccgtgtcacaagaaggttttcggtcacgagagggccgagcgcatccggcgtcacattccagttgccgagaccgacgatcaaacagcttgcatcctttggaatctttaatgccgacagataggcggaaaattcctcggcaaacacttccgttactttttcctgcatgtcagagtcgtgttcccgaaccccttgagcctcgatcgtgacatagcgtccctgctttttccccgatagctcggcgccttctttggtaatatcgacggttctgactttaatgccgcccttgtcgcgttctttttcaataaacccgtttatttcttttgtctgaccggcttgtccgtcttttaccgcctgtttcgtttctaccgctaaatccgtccgtatcagaaattgattgacattcagttcgttgtttttcacaggaaagacctccttcaatcatcgtggtacatagtgtggccatttacaaaacgaatcatgcgaatttacccatcaacgaaaaatactttacatttatattgcaatctaaagttctgtttgatagaatacaatttgttctattgtgaagaagatttaaccttaagacactgtgctacaggttgtatcttaggaggtgaaacacatgccaaacattaaatcagcgattaaacgtacaaaaacaaacaacgaacgccgcgctcataacgcgacaatcaaatctgctatgcgtactgcaatcaaacaagttgaagcttctgttgctaacaacgaagcggataaagcgaaaactgctctttctgaagcagcgaaacgcattgataaagcagtgaaaacaggtcttgtacacaaaaatgccgcagctcgatacaaatctagacttgcgaaacaagtgaacggactttctgcataatacaaaaacgatccctttaacggggatcgtttttttcattcagtccggagaagctcaaggagaaagagctccagcaagagctgcttgtcctttttccccgttttcatttcataatccatcactgcgagcctttctataatacgccgcagctcttcttcagaaaaaagcctcgcctgatccatcgccagctttacccggaaagggtgcacctttaagttggaagcgatttgcttttggccgtatccttgtcccgcaaaatactttgtctgcataatcagacggaattggttggcgatcagcgccataattttgatcggttcttcgttttgttttaaaagatcataaaatatttgaagactttccgtccgttttcggttcacgattttgttgatcagctcaaaaatattctgctccaaacttcttgcgacaagctcccggacatcttcaagcgtgatctcatgtctgtcaccggtgtaggcggagagtttttgtatttcctgatatatggaagacagatggccgtttgcaagcagaaccaaatgctcggcagcttctgtatccatcgttttattttcggatttcgccagattaatcgtaaaatcagtcgtctcctttgcattcagctccttagcttcaatcataagggctttttgcttcagcgctttcgtcagctttttccgttcgtccagcttttcatacggagccacaatcacaaagaccgtataaggcgcaggctccttcaggtaagtctccaaagcgcttgtattatgctctattttttctttctttttttctcctgttaaaaaagacggattttttacgataaccagccgcttctctcccataaacggaaacgtttccgcatcggttatggcctggtcaagcggatcctcttcaagatcaaaaacagacaggttaaaatctttagtctcctcatcaacgacagcttgtctgatccggctgacagtctcttggagcagatacgtttcttttccgtataagcaataaacggagcggacatccccttttttcagggctttccaaacatcaaataccatgatcgtatgacttcctctctttcttgatccccttctatcctaaattgagttcggcaaatagtaaagaggaagctttaaaaaggacagcttcctcatttataataaacgcctgattcacaagctcccgggtctgcttgtaaaaaggcgataatcacaagaacagaaaacgttaccatcacttctagatttttcaaaacaattccagtatacttagggaagtcaggagggatgaaattgaatgattttgaaaaaaacgttcaaagcaaacgaaatgatgctgttgactcagctgtcggttttgtcgtgtccttcggatttttcgcctttttgttcgtgatggcaacagccatccatcttatcggctcttagccgcattccgggctgctgtcaatcggcagtcttttttacttcttgcgccctggtttcttctatatcatatggagggaagacggaaaacgttccggcgcctttttcaaatctgtattgaatcgttccgctgatatcggtgcgaagcacattgacagagtacgccttcaaacgatccagcacttcttcatgcggatgatggtatcgattctcttttcctgctgaaatcagcgctgcttccggctgaagctgtttcaaaaaggcttcactcgttgagcttttgctgccgtgatgacccgccttcaatatatcagccttcagtttcggatacgttttcagcacttctgtttcgccgtccgattctaaatctcccgtcaaaagccagctcactccgcctaaaaccgtccaaagcaccagtgatgaatcatttttactctttccgtcagatgactccggagacagcacctgaaactgaagatcacccgctgtaatggtgtcgccccgctttgcttcggcaacgggaatgttgttttctttcgccatttttaatatgttctgatccttcggttcttttacgaatcccacggggacaattaaccgtttgactctatgatttttgattaacactccggcttctccgatgtgatcctgatccgcatgggttaaaaacagcgcatccagctttttcaccccttttccgtttaaaaacggaatcaaaaccttctcgccgatagaatacgggtggcgtttttctttccatgattctccgggataagcaatcactccccctgtatcaaccattacggtccctttgcggtatggcgcgcttataaacagcgagtctccctgcccgatatcaagcatatccgcttctccccatggactgaaatacggacggcatattaaataagccaaaaccgcgcagaaaaaaagagccgatttcctgagttttaaaaaacctcccttttccaaagccgcaaaaagcgtaaaaacggaaaccgcaagcagaagaagggaaagaaagtcaggctttgacacaatcatagtaaataaatcaacggatgccgcatatgtaatgaaatcatgcacaggcttcatcacaaggtcaaacatatcaaacaaacattctcccatctgccttgaaagcaaaagaagaaggaagccgatgacagaaaccggaatgacaaataacgtataaaatggcaccatcaccatgttcatcggaaaactgacaagtgaaatttgttgaaaatgatagagaagaaacggaagtgagctgagctctgcaatgaatgaggccatcgcaagcccggcaagtctgcttttccccgctttctttaaaatggaggatgacagaattaaagaggcgcttaccgcaaaggaaagctggaagcccgcctgccaaaggaagtaaggattaaacagcaggagcagcagataagacagagacaatgcagcagaggaatgaatgccgcgtttaacaagagttccggcgatataaaatcccagcatgagggatgcgcgcaatacggatggggcggcaccgctcagcagcgtatataccggcaaaaacagcagcagcaacatccccgccttttctcttgtcagcccgattctgatcagagcataaaatagtcccgccgtaataagaccgacatgcattcctgaaatcgccattaaatgaacgactcccagattttgatatgcactcagtatatcgtcctctatagaaaatctttcacctaaggtcagcgcttcaacaattccggcggaagattcaggcacgtgattccgaatgattgaaatcaaattttttctgatgttcagcagtttaaacagcggctgtttggatttttcacaccgctgaatggaagtcacggaaaataaccagtgaatctgctgagagtaaagatattccttataatcaaaacctccgggaatcgtcgcatgtgcaggctgttccagagagcctgtaaacgtgcagcgcatccccggttcaagctgttcaatgagtctcttttcctcaagagaccggattttatacgaagccgcccatttttccttgtcatgtgtacggataacggctgacattttcgctccgtcaaccttcggaatattagtgatgacggcctgttcagtataactgccggcctgatatcgcgttacattcgcagcgtcacaaaccgtataaagaaagaaataaacacaaaaagaaacgaggcagatgataaccggagcaggctgctttgtttttatcataataaagagaagatacagaagaaaaaggagcagaacccagaagacatgagcggcggcaattcccgcagttgcagaaaccgccgccagaggcagaagaaggtatttatatttcatttatacgtaactggtaaacagctcattggcctgttcatgaatttttttcagttcatctgccttaactcccgcatcagataattgctgaatcagacctgcgacaaaagacaatttttcgcgatttttgagatcgatgatcatttcatcaagttcgacctgctccaccttgactccggcttggctgaacagctcttttgcataaggctgtgttttgtaatcttcggcataatagaccgttttgatgcctgcctggataattgatttgcagcattgaatacaaggataatgcgtcacataaatttcggcgccctccgtcggaacaccgaacttagaacattgcagaatcgcattcatctctgcatgtatggtcctctggcaatgattatctattaaaaggcatccttcatcagcgcaa

(The sequence listing continues in the following parts.)

What is claimed is:

1. A method of controlling a population of pathogenic bacteria and/or fungi, the method comprising providing an effective amount of the isolated bacterial strain *Bacillus amyloliquefaciens* 298, a sample of which having been deposited as KCTC 13469BP at the Korean Collection for Type Cultures, thereby controlling the population of pathogenic bacteria and/or fungi.

2. The method of claim 1, wherein said isolated microbial strain is purified to a level of at least 99%.

* * * * *